US009551006B2

(12) United States Patent
Poraty et al.

(10) Patent No.: US 9,551,006 B2
(45) Date of Patent: Jan. 24, 2017

(54) ISOLATED POLYNUCLEOTIDES AND POLYPEPTIDES, AND METHODS OF USING SAME FOR IMPROVING PLANT PROPERTIES

(75) Inventors: Limor Poraty, Holon (IL); Sharon Ayal, Kiryat-Ekron (IL); Inbal Nurith Dangoor, Gedera (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 434 days.

(21) Appl. No.: 13/995,179

(22) PCT Filed: Dec. 21, 2011

(86) PCT No.: PCT/IB2011/055854
§ 371 (c)(1),
(2), (4) Date: Jun. 18, 2013

(87) PCT Pub. No.: WO2012/085862
PCT Pub. Date: Jun. 28, 2012

(65) Prior Publication Data
US 2013/0276169 A1    Oct. 17, 2013

Related U.S. Application Data

(60) Provisional application No. 61/487,749, filed on May 19, 2011, provisional application No. 61/425,953, filed on Dec. 22, 2010.

(51) Int. Cl.
*C12N 15/82* (2006.01)
*C07K 14/415* (2006.01)

(52) U.S. Cl.
CPC ......... *C12N 15/8273* (2013.01); *C07K 14/415* (2013.01); *C12N 15/8247* (2013.01); *C12N 15/8261* (2013.01); *C12N 15/8271* (2013.01)

(58) Field of Classification Search
None
See application file for complete search history.

(56) References Cited

U.S. PATENT DOCUMENTS

| | | | |
|---|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |

(Continued)

FOREIGN PATENT DOCUMENTS

| AU | 2005229157 | 10/2005 |
|---|---|---|
| AU | 2005234725 | 12/2005 |

(Continued)

OTHER PUBLICATIONS

Zhang et al., Plant J. 40(2):276-90 (2004).*
Guo et al., Proc. Natl. Acad. Sci. USA 101: 9205-9210 (2004).*
Stein & Nasrallah, Plant Physiol 101:1103-06 (1993).*
Morgante et al., Gene 344:93-103 (2005).*
Vonarx et al., Plant J 46:512-21 (2006).*
Whisstock & Lesk, Q Rev Biophys. 36(3):307-40 (2003).*
Zhang et al., Curr Opin Plant Biol 6:430-40 (2003).*
Jia et al., EMT14713 (2013).*
Sinclair et al., Trends Plant Sci 9(2):70-75 (2004).*
Communication Pursuant to Rule 58 EPC or Rule 159 EPC, Invitation to Remedy Deficiencies in the Application Documents Dated Dec. 6, 2013 From the European Patent Office Re. Application No. 11190921.4.
Patent Examination Report Dated Jan. 3, 2014 From the Australian Government, IP Australia Re. Application No. 2008278654.
Official Action Dated Jan. 9, 2014 From the US Patent and Trademark Office Re. U.S. Appl. No. 12/992,902.

(Continued)

*Primary Examiner* — David H Kruse
*Assistant Examiner* — Russell Boggs

(57) ABSTRACT

Provided are isolated polynucleotides which are at least 80% homologous to SEQ ID NO: 320, 1-319, 321-473, 836-1652, 1654-3221, 3225-3241, 3243-3630, 3632-4176 or 4177; and isolated polypeptides which are at least 80% homologous to SEQ ID NO: 760, 474-759, 761-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 or 7130, nucleic acid constructs comprising the isolated polynucleotides, transgenic plants expressing same and methods of using same for increasing abiotic stress tolerance, yield, biomass, growth rate, vigor, oil content, fiber yield, fiber quality, and/or nitrogen use efficiency of a plant.

7 Claims, 8 Drawing Sheets

(56) References Cited

U.S. PATENT DOCUMENTS

| | | | |
|---|---|---|---|
| 5,608,144 A | 3/1997 | Baden et al. | |
| 5,608,149 A | 3/1997 | Barry et al. | |
| 5,608,152 A | 3/1997 | Kridl et al. | |
| 5,620,882 A | 4/1997 | John | |
| 5,659,026 A | 8/1997 | Baszczynski et al. | |
| 5,693,507 A | 12/1997 | Daniell et al. | |
| 5,859,330 A | 1/1999 | Bestwick et al. | |
| 5,880,100 A | 3/1999 | Ogiso et al. | |
| 5,981,834 A | 11/1999 | John et al. | |
| 6,080,914 A | 6/2000 | Conner | |
| 6,084,153 A | 7/2000 | Good et al. | |
| 6,313,375 B1 | 11/2001 | Jung et al. | |
| 6,313,376 B1 | 11/2001 | Jung et al. | |
| 6,359,196 B1 | 3/2002 | Lok et al. | |
| 6,392,122 B1 | 5/2002 | Clendennen et al. | |
| 6,403,862 B1 | 6/2002 | Jiao et al. | |
| 6,472,588 B1 | 10/2002 | Haigler et al. | |
| 6,670,528 B1 | 12/2003 | Shinozaki et al. | |
| 6,720,477 B2 | 4/2004 | Da Costa e Silva et al. | |
| 7,214,786 B2 | 5/2007 | Kovalic et al. | |
| 7,554,007 B2 | 6/2009 | Ronen et al. | |
| 7,812,218 B2 | 10/2010 | Ronen et al. | |
| 7,910,800 B2 | 3/2011 | Karchi et al. | |
| 8,049,069 B2 | 11/2011 | Wu et al. | |
| 8,168,857 B2 | 5/2012 | Ayal et al. | |
| 8,426,682 B2 | 4/2013 | Ronen et al. | |
| 2002/0046419 A1 | 4/2002 | Choo et al. | |
| 2002/0049999 A1 | 4/2002 | Allen et al. | |
| 2002/0148007 A1 | 10/2002 | Jiao et al. | |
| 2002/0160378 A1 | 10/2002 | Harper et al. | |
| 2002/0170088 A1 | 11/2002 | Wilkins | |
| 2003/0005485 A1 | 1/2003 | Ohlrogge et al. | |
| 2003/0074697 A1 | 4/2003 | Allen et al. | |
| 2003/0084485 A1 | 5/2003 | Zhu et al. | |
| 2003/0162294 A1 | 8/2003 | Verbruggen | |
| 2003/0163839 A1 | 8/2003 | Helentjaris et al. | |
| 2003/0233670 A1 | 12/2003 | Edgerton et al. | |
| 2004/0006794 A1 | 1/2004 | Wilkins | |
| 2004/0019927 A1 | 1/2004 | Sherman et al. | |
| 2004/0031072 A1 | 2/2004 | La Rosa et al. | |
| 2004/0034888 A1 | 2/2004 | Liu et al. | |
| 2004/0123343 A1 | 6/2004 | La Rosa et al. | |
| 2004/0172684 A1 | 9/2004 | Kovalic et al. | |
| 2004/0181830 A1 | 9/2004 | Kovalic et al. | |
| 2005/0108791 A1 | 5/2005 | Edgerton | |
| 2006/0048240 A1 | 3/2006 | Alexandrov et al. | |
| 2006/0101543 A1 | 5/2006 | Somerville et al. | |
| 2006/0107345 A1* | 5/2006 | Alexandrov | C07K 14/415 800/278 |
| 2006/0123505 A1 | 6/2006 | Kikuchi et al. | |
| 2006/0123516 A1 | 6/2006 | Ronen et al. | |
| 2006/0137043 A1 | 6/2006 | Puzio et al. | |
| 2006/0143729 A1 | 6/2006 | Alexandrov et al. | |
| 2006/0150283 A1 | 7/2006 | Alexandrov et al. | |
| 2006/0168684 A1 | 7/2006 | Renz et al. | |
| 2006/0174373 A1 | 8/2006 | Gipmans et al. | |
| 2006/0179511 A1 | 8/2006 | Chomet et al. | |
| 2006/0183137 A1 | 8/2006 | Harper et al. | |
| 2006/0195943 A1 | 8/2006 | Feldmann et al. | |
| 2006/0206961 A1 | 9/2006 | Cirpus et al. | |
| 2006/0260002 A1 | 11/2006 | Ronen et al. | |
| 2006/0288451 A1 | 12/2006 | Val et al. | |
| 2007/0006345 A1 | 1/2007 | Alexandrov et al. | |
| 2007/0006346 A1 | 1/2007 | Alexandrov et al. | |
| 2007/0022495 A1* | 1/2007 | Reuber | C07K 14/415 800/279 |
| 2007/0044171 A1* | 2/2007 | Kovalic | C07K 14/415 800/278 |
| 2007/0044172 A1 | 2/2007 | Schneeberger et al. | |
| 2007/0061916 A1 | 3/2007 | Kovalic et al. | |
| 2007/0124833 A1 | 5/2007 | Abad et al. | |
| 2007/0169219 A1 | 7/2007 | Nadzan et al. | |
| 2007/0214517 A1 | 9/2007 | Alexandrov et al. | |
| 2007/0261130 A1 | 11/2007 | Lightner et al. | |
| 2008/0072340 A1 | 3/2008 | Troukhan et al. | |
| 2008/0076179 A1 | 3/2008 | Hartel et al. | |
| 2008/0148432 A1 | 6/2008 | Abad | |
| 2008/0196120 A1 | 8/2008 | Wu et al. | |
| 2008/0301839 A1 | 12/2008 | Ravanello | |
| 2009/0089898 A1 | 4/2009 | Karchi et al. | |
| 2009/0093620 A1 | 4/2009 | Kovalic et al. | |
| 2009/0094717 A1 | 4/2009 | Troukhan et al. | |
| 2009/0126042 A1 | 5/2009 | Ronen et al. | |
| 2009/0260109 A1 | 10/2009 | Ronen et al. | |
| 2009/0293154 A1 | 11/2009 | Yelin et al. | |
| 2010/0037352 A1 | 2/2010 | Alexandrov et al. | |
| 2010/0154077 A1 | 6/2010 | Emmanuel et al. | |
| 2010/0319088 A1 | 12/2010 | Ronen et al. | |
| 2011/0080674 A1 | 4/2011 | Durand | |
| 2011/0214206 A1 | 9/2011 | La Rosa et al. | |
| 2012/0060234 A1 | 3/2012 | Emmanuel et al. | |
| 2012/0084885 A1 | 4/2012 | Alexandrov et al. | |
| 2012/0096587 A1 | 4/2012 | Vinocur et al. | |
| 2012/0180164 A1 | 7/2012 | Ayal et al. | |
| 2012/0222169 A1 | 8/2012 | Ronen et al. | |
| 2012/0297504 A1 | 11/2012 | Granevitze et al. | |
| 2013/0125258 A1 | 5/2013 | Emmanuel et al. | |
| 2013/0167265 A1 | 6/2013 | Panik et al. | |
| 2013/0219562 A1 | 8/2013 | Ronen et al. | |
| 2013/0239255 A1 | 9/2013 | Ronen et al. | |
| 2013/0291223 A1 | 10/2013 | Emmanuel et al. | |
| 2014/0325709 A1* | 10/2014 | Plesch | C07K 14/245 800/298 |

FOREIGN PATENT DOCUMENTS

| | | |
|---|---|---|
| CN | 1823168 | 8/2006 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/141824 | 11/2009 |

(56) References Cited

FOREIGN PATENT DOCUMENTS

| | | |
|---|---|---|
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |
| WO | WO 2014/188428 | 11/2014 |
| WO | WO 2015/029031 | 3/2015 |
| WO | WO 2015/181823 | 12/2015 |

OTHER PUBLICATIONS

Bork et al. "Go Hunting in Sequence Databases But Watch Out for the Traps", Trends in Genetics, TIG, 12(10): 425-427, Oct. 1996.

Doerks et al. "Protein Annotation: Detective Work for Function Prediction", Trends in Genetics, TIG, 14(6): 248-250, Jun. 1998.

Smith et al. "The Challenges of Genome Sequence Annotation or 'The Devil Is in the Details'", Nature Biotechnology, 15: 1222-1223, Nov. 1997.

Applicant-Initiated Interview Summary Dated Dec. 20, 2013 From the US Patent and Trademark Office Re. U.S. Appl. No. 13/125,047.

Wing et al. "GA_Eb0026P18f Gossypium Arboreum 7-10 Dpa Fiber Library Gossypium Arboreum cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.

Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.

Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.

Yamada et al. "Arabidopsis Thaliana Clone RAFL14-87-A16 (R20399) Unknown Protein (At1g60770) mRNA, Complete Cds", GenBank Accession No. BT002876, Retrieved From the Internet, Jan. 21, 2010.

Yamada et al. "Arabidopsis Thaliana Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.

Yanagisawa et al. "Diversity and Similarity Among Recognition Sequences of Dof Transcription Factors", The Plant Journal, 17(2): 209-214, 1999.

Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.

Young et al. "Hypothetical Protein MTR_7g116270 [Medicago Truncatula]", Database NCBI [Online], GenBank: AES82688.1, Database Accession No. AES82688, Nov. 21, 2011.

Zabrouskov et al. "Oxidative Metabolism and the Physiological Age of Seed Potatoes Are Affected by Increased Alpha-Linolenate Content", Physiologia Plantarum, 116: 172-185, 2002.

Zhang et al. "Phosphatidic Acid Regulates Microtubule Organization by Interaction With MAP65-1 in Response to Salt Stress in Arabidopsis", The Plant Cell, 24: 4555-4576, Nov. 2012.

Communication Pursuant to Article 94(3) EPC Dated Dec. 8, 2008 From the European Patent Office Re.: Application No. 04734072.4.

International Preliminary Report on Patentability Dated Dec. 8, 2005 From the International Bureau of WIPO Re.: Application No. PCT/IL2004/000431.

International Preliminary Report on Patentability Dated Jan. 22, 2009 From the International Bureau of WIPO Re.: Application No. PCT/IL2006/001223.

Invitation to Pay Additional Fees Dated Feb. 7, 2008 From the International Searching Authority Re.: Application No. PCT/IL06/001223.

Invitation to Pay Additional Fees Dated Dec. 18, 2008 From the International Searching Authority Re.: Application No. PCT/IL08/01024.

Advisory Action Before the Filing of an Appeal Brief Dated Aug. 5, 2011 From the US Patent and Trademark Office Re. U.S. Appl. No. 12/083,978.

Advisory Action Before the Filing of an Appeal Brief Dated Aug. 29, 2012 From the US Patent and Trademark Office Re. U.S. Appl. No. 12/457,199.

Applicant-Initiated Interview Summary Dated Aug. 6, 2012 From the US Patent and Trademark Office Re. U.S. Appl. No. 12/669,975.

Communication Pursuant to Article 94(3) EPC Dated Apr. 3, 2012 From the European Patent Office Re.: Application No. 06766224.7.

Communication Pursuant to Article 94(3) EPC Dated Jan. 3, 2013 From the European Patent Office Re. Application No. 09807983.3.

Communication Pursuant to Article 94(3) EPC Dated Jul. 4, 2012 From the European Patent Office Re. Application No. 10194223.3.

Communication Pursuant to Article 94(3) EPC Dated Mar. 8, 2011 From the European Patent Office Re.: Application No. 06809784.9.

Communication Pursuant to Article 94(3) EPC Dated May 8, 2013 From the European Patent Office Re. Application No. 08776651.5.

Communication Pursuant to Article 94(3) EPC Dated Nov. 8, 2010 From the European Patent Office Re.: Application No. 04734072.4.

Communication Pursuant to Article 94(3) EPC Dated Sep. 9, 2009 From the European Patent Office Re.: Application No. 04734072.4.

Communication Pursuant to Article 94(3) EPC Dated May 12, 2010 From the European Patent Office Re.: Application No. 06766224.7.

Communication Pursuant to Article 94(3) EPC Dated Feb. 13, 2009 From the European Patent Office Re.: Application No. 05750089.4.

Communication Pursuant to Article 94(3) EPC Dated Jul. 13, 2012 From the European Patent Office Re. Application No. 11172514.9.

Communication Pursuant to Article 94(3) EPC Dated Feb. 14, 2012 From the European Patent Office Re.: Application No. 04734072.4.

Communication Pursuant to Article 94(3) EPC Dated Mar. 14, 2011 From the European Patent Office Re. Application No. 07849616.3.

Communication Pursuant to Article 94(3) EPC Dated Jun. 15, 2012 From the European Patent Office Re. Application No. 11154193.4.

Communication Pursuant to Article 94(3) EPC Dated Dec. 19, 2012 From the European Patent Office Re.: Application No. 04734072.4.

Communication Pursuant to Article 94(3) EPC Dated Nov. 19, 2010 From the European Patent Office Re.: Application No. 06809784.9.

Communication Pursuant to Article 94(3) EPC Dated Jun. 21, 2012 From the European Patent Office Re. Application No. 11154213.0.

Communication Pursuant to Article 94(3) EPC Dated Oct. 23, 2012 From the European Patent Office Re. Application No. 11154193.4.

Communication Pursuant to Article 94(3) EPC Dated Oct. 23, 2012 From the European Patent Office Re. Application No. 11154213.0.

Communication Pursuant to Article 94(3) EPC Dated Nov. 27, 2009 From the European Patent Office Re.: Application No. 06809784.9.

Communication Pursuant to Article 94(3) EPC Dated Jun. 29, 2011 From the European Patent Office Re. Application No. 08738191.9.

Communication Pursuant to Article 94(3) EPC Dated May 29, 2013 From the European Patent Office Re. Application No. 09823171.5.

Communication Pursuant to Rule 55 EPC Dated Mar. 16, 2012 From the European Patent Office Re. Application No. 11190921.4.

Communication Pursuant to Rule 58 EPC or Rule 159 EPC, Invitation to Remedy Deficiencies in the Application Documents Dated Jan. 19, 2012 From the European Patent Office Re. Application No. 11190922.2.

Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.

(56) References Cited

OTHER PUBLICATIONS

Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Communication Relating to the Results of the Partial International Search Dated Jul. 8, 2009 From the International Searching Authority Re.: Application No. PCT/IL2008/001657.
Decision on Granting a Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
English Summary of Examination Results Dated Dec. 28, 2012 From the National Office of Intellectual Property (NOIP) of Vietnam Re. Application No. 1-2009-02358.
European Search Report and the European Search Opinion Dated Nov. 2, 2011 From the European Patent Office Re. Application No. 10194223.3.
European Search Report and the European Search Opinion Dated Oct. 6, 2011 From the European Patent Office Re. Application No. 11172514.9.
European Search Report and the European Search Opinion Dated Aug. 9, 2010 From the European Patent Office Re.: Application No. 09163033.5.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Nov. 3, 2010 From the Government of India, Patent Office Re.: Application No. 158/CHENP/2007.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Examination Report Dated Dec. 7, 2012 From the Instituto Mexicano de la Propiedad Industrial Re. Application No. MX/a/2011/003575 and Its Translation Into English.
Examination Report Dated Jun. 11, 2012 From the Instituto Mexicano de la Propiedad Industrial Re. Application No. MX/a/2011/007294 and Its Translation Into English.
Examination Report Dated Mar. 13, 2013 From the Instituto Mexicano de la Propiedad Industrial Re. Application No. PA/a/2005/009380 and Its Summary in English.
Examination Report Dated Nov. 13, 2007 From the Government of India, Patent Office Re.: Application No. 3482/CHENP/2005.
Examination Report Dated Sep. 14, 2012 From the Australian Government IP Australia Re. Application No. 2007335706.
Examination Report Dated Oct. 15, 2012 From the Instituto Mexicano de la Propiedad Industrial Re. Application No. MX/a/2009/006660 and Its Translation Into English.
Examination Report Dated Aug. 16, 2012 From the Instituto Mexicano de la Propiedad Industrial Re. Application No. MX/a/2010/014097 and Its Translation Into English.
Examination Report Dated Feb. 17, 2010 From the Instituto Mexicano de la Propriedad Industrial Re. Application No. PA/a/2005/012565 and Its Summary in English.
Examination Report Dated Apr. 19, 2011 From the Instituto Mexicano de la Propriedad Industrial Re. Application No. MX/a/2008/002262 and Its Summary Into English.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examination Report Dated Sep. 22, 2010 From the Instituto Mexicano de la Propriedad Industrial Re. Application No. MX/a/2008/005280 and Its Summary Into English.
Examination Report Dated Mar. 23, 2013 From the Government of India, Patent Office, intellectual Property Building Re. Application No. 2570/CHENP/2008.
Examination Report Dated Jun. 25, 2012 From the Instituto Mexicano de la Propiedad Industrial Re. Application No. MX/a/2011/003575 and Its Translation Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Examiner's Report Dated Jan. 10, 2012 From the Australian Government, IP Australia Re. Application No. 2005234725.
Examiner's Report Dated Jan. 13, 2011 From the Australian Government, IP Australia Re.: Application No. 2005252469.
Examiner's Report Dated Jan. 13, 2012 From the Australian Government, IP Australia Re. Application No. 2011239323.
Examiner's Report Dated Mar. 15, 2012 From the Australian Government, IP Australia Re. Application No. 2011239323.
Examiner's Report Dated Dec. 17, 2009 From the Australian Government, IP Australia Re.: Application No. 2005252469.
Examiner's Report Dated Oct. 19, 2011 From the Australian Government, IP Australia Re. Application No. 2006281018.
Examiner's Report Dated Dec. 20, 2010 From the Australian Government, IP Australia Re. Application No. 2005234725.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Oct. 28, 2011 From the Australian Government, IP Australia Re. Application No. 2006307457.
Examiner's Report Dated Jun. 30, 2011 From the Australian Government, IP Australia Re. Application No. 2006307457.
Examiner's Report Dated Jan. 31, 2012 From the Australian Government, IP Australia Re. Application No. 2006281018.
Examiner's Report Dated Mar. 31, 2011 From the Australian Government, IP Australia Re.: Application No. 2005252469.
International Preliminary Report on Patentability Dated Dec. 1, 2011 From the International Bureau of WIPO Re. Application No. PCT/IL2008/000489.
International Preliminary Report on Patentability Dated Dec. 2, 2010 From the International Bureau of WIPO Re. Application No. PCT/IL2009/000508.
International Preliminary Report on Patentability Dated Mar. 3, 2011 From the International Bureau of WIPO Re.: Application No. PCT/IB2009/053633.
International Preliminary Report on Patentability Dated Feb. 4, 2010 From the International Bureau of WIPO Re.: Application No. PCT/IL2008/001024.
International Preliminary Report on Patentability Dated Jul. 4, 2013 From the International Bureau of WIPO Re. Application No. PCT/IB2011/055854.
International Preliminary Report on Patentability Dated Jul. 8, 2010 From the International Bureau of WIPO Re.: Application No. PCT/IL2008/001657.
International Preliminary Report on Patentability Dated Apr. 12, 2012 From the Interantional Bureau of WIPO Re. Application No. PCT/IB2010/052545.
International Preliminary Report on Patentability Dated Jul. 12, 2012 From the International Bureau of WIPO Re. Application No. PCT/IB2010/056023.
International Preliminary Report on Patentability Dated May 12, 2011 From the International Bureau of WIPO Re. Application No. PCT/IB2009/054774.
International Preliminary Report on Patentability Dated Jan. 14, 2010 From the International Bureau of WIPO Re.: Application No. PCT/IL2008/000489.
International Preliminary Report on Patentability Dated Mar. 14, 2013 From the International Bureau of WIPO Re. Application No. PCT/IB2011/053697.

(56) References Cited

OTHER PUBLICATIONS

International Preliminary Report on Patentability Dated Sep. 15, 2011 From the International Bureau of WIPO Re. Application No. PCT/IB32010/050871.
International Preliminary Report on Patentability Dated Feb. 21, 2013 From the International Bureau of WIPO Re. Application No. PCT/IB2011/051843.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 2, 2010 From the International Searching Authority Re. Application No. PCT/IB09/53633.
International Search Report and the Written Opinion Dated Jun. 2, 2010 From the International Searching Authority Re.: Application No. PCT/IB09/54774.
International Search Report and the Written Opinion Dated Aug. 6, 2012 From the International Searching Authority Re. Application No. PCT/IB2011/053697.
International Search Report and the Written Opinion Dated Dec. 6, 2011 From the International Searching Authority Re. Application No. PCT/IB2011/051843.
International Search Report and the Written Opinion Dated Sep. 6, 2012 From the International Searching Authority Re. Application No. PCT/IB2011/055854.
International Search Report and the Written Opinion Dated Jan. 7, 2013 From the International Searching Authority Re. Application No. PCT/IL2012/050154.
International Search Report and the Written Opinion Dated Sep. 7, 2010 From the International Searching Authority Re. Application No. PCT/IB10/50871.
International Search Report and the Written Opinion Dated Apr. 10, 2013 From the International Searching Authority Re. Application No. PCT/IL2012/050327.
International Search Report and the Written Opinion Dated May 12, 2013 From the International Searching Authority Re. Application No. PCT/IL2013/050172.
International Search Report and the Written Opinion Dated Mar. 16, 2012 From the International Searching Authority Re. Application No. PCT/IB2010/052545.
International Search Report and the Written Opinion Dated Feb. 17, 2010 From the International Searching Authority Re.: Application No. PCT/IL09/00508.
International Search Report and the Written Opinion Dated Aug. 22, 2011 From the International Searching Authority Re. Application No. PCT/IB2010/056023.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report and the Written Opinion Dated Oct. 31, 2011 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated Apr. 8, 2013 From the International Searching Authority Re. Application No. PCT/IL2013/050172.
Invitation to Pay Additional Fees Dated May 8, 2012 From the International Searching Authority Re. Application No. PCT/IB2011/053697.
Invitation to Pay Additional Fees Dated Sep. 8, 2006 From the International Searching Authority Re.: Application No. PCT/IL05/00627.
Invitation to Pay Additional Fees Dated Jun. 9, 2011 From the International Searching Authority Re. Application No. PCT/IB2010/056023.
Invitation to Pay Additional Fees Dated Jun. 15, 2012 From the International Searching Authority Re. Application No. PCT/IB2011/055854.
Invitation to Pay Additional Fees Dated Oct. 17, 2012 From the International Searching Authority Re. Application No. PCT/IL2012/050154.
Invitation to Pay Additional Fees Dated Aug. 18, 2011 From the International Searching Authority Re.: Application No. PCT/IL08/00489.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Invitation to Pay Additional Fees Dated Dec. 27, 2011 From the International Searching Authority Re. Application No. PCT/IB2010/052545.
Invitation to Pay Additional Fees Dated Dec. 31, 2012 From the International Searching Authority Re. Application No. PCT/IL2012/050327.
Notice of Allowance Dated Dec. 5, 2011 From the US Patent and Trademark Office Re. U.S. Appl. No. 12/448,359.
Notice of Allowance Dated Jan. 7, 2013 From the US Patent and Trademark Office Re. U.S. Appl. No. 12/457,199.
Notice of Allowance Dated Apr. 8, 2013 From the US Patent and Trademark Office Re. U.S. Appl. No. 12/594,853.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.: U.S. Appl. No. 11/990,386.
Notice of Allowance Dated Nov. 19, 2012 From the US Patent and Trademark Office Re. U.S. Appl. No. 13/450,547.
Notice of Grant Dated Jan. 14, 2011 From the Instituto Mexicano de la Propriedad Industrial Re. Application No. MX/a/2008/005280.
Office Action Dated Apr. 1, 2013 From the State Intellectual Property Office of the People's Republic of China Re. Application No. 200880127757.X and Its Translation Into English.
Office Action Dated Jan. 2, 2012 From the Israel Patent Office Re. Application No. 206118 and Its Translation Into English.
Office Action Dated Feb. 3, 2011 From the Israel Patent Office Re.: Application No. 172135 and Its Translation Into English.
Office Action Dated Aug. 4, 2010 From the Israel Patent Office Re.: Application No. 172135 and Its Translation Into English.

(56) References Cited

OTHER PUBLICATIONS

Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and Its Translation Into English.
Office Action Dated May 13, 2010 From the Israel Patent Office Re. Application No. 180022 and Its Translation Into English.
Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jun. 19, 2011 From the Israel Patent Office Re. Application No. 199391 and Its Translation Into English.
Office Action Dated Jun. 20, 2011 From the Israel Patent Office Re. Application No. 190918 and Its Translation Into English.
Office Action Dated Jan. 22, 2010 From the State Intellectual Property Office of the People's Republic of China Re.: Application No. 200580027481.4 and Its Translation Into English.
Office Action Dated Sep. 22, 2011 From the Israeli Patent Office Re. Application No. 201242 and Its Translation Into English.
Office Action Dated Jun. 25, 2012 From the State Intellectual Property Office of the People's Republic of China Re.: Application No. 200880109464.9 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Feb. 8, 2013 From the US Patent and Trademark Office Re. U.S. Appl. No. 12/594,853.
Official Action Dated Jul. 8, 2011 From the US Patent and Trademark Office Re. U.S. Appl. No. 12/083,978.
Official Action Dated Jun. 8, 2010 From the US Patent and Trademark Office Re.: U.S. Appl. No. 11/629,411.
Official Action Dated May 8, 2013 From the US Patent and Trademark Office Re. U.S. Appl. No. 13/125,047.
Official Action Dated Apr. 10, 2012 From the US Patent and Trademark Office Re. U.S. Appl. No. 12/669,975.
Official Action Dated May 10, 2011 From the US Patent and Trademark Office Re. U.S. Appl. No. 12/457,199.
Official Action Dated Jun. 13, 2012 From the US Patent and Trademark Office Re. U.S. Appl. No. 12/594,853.
Official Action Dated May 14, 2012 From the US Patent and Trademark Office Re. U.S. Appl. No. 12/457,199.
Official Action Dated Feb. 15, 2011 From the US Patent and Trademark Office Re. U.S. Appl. No. 12/448,359.
Official Action Dated May 15, 2009 From the US Patent and Trademark Office Re.: U.S. Appl. No. 11/990,386.
Official Action Dated Jul. 17, 2012 From the US Patent and Trademark Office Re. U.S. Appl. No. 12/834,106.
Official Action Dated Aug. 18, 2010 From the US Patent and Trademark Office Re. U.S. Appl. No. 12/083,978.
Official Action Dated Dec. 18, 2012 From the US Patent and Trademark Office Re. U.S. Appl. No. 12/834,106.
Official Action Dated Jan. 18, 2013 From the US Patent and Trademark Office Re. U.S. Appl. No. 12/669,975.
Official Action Dated Oct. 18, 2007 From the US Patent and Trademark Office Re.: U.S. Appl. No. 11/284,236.
Official Action Dated Jun. 19, 2012 From the US Patent and Trademark Office Re. U.S. Appl. No. 13/450,547.
Official Action Dated Sep. 19, 2011 From the US Patent and Trademark Office Re. U.S. Appl. No. 12/810,855.
Official Action Dated May 20, 2013 From the US Patent and Trademark Office Re. U.S. Appl. No. 13/059,231.
Official Action Dated Dec. 21, 2011 From the US Patent and Trademark Office Re. U.S. Appl. No. 12/810,855.
Official Action Dated Aug. 22, 2011 From the US Patent and Trademark Office Re. U.S. Appl. No. 12/457,199.
Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re.: U.S. Appl. No. 11/284,236.
Official Action Dated Apr. 29, 2011 From the US Patent and Trademark Office Re. U.S. Appl. No. 12/448,359.
Partial European Search Report Dated Jul. 12, 2011 From the European Patent Office Re. Application No. 10194223.3.
Partial European Search Report Dated Apr. 19, 2010 From the European Patent Office Re.: Application No. 09163033.5.
Patent Examination Report Dated Jan. 4, 2013 From the Australian Government, IP Australia Re. Application No. 2008344935.
Patent Examination Report Dated Dec. 12, 2012 From the Australian Government, IP Australia Re. Application No. 2008236316.
Patent Examination Report Dated Jun. 21, 2013 From the Australian Government, IP Australia Re. Application No. 2012241091.
Patent Examination Report Dated Jun. 27, 2013 From the Australian Government, IP Australia Re. Application No. 2012216482.
Patent Examination Report Dated May 31, 2013 From the Australian Government, IP Australia Re. Application No. 2008278654.
Requisition—Sequence Listing Dated May 8, 2013 From the Canadian Intellectual Property Office Re. Application No. 2,753,616.
Requisition by the Examiner Dated Feb. 2, 2012 From the Canadian Intellectual Property Office Re. Application No. 2,570,195.
Requisition by the Examiner Dated Oct. 3, 2012 From the Canadian Intellectual Property Office Re. Application No. 2,526,440.
Requisition by the Examiner Dated Apr. 11, 2013 From the Canadian Intellectual Property Office Re. Application No. 2,626,592.
Requisition by the Examiner Dated Feb. 12, 2013 From the Canadian Intellectual Property Office Re. Application No. 2,570,195.
Requisition by the Examiner Dated Jun. 15, 2011 From the Canadian Intellectual Property Office Re. Application No. 2,526,440.
Requisition by the Examiner Dated Mar. 25, 2013 From the Canadian Intellectual Property Office Re. Application No. 2,619,114.
Restriction Official Action Dated Feb. 1, 2012 From the US Patent and Trademark Office Re. U.S. Appl. No. 12/669,975.
Restriction Official Action Dated Mar. 1, 2013 From the US Patent and Trademark Office Re. U.S. Appl. No. 13/254,183.
Restriction Official Action Dated Apr. 4, 2013 From the US Patent and Trademark Office Re. U.S. Appl. No. 13/125,047.
Restriction Official Action Dated Apr. 11, 2012 From the US Patent and Trademark Office Re. U.S. Appl. No. 12/834,106.
Restriction Official Action Dated Feb. 13, 2012 From the US Patent and Trademark Office Re. U.S. Appl. No. 12/594,853.
Restriction Official Action Dated Nov. 13, 2012 From the US Patent and Trademark Office Re. U.S. Appl. No. 12/992,902.
Summary of Office Action Dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated Jan. 2, 2012 From the European Patent Office Re. Application No. 09807983.3.
Supplementary European Search Report and the European Search Opinion Dated Jul. 6, 2012 From the European Patent Office Re. Application No. 10748403.2.
Supplementary European Search Report and the European Search Opinion Dated May 6, 2011 From the European Patent Office Re. Application No. 09750276.9.

(56) References Cited

OTHER PUBLICATIONS

Supplementary European Search Report and the European Search Opinion Dated Aug. 11, 2010 From the European Patent Office Re. Application No. 08738191.9.
Supplementary European Search Report and the European Search Opinion Dated Feb. 14, 2013 From the European Patent Office Re. Application No. 10785834.2.
Supplementary European Search Report and the European Search Opinion Dated Sep. 14, 2009 From the European Patent Office Re.: Application No. 06809784.9.
Supplementary European Search Report and the European Search Opinion Dated Apr. 18, 2012 From the European Patent Office Re. Application No. 09823171.5.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of Decision of Rejection Dated Dec. 9, 2011 From the State Intellectual Property Office of the People's Republic of China Re.: Application No. 200580027481.4.
Translation of Examination Report Dated Sep. 6, 2010 From the Government of the People's Republic of Bangladesh, Department of Patents, Designs and Trademarks, Ministry of Industries Re. Application No. 275/2009.
Translation of Notice of Paying Restoration Fee for Unity of Invention Dated Oct. 29, 2012 From the State Intellectual Property Office of the People's Republic of China Re. Application No. 200880127757.X.
Translation of Notice of Payment of the Restoration Fee for Unity of Invention Dated Mar. 20, 2009 From the State Intellectual Property Office of the People's Republic of China Re.: Application No. 200580027481.4.
Translation of Notice to Amendment Dated Aug. 31, 2012 From the Thai Patent Office, Department of Intellectual Property Office Re. Application No. 0901000235.
Translation of Notification of the Office Action Dated Dec. 1, 2011 From the State Intellectual Property Office of the People's Republic of China Re. Application No. 200680047610.0.
Translation of Notification of the Office Action Dated Jun. 30, 2011 From the State Intellectual Property Office of the People's Republic of China Re. Application No. 200680047610.0.
Translation of Office Action Dated Jul. 1, 2011 From the State Intellectual Property Office of the People's Republic of China Re. Application No. 200880017707.6.
Translation of Office Action Dated Jan. 4, 2012 From the State Intellectual Property Office of the People's Republic of China Re. Application No. 200880109464.9.
Translation of Office Action Dated Apr. 9, 2012 From the State Intellectual Property Office of the People's Republic of China Re. Application No. 200880017707.6.
Translation of Office Action Dated Sep. 13, 2012 From the State Intellectual Property Office of the People's Republic of China Re. Application No. 200910217137.1.
Translation of Office Action Dated Jan. 17, 2012 From the State Intellectual Property Office of the People's Republic of China Re. Application No. 201110104274.1.
Translation of Office Action Dated Jan. 17, 2013 From the State Intellectual Property Office of the People's Republic of China Re. Application No. 201110104274.1.
Translation of Office Action Dated Oct. 19, 2010 From the State Intellectual Property Office of the People's Republic of China Re. Application No. 200680038391.X.
Translation of Office Action Dated Jun. 22, 2011 From the State intellectual Property Office of the People's Republic of China Re. Application No. 200880127685.9.
Translation of Office Action Dated Mar. 22, 2013 From the State Intellectual Property Office of the People's Republic of China Re. Application No. 200880109464.9.
Translation of Office Action Dated Feb. 25, 2013 From the State Intellectual Property Office of the People's Republic of China Re. Application No. 200910217137.1.
Translation of Office Action Dated Dec. 31, 2011 From the State Intellectual Property Office of the People's Republic of China Re. Application No. 200910217137.1.
Translation of Search Report Dated Jan. 17, 2013 From the State Intellectual Property Office of the People's Republic of China Re. Application No. 201110104274.1.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the international Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/IL04/00431.
Written Opinion Dated Aug. 27, 2008 From the International Searching Authority Re.: Application No. PCT/IL06/00947.
Adachi et al. "Oryza Sativa Japonica Group cDNA Clone:J023021L06, Full Insert Sequence", Database EMBASE [Online], XP002665608, Retrieved From EBI, Database Accession No. AK099270, Jul. 19, 2003.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Alcala et al. "EST543159 Tomato Callus *Solanum lycopersicum* cDNA Clone cLEC80A19 5-end, mRNA Sequence", GenBank: BI923254.1, GenBank Accession No. BI923254, Oct. 17, 2001.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, XP003018468, 13(2): 146-150, Apr. 1, 2002.
Arabidopsis Genome initiative "Analysis of the Genome Sequence of the Flowering Plant *Arabicopsis thaliana*" Nature, 408: 796-815, Dec. 14, 2000.
Backhaus et al. "Nucleotide Sequence of A cDNA for A P2 60S Acidic Ribosomal Protein From Parthenium Argentatum", Plant Physiology, 106: 395, 1994.
Bautista et al. "Arabidopsis Thaliana At5g06690 mRNA, Complete Cds", Unpublished, The Salk Institute for Biological Studies, La Jolla, CA, USA, GenBank: BT029447, Nov. 15, 2006.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Bernhardt et al. "The bHLH Genes GLABRA3 (GL3) and Enhancer of GLABRA3 (EGL3) Specify Epidermal Cell Fate in the Arabidopsis Root", Development, 130(26): 6431-6439, 2003.
Blast "BLAST Results", 1 P.
Blewitt et al. "BNLGHi10083 Six-Day Cotton Fiber Gossypium Hirsutum cDNA 5' Similar to (AC004521) Unknown Protein [Arabidopsis Thaliana], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber Gossypium Hirsutum cDNA 5' Similar to (AC004521) Unknown Protein [Arabidopsis Thalian], mRNA Sequence", XP002576189, Retrieved From EBI Accesion No. EMBL:AI730835, Database Accession No. AI730835, Jun. 12, 1999. Sequence.

(56) References Cited

OTHER PUBLICATIONS

Blewitt et al. "BNLGHi8396 Six-Day Cotton Fiber Gossypium Hirsutum cDNA 5' Similar to (AC004521) Unknown Protein [Arabidopsis Thaliana], mRNA Sequence", XP002576190, Retrieved From EBI Accession No. EMBL:AI27553, Database Accession No. AI27553, Jun. 12, 1999. Sequence.
Blewitt et al. "Gossypium Hirsutum Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Castelli et al. "Arabidopsis Thaliana Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "Arabidopsis Thaliana At2g40550 Gene, Complete CDS", Database EMBL [Online], XP002673499, Retrieved From EBI Accession No. EM_PL: BT022032.1, Database Accession No. BT022032, May 4, 2005.
Cheuk et al. "Arabidopsis Thaliana At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Ciddi et al. "Elicitation of *Taxus* SP. Cell Cultures for Production of Taxol", Biotechnology Letters, 17(12): 1343-1346, Dec. 1995.
Daniell et al. "Solanum Bulbocastanum Chloroplast, Complete Genome", GenBank NCBI, Accession No. NC_007943, Mar. 26, 2010. p. 1, Source, p. 10-11, Nucleotides 46590-47195, Gene 'RPS4'.
Davletova et al. "The Zinc-Finger Protein Zat12 Plays a Central Role in Reactive Oxygen and Abiotic Stress Signaling in Arabidopsis", Plant Physiology, 139: 847-856, Oct. 2005.
Del Pozo et al. "F-Box Proteins and Protein Degradation: An Emerging Theme in Cellular Regulation", Plant Molecular Biology, 44(2): 123-128, Sep. 2000.
Desveaux et al. "Whirly Transcription Factors: Defense Gene Regulation and Beyond", Trends in Plant Science, TiPS, 10(2): 95-102, Feb. 2005.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Friedberg "Automated Protein Function Prediction—The Genomic Challenge", Briefings in Bioinformatics, 7(3): 225-242, 2006.
Gardiner et al. "Zea Mays PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Good et al. "Can Less Yield More? Is Reducing Nutrient Input Into the Environment Compatible With Maintaining Crop Production?", Trends in Plant Science, 9(12): 597-605, Dec. 2004.

Good et al. "Engineering Nitrogen Use Efficiency With Alanine Aminotransferase", Canadian Journal of Botany, 85: 252-262, 2007.
Gowik et al. "Cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2-p. 1153, col. 1, § 1, Table 1.
Harwood "Plant Fatty Acid Synthesis", The AOCS Lipid Library, 11 P., Apr. 12, 2010.
Hattori et al. "An Acetohydroxy Acid Synthase Mutant Reveals a Single Site Involved in Multiple Herbicide Resistance", Molecular and General Genetics, 246: 419-425, 1995. Abstract!.
Hill et al. "Functional Analysis of Conserved Histidines in ADP-Glucose Pyrophosphorylase From *Escherichia coli*", Biochemical and Biophysical Research Communications, 244(2): 573-577, 1998.
Hirner et al. "Arabidopsis LHT1 is a High-Affinity Transporter for Cellular Amino Acid Uptake in Both Root Epidermis and Leaf Mesophyll", The Plant Cell, 18: 1931-1946, Aug. 2006.
Holmstroem et al. "Drought Tolerance in Tobacco", Nature, 379: 683-684, 1996. Abstract.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ishikawa et al. JP 2005-185101: Full Length cDNA of Plant and the Use Thereof, Database EMBL [Online], XP002678022, Retrieved From EBI Accession No. EM_PAT:HV067703, Database Accession No. HV067703, Jul. 15, 2011. Sequence.
Ji et al. "Gossypium Hirsutum Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Kano-Murakami et al. "A Rice Homeotic Gene, OSH1, Causes Unusual Phenotypes in Transgenic Tobacco", FEBS Letters, 334(3): 365-368, Nov. 1993.
Katavic et al. "Utility of the Arabidopsis FAE1 and Yeast SLC1-1 Genes for Improvement in Erucic Acid and Oil Content in Rapeseed", Biochemical Society Transactions, 28(6): 935-937, Dec. 2000.
Keskin et al. "A New, Structurally Nonredundant, Diverse Data Set of Protein-Protein Interfaces and Its Implications", Protein Science, 13: 1043-1055, 2004.
Kikuchi et al. "Oryza Sativa Japonica Group cDNA Clone:J023131O04, Full Insert Sequence", GenBank Database Accession No. AK072531, Jul. 2, 2013.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100% Identity to SEQ ID No. 7 Over 458 Nucleotides. Abstract.

(56) References Cited

OTHER PUBLICATIONS

Kim et al. "Arabidopsis Thaliana At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
La Rosa et al. "Oryza Sativa Nucleotide Sequence SEQ ID No. 31205", Database Geneseq [Online], XO002678024, Retrieved From EBI Accession No. GSN:ANL17203, Database Accession No. ANL17203, Dec. 28, 2007. Sequence.
Li et al. "Gossypium Hirsutum Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "Arabidopsis Thaliana Chromosome III BAC F7O18 Genomic Sequence, Complete Sequence", GenBank Accession No. AC011437, Oct. 30, 2002.
Liu et al. "Root-Specific Expression of a Western White Pine PR10 Gene is Mediated by Different Promoter Regions in Transgenic Tobacco", Plant Molecular Biology, 52: 103-120, 2003.
Lurin et al. "Genome-Wide Analysis of Arabidopsis Pentatricopeptide Repeat Proteins Reveals Their Essential Role in Organelle Biogenesis", The plant Cell, 16: 2089-2103, Aug. 2004.
Matsumoto et al. "*Hordeum vulgare* Subsp. *vulgare*, Full-Length cDNA", UniProtKB/TrEMBL, ID: F2DLE8-IIORVD, UniProt Accession No. F2DLE8, May 31, 2011.
Matz et al. "Gossypium Hirsutum GHDEL65 (ghdel65) mRNA, Complete CDS", GenBank Nucleotide, GenBank Accession No. AF336280, Mar. 15, 2001.
Maurel "Plant Aquaporins: Novel Functions and Regulation Properties", FEBS Letters, XP022078418, 581(12): 2227-2236, May 25, 2007. p. 2230, col. 2, Last § -p. 2231, col. 1, § 2, Fig.1.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.

Payne et al. "GL3 Encodes a bHLH Protein That Regulates Trichome Development in Arabidopsis Through Interaction With GL1 and TTG1", Genetics, 156: 1349-1362, Nov. 2000.
Payne et al. "Heterologous MYB Genes Distinct From GL1 Enhance Trichome Production When Overexpressed in Nicotiana Tabacum", Development, 126: 671-682, 1999.
Pilon-Smits et al. "Improved Performance of Transgenic Fructan-Accumulating Tobacco under Drought Stress", Plant Physiology, 107: 125-130, 1995.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Purnelle et al. "Arabidopsis Thaliana DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Quesada et al. "Genetic Architecture of NaCl Tolerance in Arabidopsis", Plant Physiology, 130: 951-963, 2002. Abstract!
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Rounsley et al. "Arabidopsis Thaliana Chromosome 2 Clone T2P4 Map CIC10A06, Complete Sequence", Database EMBl [Online], XP002673500, Retrieved From EBI Accession No. EMBL:AC002336, Database Accession No. AC002336, Jul. 18, 1997. Sequence.
Saez-Vasquez et al. "Accumulation and Nuclear Targeting of BnC24, A Brassica Napus Ribosomal Protein Corresponding to a mRNA Accumulating in Response to Cold Treatment", Plant Science, 156(1): 35-46, 2000.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Smart et al. "MIP Genes Are Down-Regulated Under Drought Stress in Nicotiana Glauca", Plant and Cell Physiology, XP002455682, 42(7): 686-693, 2001. p. 686, Reference to Database Entry AF290618, p. 692, l-h col., § 2.
Smart et al. "Nicotiana Glauca Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.
Soderlund et al. "Sequencing, Mapping, and Analysis of 27,455 Maize Full-Length cDNAs", PLoS Genetics, 5(11): e1000740-1-e1000740-13, Nov. 2009.
Su et al. "Molecular and Functional Characterization of a Family of Amino Acid Transporter From Arabidopsis", Plant Physiology, 136: 3104-3113, Oct. 2004.
Sunkar et al. "Small RNAs as Big Players in Plant Abiotic Stress Responses and Nutrient Deprivation", Trends in Plant Science, XP022148764, 12(7): 301-309, Jul. 1, 2007.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Taliercio et al. "GH_TMIRS_129_G10_F Cooton Normalized Library dT Primed Gossypium Hirsutum cDNA, mRNA Sequence", EMBL-Bank, XP002659970, Retrieved From EBI Accession No. EM_EST:DW508992, Database Accession No. DW508992.
Taliercio et al. "GH_TMIRS_129_G10_R Cotton Normalized Library dT Primed Gossypium IIirsutum cDNA, mRNA Sequence", EMBL-Bank, XP002659971, Retrieved From EBI Accession No. EM_EST:DW508993, Database Accession No. DW508993.

(56) References Cited

OTHER PUBLICATIONS

Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Tarczynski et al. "Stress Protection of Transgenic Tobacco by Production of the Osmolyte Mannitol", Science, 259: 508-510, 1993. Abstract!
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218814, XP002455680, Database Accession No. AW218814, Dec. 14, 1999. Abstract.
Van der Hoeven et al. "EST301295 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218815, XP002455681, Database Accession No. AW218815, Dec. 14, 1999. Abstract.
Van der Hoeven et al. "EST312975 Tomato Root During/After Fruit Set, Cornell University Solanum Lycopersicum cDNA Clone cLEX14O20 5-, mRNA Sequence", GenBank, GenBank Accession No. AW622177.1.
Van der Hoeven et al. "EST428934 Tomato Nutrient Deficient Roots Lycopersicon Esculentum cDNA Clone cLEW26B2 5' Sequence, mRNA Sequence", Database EMBL, Retrieved From EBI Accession No. EMBL, Database Accession No. BF098413, 2000.
Van Haaren et al. "A Functional Map of the Fruit-Specific Promoter of the Tomato 2A11 Gene", Plant Molecular Biology, 21: 625-640, 1993. Abstract!
Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004. GenEmbl Database, Accession No. AY641990.
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!
Wells "Additivity of Mutational Effects in Proteins", Biochemistry, 29 (37): 8509-8517, 1990.
Whisstock et al. "Prediction of Protein Function from Protein Sequence and Structure," Quarterly Reviews of Biophysics 36 (3): 307-340, Aug. 2003.
Wing et al. "An Integrated Analysis of the Genetics, Devlopment, and Evolution of Cotton Fiber", NBCI GenBank Accession No. BE052336, 2000.
Wing et al. "GA_Eb0023F09f Gossypium Arboreum 7-10 Dpa Fiber Library Gossypium Arboreum cDNA Clone GA_Eb0023F09f, mRNA Sequence", XP002576191, Retrieved From EBI Accession No. EMBL:BF275177, Database Accession No. BF275177, Nov. 20, 2000. Sequence.
Examination Report Dated May 23, 2013 From the Instituto Mexicano de la Propiedad industrial Re. Application No. MX/a/2011/001741 and its Translation Into English.
Invitation to Pay Additional Fees Dated Jul. 17, 2013 From the International Searching Authority Re. Application No. PCT/IB2013/054374.
Official Action Dated Jun. 24, 2013 From the US Patent and Trademark Office Re. U.S. Appl. No. 12/992,902.
Official Action Dated Jul. 26, 2013 From the US Patent and Trademark Office Re. U.S. Appl. No. 13/254,183.
Johansson et al. "The Role of Aquaporins in Cellular and Whole Plant Water Balance," Biochimica et Biophysica Acta 1465: 324-342, 2000.
Matsumoto et al. "Os11g0162200 [Oryza Sativa Japonica Group]", Direct GenBank Sequence Submission, GenBank: BAF27672.1, GenBank Accession No. BAF27672, Aug. 11, 2012.
Communication Pursuant to Article 94(3) EPC Dated Aug. 2, 2013 From the European Patent Office Re. Application No. 10194223.3.
Examination Report Dated Jul. 9, 2013 From the Instituto Mexican de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
Examination Report Dated Jun. 7, 2013 From the Instituto Mexicano de la Propiedad Industrial Re. Application No. MX/a/2011/003575 and Its Translation Into English.
Examination Report Dated Jun. 20, 2013 From the Instituto Mexicano de la Propiedad Industrial Re. Application No. MX/a/2011/007294 and Its Translation Into English.
International Search Report and the Written Opinion Dated Sep. 1, 2013 From the International Searching Authority Re. Application No. PCT/IB2013/054374.
Bennetzen et al. "Setaria Italica Strain Yugul SETITScaffold 2 Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
NCBI "Predicted: Nudix Hydrolase 16, Mitochondrial-Like [Setaria Italica]", Database NCBI [Online], NCBI Reference Sequence: XP_004955808, Jun. 26, 2013.
Communication Pursuant to Article 94(3) EPC Dated Aug. 20, 2013 From the European Patent Office Re. Application No. 11172514.9.
Official Action Dated Sep. 16, 2013 From the US Patent and Trademark Office Re. U.S. Appl. No. 13/125,047.
Translation of Office Action Dated Aug. 28, 2013 From the State Intellectual Property Office of the People's Republic of China Re. Application No. 200880109464.9.
Clontech "Genome Walker™ Universal Kit User Manual", Clontech Laboratories Inc., Cat. No. 638904, PT3042-1 (PR742239), p. 1-30, Apr. 25, 2007.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Examination Report Dated Jul. 29, 2013 From the Instituto Mexicano de la Propiedad Industrial Re. Application No. MX/a/2010/012697 and Its Translation Into English.
Official Action Dated Sep. 20, 2013 From the US Patent and Trademark Office Re. U.S. Appl. No. 12/669,975.
Communication Pursuant to Article 94(3) EPC Dated Oct. 9, 2013 From the European Patent Office Re. Application No. 08869158.9.
Invitation to Pay Additional Fees Dated Oct. 16, 2013 From the International Searching Authority Re. Application No. PCT/IL2013/050725.

(56) References Cited

OTHER PUBLICATIONS

Office Action Dated Sep. 9, 2013 From the State Intellectual Property Office of the People's Republic of China Re. Application No. 200910217137.1 and Its Translation Into English.
Supplementary European Search Report and the European Search Opinion Dated Oct. 15, 2013 From the European Patent Office Re. Application No. 10840687.7.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No:653 and Is Used for the Same Purpose, Abstract, Sequence.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.
Office Action Dated Oct. 28, 2013 From the State Intellectual Property Office of the People's Republic of China Re. Application No. 201110104274.1 and Its Translation Into English.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propiedad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 Arabidopsis Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
Requisition by the Examiner Dated Aug. 27, 2013 From the Canadian Intellectual Property Office Re. Application No. 2,526,440.
Advisory Action Before the Filing of an Appeal Brief Dated Nov. 19, 2013 From the US Patent and Trademark Office Re. U.S. Appl. No. 12/834,106.
International Search Report and the Written Opinion Dated Nov. 19, 2013 From the International Searching Authority Re. Application No. PCT/IL2013/050725.
Yu et al. "Cell Cycle Checkpoint Protein MAD2 Homolog [Zea Mays]", Database NCBI [Online], GenBank: AAD30555.1, GenBank Accession No. AAD30555, May 17, 1999.
Applicant-Initiated Interview Summary Dated Nov. 20, 2013 From the US Patent and Trademark Office Re. U.S. Appl. No. 13/125,047.
Requisition by the Examiner Dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Patent Examination Report Dated Dec. 16, 2015 From the Australian Government, IP Australia Re. Application No. 2011346525.
Examination Report Dated Mar. 30, 2016 From the Instituto Mexicano de la Propiedad Industrial, IMPI, Re. Application No. MX/a/2013/007208 and Its Translation Into English.
Notice of Allowance Dated Nov. 15, 2013 From the US Patent and Trademark Office Re. U.S. Appl. No. 12/669,975.
Patent Examination Report Dated Jul. 20, 2015 From the Australian Government, IP Australia Re. Application No. 2011346525.
Examination Report Dated Dec. 16, 2013 From the Government of India, Patent Office, Intellectual Property Building Re. Application No. 2570/CHENP/2008.
Li et al. "Dehydration-Induced Protein RD22-Like Protein [Gossypium Hirsutum]", NCBI Database [Online], GenBank: AAL67991.1, GenBank Accession No. AAL67991, Dec. 4, 2002.
Examination Report Dated Oct. 1, 2013 From the Instituto Mexicano de la Propiedad Industrial Re. Application No. MX/a/2010/000975 and Its Translation Into English.
International Preliminary Report on Patentability Dated Nov. 14, 2013 From the International Bureau of WIPO Re. Application No. PCT/IL2012/050154.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.

\* cited by examiner pQFN, pQFNc

Nitrogen limiting conditions

Osmotic stress (15 % PEG)

Normal conditions

ISOLATED POLYNUCLEOTIDES AND POLYPEPTIDES, AND METHODS OF USING SAME FOR IMPROVING PLANT PROPERTIES

RELATED APPLICATIONS

This application is a National Phase of PCT Patent Application No. PCT/IB2011/055854 having International filing date of Dec. 21, 2011, which claims the benefit of priority under 35 USC §119(e) of U.S. Provisional Patent Applications No. 61/425,953 filed on Dec. 22, 2010 and No. 61/487,749 filed on May 19, 2011. The contents of the above applications are all incorporated by reference as if fully set forth herein in their entirety.

SEQUENCE LISTING STATEMENT

The ASCII file, entitled 56778SequenceListing.txt, created on Jun. 5, 2013 comprising 19,969,175 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic plants expressing same and methods of using same for increasing abiotic stress to tolerance (ABST), water use efficiency (WUE), yield (e.g., grain quantity and/or quality, oil yield), biomass, oil content, growth rate, vigor, fiber yield and/or quality, nitrogen use efficiency (NUE) and/or fertilizer use efficiency (FUE) of a plant.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. In addition, chilling may lead to yield losses and lower product quality through the delayed ripening of maize. Excessive light conditions, which occur under clear atmospheric conditions subsequent to cold late summer/autumn night's, can lead to photoinhibition of photosynthesis (disruption of photosynthesis).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture.

Nitrogen is an essential macronutrient for the plant, responsible for biosynthesis of amino and nucleic acids, prosthetic groups, plant hormones, plant chemical defenses, etc. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate to pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 2005010879 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in to deeper soil layers. Triggering this effect will allow the plants to access nutrients and water located in deeper soil horizons particularly those readily dissolved in water like nitrates.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, protein and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

WO publication No. 2009/083958 discloses methods of increasing water use efficiency, fertilizer use efficiency, biotic/abiotic stress tolerance, yield and biomass in plant and plants generated thereby.

WO publication No. 2010/020941 discloses methods of increasing nitrogen use efficiency, abiotic stress tolerance, yield and biomass in plants and plants generated thereby.

WO publication No. 2009/141824 discloses isolated polynucleotides and methods using same for increasing plant utility.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO publication No. 2004/081173 discloses novel plant derived regulatory sequences and constructs and methods of using such sequences for directing expression of exogenous polynucleotide sequences in plants.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO publication No. 2004/111183 discloses nucleotide sequences for regulating gene expression in plant trichomes and constructs and methods utilizing same.

SUMMARY OF THE INVENTION

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence encoding a polypeptide at least 80% identical to SEQ ID NO: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 or 7130, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence encoding a polypeptide selected from the group consisting of SEQ ID NOs: 474-835, 4178-6223, 6226-7129 and 7130, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence at least 80% identical to SEQ ID NO: 1-473, 836-1652, 1654-3221, 3225-3241, 3243-3630, 3632-4176 or 4177, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising the nucleic acid sequence selected from the group consisting of SEQ ID NOs: 1-473, 836-4176 and 4177, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 or 7130, wherein the amino acid sequence is capable of increasing abiotic stress tolerance, yield, biomass, growth rate, vigor, oil content, fiber yield, fiber quality, and/or nitrogen use efficiency of a plant.

According to an aspect of some embodiments of the present invention there is provided an isolated polynucleotide comprising a nucleic acid sequence encoding a polypeptide which comprises the amino acid sequence selected from the group.

According to an aspect of some embodiments of the present invention there is provided an isolated polynucleotide comprising a nucleic acid sequence at least 80% identical to SEQ ID NO:1-473, 836-1652, 1654-3221, 3225-3241, 3243-3630, 3632-4176 or 4177, wherein the nucleic acid sequence is capable of increasing abiotic stress tolerance, yield, biomass, growth rate, vigor, oil content, fiber yield, fiber quality, and/or nitrogen use efficiency of a plant.

According to an aspect of some embodiments of the present invention there is provided an isolated polynucleotide comprising the nucleic acid sequence selected from the group consisting of SEQ ID NOs: 1-473, 836-4176 and 4177.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% to homologous to SEQ ID NO: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 or 7130, wherein the amino acid sequence is capable of increasing abiotic stress tolerance, yield, biomass, growth rate, vigor, oil content, fiber yield, fiber quality, and/or nitrogen use efficiency of a plant.

According to an aspect of some embodiments of the present invention there is provided an isolated polypeptide comprising the amino acid sequence selected from the group consisting of SEQ ID NOs: 474-835, 4178-6223, 6226-7129 and 7130.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 474-835, 4178-6223, 6226-7129 and 7130.

According to some embodiments of the invention, the nucleic acid sequence is selected from the group consisting of SEQ ID NOs: 1-473, 836-4176 and 4177.

According to some embodiments of the invention, the polynucleotide consists of the nucleic acid sequence selected from the group consisting of SEQ ID NOs: 1-473, 836-4176 and 4177.

According to some embodiments of the invention, the nucleic acid sequence encodes the amino acid sequence selected from the group consisting of SEQ ID NOs: 474-835, 4178-6223, 6226-7129 and 7130.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of some embodiments of the invention.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
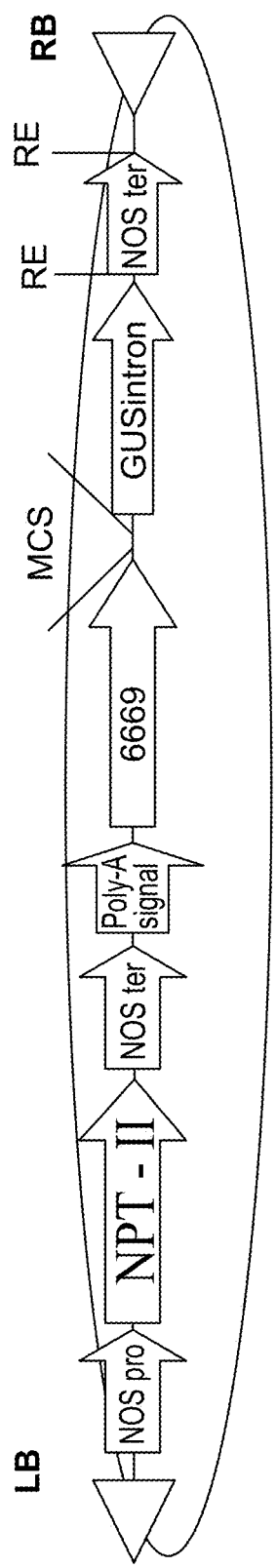
FIG. 1 is a schematic illustration of the modified pGI binary plasmid containing the new At6669 promoter (SEQ ID NO:7724) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron).
Figure 2:
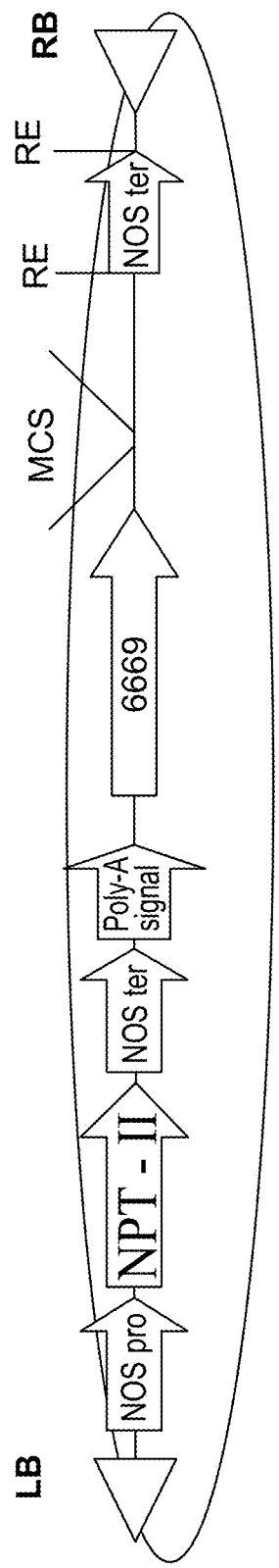
FIG. 2 is a schematic illustration of the modified pGI binary plasmid containing the new At6669 promoter (SEQ ID NO:7724) (pQFN, pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector pQFNc.
Figure 3E:
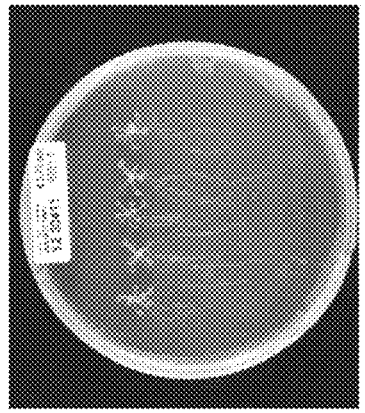
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
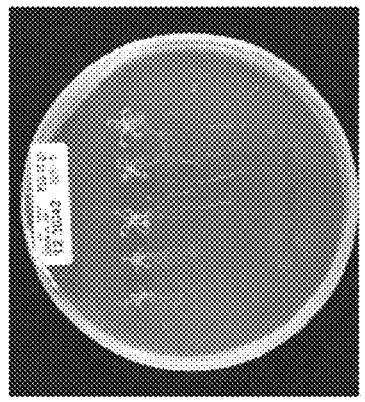
Figure 3A:
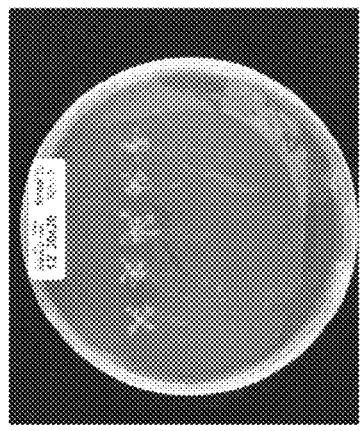
Figure 3F:
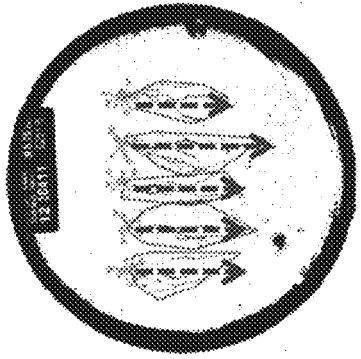
Figure 3D:
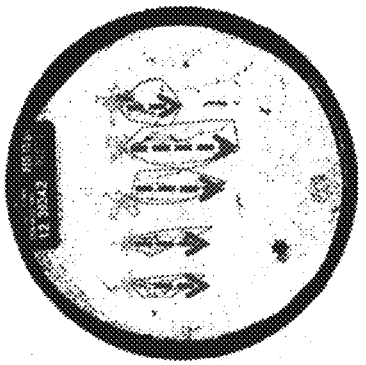
Figure 3B:
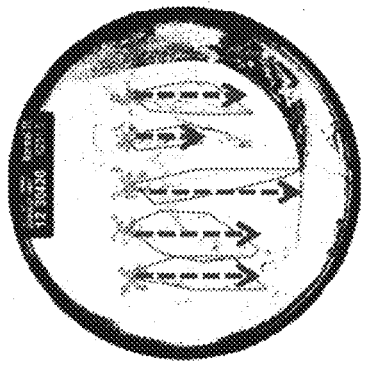
Figure 4:
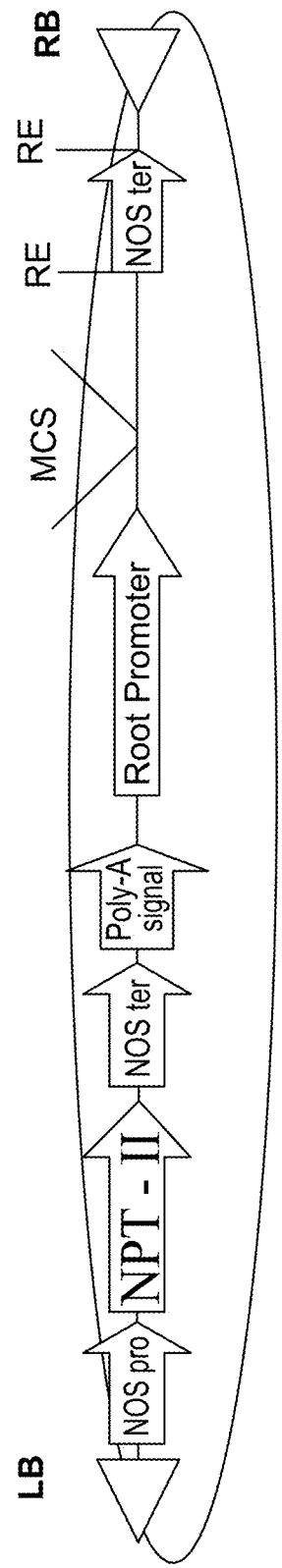
FIG. 4 is a schematic illustration of the modified pGI binary plasmid containing the Root Promoter (pQNa_RP; SEQ ID NO:7725) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS of the vector.
Figure 5:
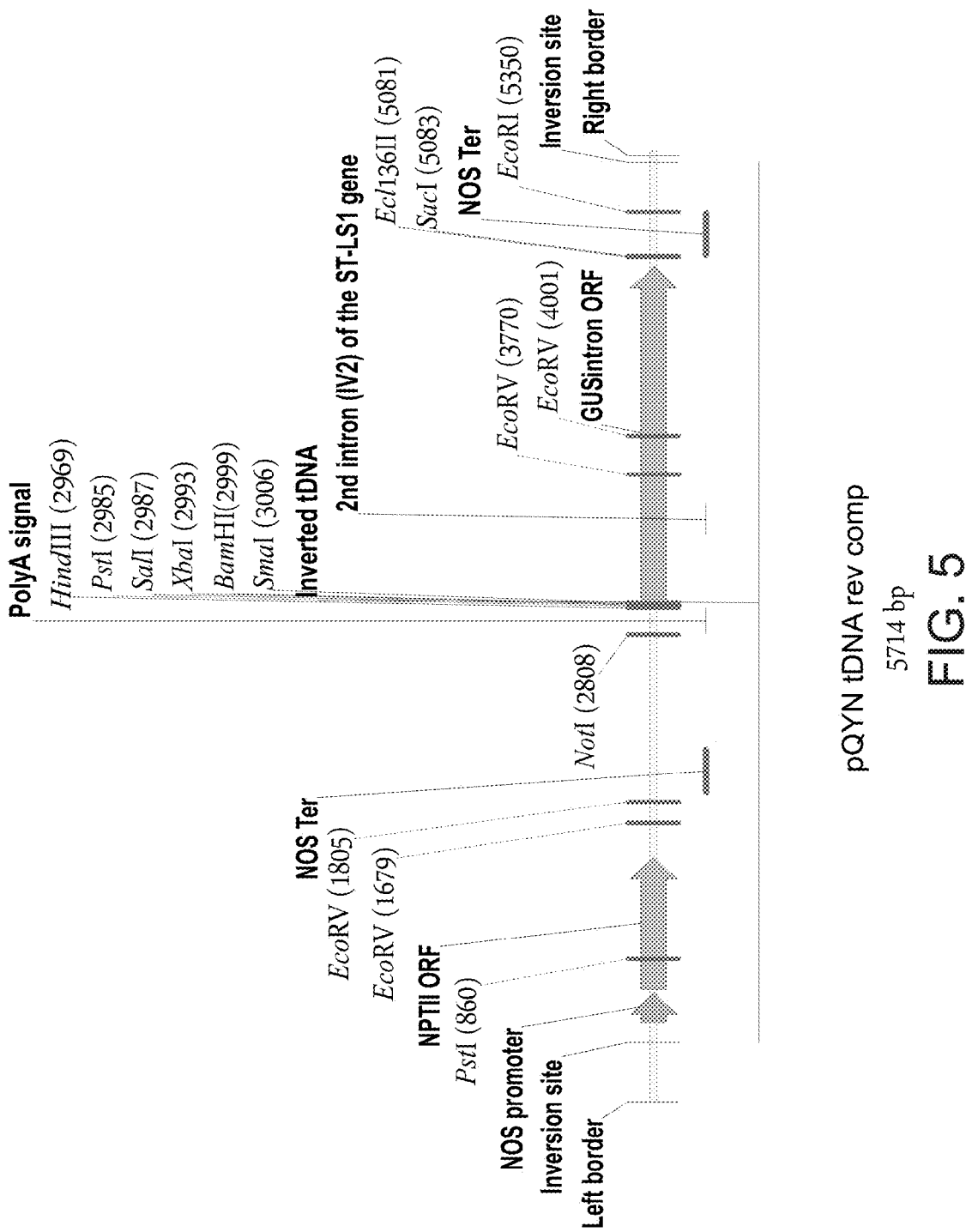
FIG. 5 is a schematic illustration of the pQYN plasmid (5714 bp).
Figure 6:
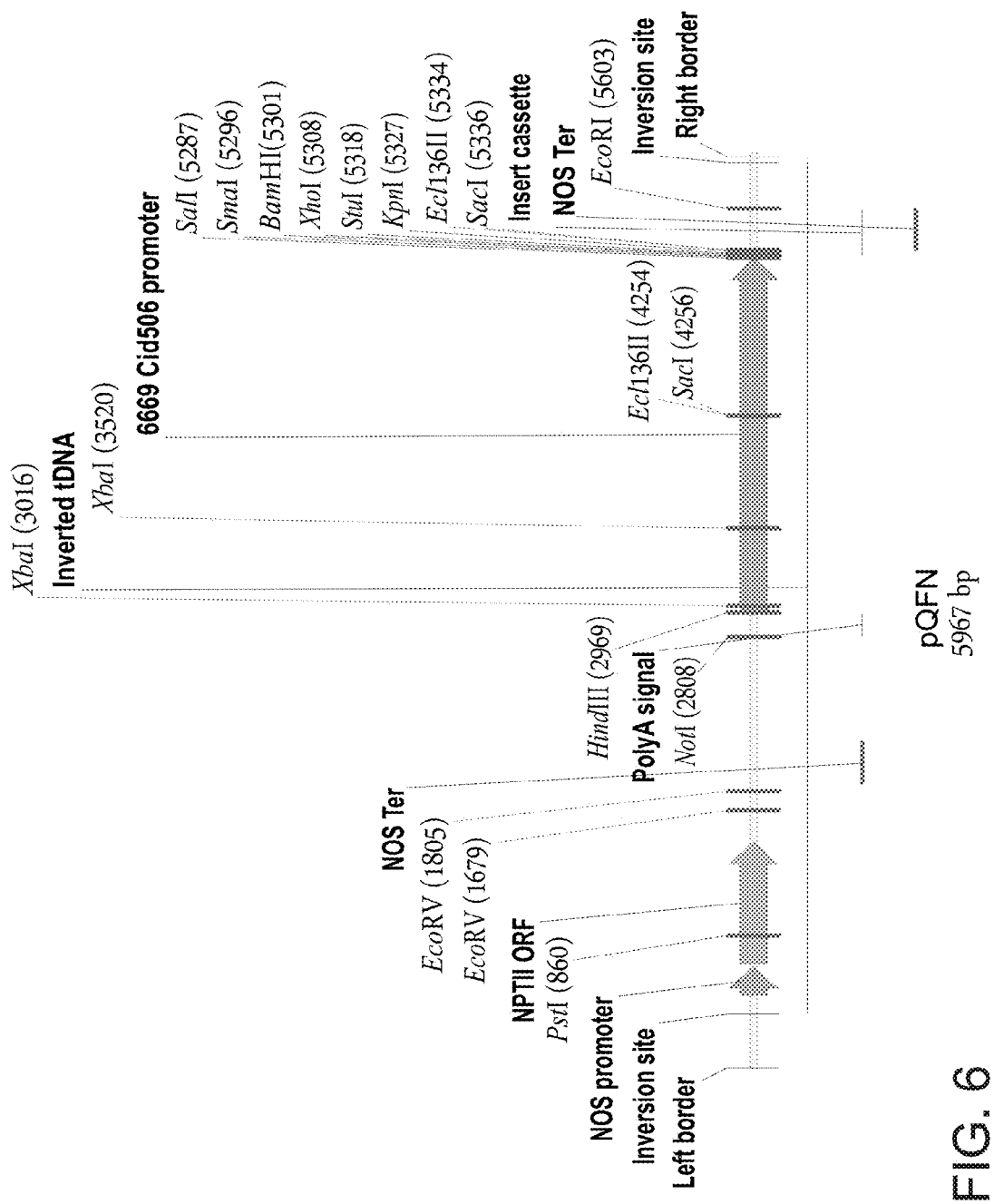
FIG. 6 is a schematic illustration of the pQFN plasmid (5967 bp).
Figure 7:
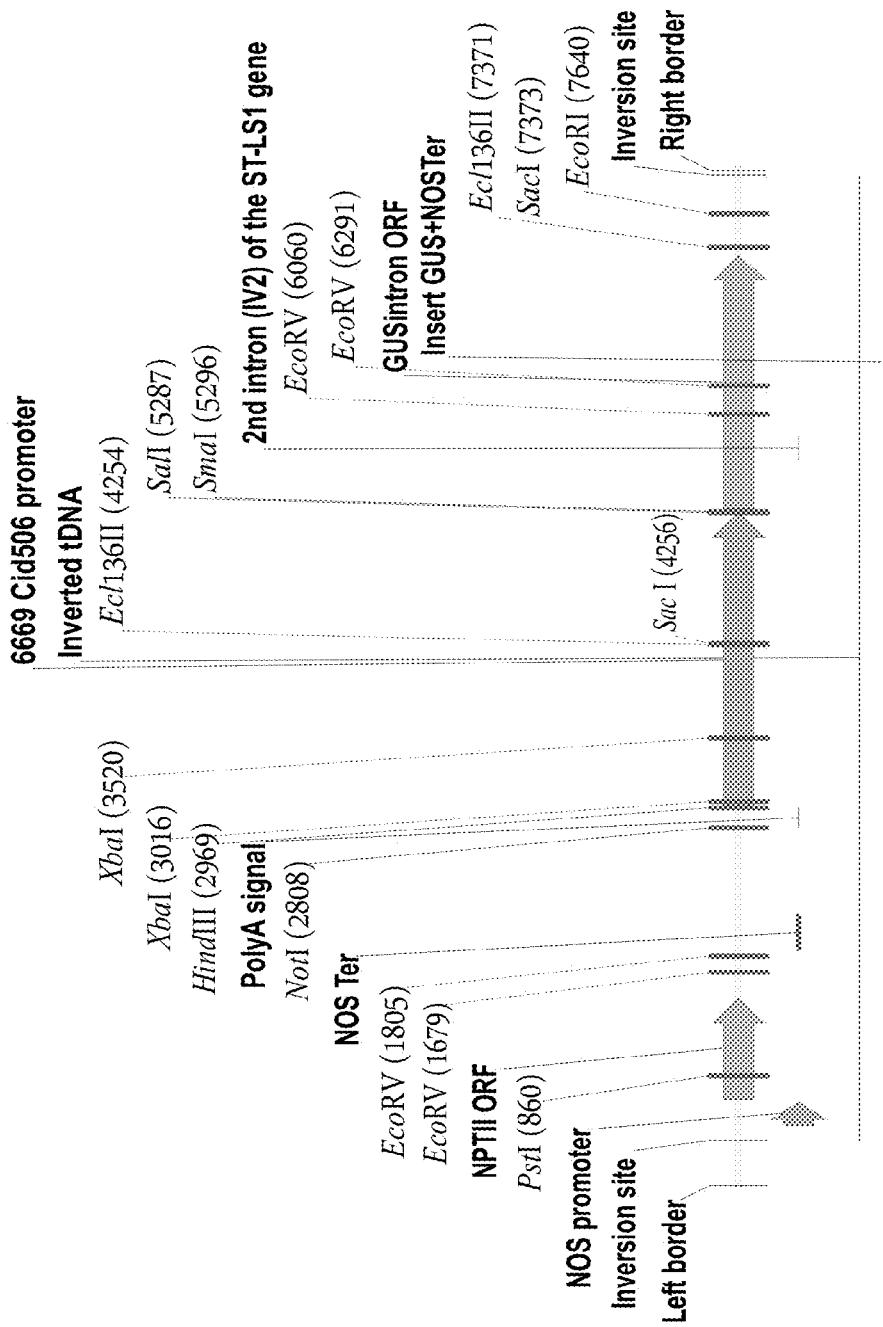
FIG. 7 is a schematic illustration of the pQFYN plasmid (8004 bp).
Figure 8:
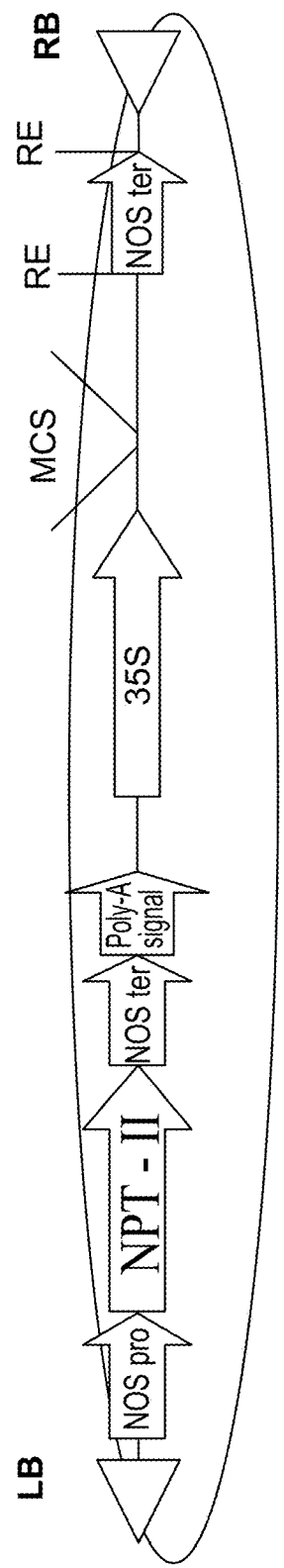
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO:7722). The isolated polynucleotide sequences of some embodiments of the invention were cloned into the MCS (Multiple cloning site) of the vector.

The present invention, in some embodiments thereof, relates to isolated polypeptides and polynucleotides, nucleic acid constructs comprising the isolated polypeptides, transgenic plants expressing same and methods of using same for increasing abiotic stress tolerance (ABST), water use efficiency (WUE), yield (e.g., grain quantity and/or quality), biomass, oil content, growth rate, vigor, nitrogen use efficiency (NUE) and/or fertilizer use efficiency (FUE) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase abiotic stress tolerance, yield, biomass, growth rate, vigor, oil content, fiber yield, fiber quality, and/or nitrogen use efficiency of a plant.

Thus, as shown in the Examples section which follows, the present inventors have utilized bioinformatics tools to identify polynucleotides which enhance abiotic stress tolerance, yield (e.g., seed yield, oil yield, oil content), growth rate, biomass, vigor, fiber yield and/or fiber quality of a plant. Genes which affect the trait-of-interest were identified based on expression profiles of genes of several tomato, Sorghum, Maize, Barley, *Arabidopsis* and cotton ecotypes/accessions and tissues, homology with genes known to affect the trait-of-interest and using digital expression profile in specific tissues and conditions (Tables 1-70, Examples 1-12 of the Examples section which follows). Homologous polypeptides and polynucleotides having the same function were also identified (Table 71, Example 13 of the Examples section which follows). The identified genes were cloned using specific primers (Table 72, Example 14 of the Examples section which follows), transformed into *agrobacterium* (Examples 15 of the Examples section which follows) and transgenic plants were generated (Example 16 of the Examples section which follows). Transgenic plants over-expressing the identified polynucleotides were found to exhibit increased biomass, plant performance, root biomass, growth rate (e.g., faster developing plants), yield, root performance (e.g., fertilizer use efficiency, nitrogen use efficiency), larger photosynthetic area under standard conditions or under abiotic stress conditions (e.g., osmoticus stress, salinity stress, drought conditions) (Tables 73-115; Examples 17-19 of the Examples section which follows). Altogether, these results suggest the use of the novel polynucleotides and polypeptides of the invention for increasing abiotic stress tolerance, yield (including oil yield, seed yield, oil content), fiber yield and/or quality, growth rate, biomass, vigor and/or nitrogen use efficiency of a plant.

Thus, according to an aspect of some embodiments of the invention, there is provided method of increasing abiotic stress tolerance, oil content, yield, growth rate, biomass, vigor, fiber yield, fiber quality, and/or nitrogen use efficiency of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130, thereby increasing the abiotic stress tolerance, oil content, yield, growth rate, biomass, vigor, fiber yield, fiber quality, and/or nitrogen use efficiency of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing to seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded to fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant to responses to this collection of stresses are related. Zhu (2002) Ann Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control to resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant to biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, rosette, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in abiotic stress tolerance, oil content, yield, growth rate, biomass, vigor, fiber yield, fiber quality, and/or nitrogen use efficiency of a plant as compared to a native plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130.

According to some embodiments of the invention, the exogenous polynucleotide of the invention comprises a nucleic acid sequence encoding a polypeptide having an amino acid sequence at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 474-770, 772-835 and 4178-4195, 4197-4213, 4215-4216,4218-5334, 5336-5522, 5524-5754, 5756-6215, 6217, 6220-6223, 6230, 6232, 6235-6607, 6609-6614, 6620-7129 and 7130.

Homology (e.g., percent homology, identity+similarity) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

According to some embodiments of the invention, the term "homology" or "homologous" refers to identity of two or more nucleic acid sequences; or identity of two or more amino acid sequences.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the to first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130.

According to some embodiments of the invention, the exogenous polynucleotide of the invention encodes a polypeptide having an amino acid sequence at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130.

According to some embodiments of the invention, the method of increasing abiotic stress tolerance, oil content, yield, growth rate, biomass, vigor, fiber yield, fiber quality, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, to at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130, thereby increasing the abiotic stress tolerance, oil content, yield, growth rate, biomass, vigor, fiber yield, fiber quality, and/or nitrogen use efficiency of the plant.

According to some embodiments of the invention, the exogenous polynucleotide encodes a polypeptide consisting of the amino acid sequence set forth by SEQ ID NO:474-835, 4178-6223, 6226-7129 or 7130.

According to an aspect of some embodiments of the invention, the method of increasing abiotic stress tolerance, oil content, yield, growth rate, biomass, vigor, fiber yield, fiber quality, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs: 474-835, 4178-6223, 6226-7129 and 7130, thereby increasing the abiotic stress tolerance, oil content, yield, growth rate, biomass, vigor, fiber yield, fiber quality, and/or nitrogen use efficiency of the plant.

According to an aspect of some embodiments of the invention, there is provided a method of increasing abiotic stress tolerance, oil content, yield, growth rate, biomass, vigor, fiber yield, fiber quality, and/or nitrogen use efficiency of a plant, comprising expressing within the plant an exogenous polynucleotide comprising a nucleic acid sequence encoding a polypeptide selected from the group consisting of SEQ ID NOs: 474-835, 4178-6223, 6226-7129 and 7130, thereby increasing the abiotic stress tolerance, oil content, yield, growth rate, biomass, vigor, fiber yield, fiber quality, and/or nitrogen use efficiency of the plant.

According to some embodiments of the invention, the exogenous polynucleotide encodes a polypeptide consisting of the amino acid sequence set forth by SEQ ID NO: 474-835, 4178-6223, 6226-7129 or 7130.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-473, 836-1652, 1654-3221, 3225-3241, 3243-3630, 3632-4176 and 4177.

According to an aspect of some embodiments of the invention, there is provided a method of increasing abiotic stress tolerance, oil content, yield, growth rate, biomass, vigor, fiber yield, fiber quality, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-473, 836-1652, 1654-3221, 3225-3241, 3243-3630, 3632-4176 and 4177, thereby increasing the abiotic stress tolerance, oil content, yield, growth rate, biomass, vigor, fiber yield, fiber quality, and/or nitrogen use efficiency of the plant.

According to some embodiments of the invention, the homology is a global homology, i.e., an homology over the entire amino acid or nucleic acid sequences of the invention and not over portions thereof.

According to some embodiments of the invention, the identity is a global identity, i.e., an identity over the entire amino acid or nucleic acid sequences of the invention and not over portions thereof.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least to about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-473, 836-1652, 1654-3221, 3225-3241, 3243-3630, 3632-4176 and 4177.

According to some embodiments of the invention the exogenous polynucleotide is set forth by SEQ ID NO: 1-473, 836-4176 or 4177.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-to favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 204-206 and 272-275.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid to sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-473, 836-1652, 1654-3221, 3225-3241, 3243-3630, 3632-4176 and 4177.

According to some embodiments of the invention the nucleic acid sequence is capable of increasing abiotic stress tolerance, oil content, yield, growth rate, biomass, vigor, fiber yield, fiber quality, and/or nitrogen use efficiency of a plant.

According to some embodiments of the invention the isolated polynucleotide comprising the nucleic acid sequence selected from the group consisting of SEQ ID NOs: 1-473, 836-1652, 1654-3221, 3225-3241, 3243-3630, 3632-4176 and 4177.

According to some embodiments of the invention the isolated polynucleotide is set forth by SEQ ID NO: 1-473, 836-4176 or 4177.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130.

According to some embodiments of the invention the amino acid sequence is capable of increasing abiotic stress tolerance, oil content, yield, growth rate, biomass, vigor, fiber yield, fiber quality, and/or nitrogen use efficiency of a plant.

The invention provides an isolated polynucleotide comprising a nucleic acid sequence encoding a polypeptide which comprises the amino acid sequence selected from the group consisting of SEQ ID NOs:474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 474-770, 772-835 and 4178-4195, 4197-4213, 4215-4216, 4218-5334, 5336-5522, 5524-5754, 5756-6215, 6217, 6220-6223, 6230, 6232, 6235-6607, 6609-6614, 6620-7129 and 7130.

According to some embodiments of the invention, the polypeptide comprising an amino acid sequence selected from the group consisting of SEQ ID NOs: 474-835, 4178-6223, 6226-7129 and 7130.

According to some embodiments of the invention, the polypeptide is set forth by SEQ ID NO: 474-835, 4178-6223, 6226-7129 or 7130.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage to legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia* vi/losa, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp.,

*Triticum* spp., *Tsuga heterophylla*, *Vaccinium* spp., *Vicia* spp., *Vitis vinifera*, *Watsonia pyramidata*, *Zantedeschia aethiopica*, *Zea mays*, to amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter [SEQ ID NO:7722 (pQFNC); SEQ ID NO:7728 (PJJ 35S from Brachypodium); SEQ ID NO:7729 (Odell et al., Nature 313:810-812, 1985)], *Arabidopsis* At6669 promoter (SEQ ID NO:7721; see PCT Publication No. WO04081173A2 or the new At6669 promoter (SEQ ID NO:7724); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Ubi 1 promoter (SEQ ID NO:7727); RBCS promoter (SEQ ID NO:7726); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604, 121; 5,569,597: 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:77231, from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet. 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet. 217:240-245; 1989), apetala-3], and to root promoters such as the ROOTP promoter [SEQ ID NO: 7725].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles to such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the to host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase abiotic stress tolerance, oil content, yield, growth rate, biomass, vigor, fiber yield, fiber quality, and/or nitrogen use efficiency of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct to can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host to pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the to plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant to fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—Can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \quad \text{Formula I}$$

Fertilizer use efficiency—To analyze whether the transgenic plants are more responsive to fertilizers, plants are grown in agar plates or pots with a limited amount of fertilizer, as described, for example, in Examples 6 and 10, hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), to amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., Arabidopsis plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the to like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course.  Formula II Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

$$1000 \text{ Seed Weight} = \text{number of seed in sample/sample weight} \times 1000 \quad \text{Formula III}$$

The Harvest Index can be calculated using Formula IV $$\text{Harvest Index} = \text{Average seed yield per plant/Average dry weight} \quad \text{Formula IV}$$

Grain Protein Concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol:// World Wide Web (dot) cottoninc (dot) com/Classification-ofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil to content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (e.g., the oil is derived from the vegetative portion of the plant).

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the to above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. to All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—Was performed for selected genes according to some embodiments of the invention, in which the characterized parameters (measured parameters according to the correlation IDs) were used as "x axis" for correlation with the tissue transcriptom which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Bio-Informatics Tools for Identification of Genes which Increase Abiotic Stress Tolerance, Yield and Agronomical Important Traits in Plants The present inventors have identified polynucleotides which upregulation of expression thereof can increase abiotic stress tolerance (ABST), water use efficiency (WUE), yield, oil content, growth rate, vigor, biomass, nitrogen use efficiency (NUE), and fertilizer use efficiency (FUE) of a plant.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes
  Arabidopsis genome [TAIR genome version 6 (Hypertext Transfer Protocol://World Wide Web (dot) arabidopsis (dot) org/)].
  Rice genome [IRGSP build 4.0 (Hypertext Transfer Protocol://rgp (dot) dna (dot) affrc (dot) go (dot) jp/IRGSP/)].
  Poplar [Populus trichocarpa release 1.1 from JGI (assembly release v1.0) (Hypertext Transfer Protocol://World Wide Web (dot) genome (dot) jgi-psf (dot) org/)].
  Brachypodium [JGI 4x assembly, Hypertext Transfer Protocol://World Wide Web (dot) brachpodium (dot) org)].
  Soybean [DOE-JGI SCP, version Glyma0 (Hypertext Transfer Protocol://World Wide Web (dot) phytozome (dot) net/)].
  Grape [French-Italian Public Consortium for Grapevine Genome Characterization grapevine genome (Hypertext Transfer Protocol://World Wide Web (dot) genoscope (dot) cns (dot) fr/)].
  Castobean [TIGR/J Craig Venter Institute 4x assembly [(Hypertext Transfer Protocol://msc (dot) jcvi (dot) org/r_communis].
  Sorghum [DOE-JGI SCP, version Sbi1 [Hypertext Transfer Protocol://World Wide Web (dot) phytozome (dot) net/)].
  Partially assembled genome of Maize [Hypertext Transfer Protocol://maizesequence (dot) org/].

Expressed EST and mRNA Sequences were Extracted from the Following Databases:
  GenBank versions 154, 157, 160, 161, 164, 165, 166 and 168 (Hypertext Transfer Protocol://World Wide Web (dot) ncbi (dot) nlm (dot) nih (dot) gov/dbEST/).
  RefSeq (Hypertext Transfer Protocol://World Wide Web (dot) ncbi (dot) nlm (dot) nih (dot) gov/RefSeq/).
  TAIR (Hypertext Transfer Protocol://World Wide Web (dot) arabidopsis (dot) org/).

Protein and Pathway Databases
  Uniprot [Hypertext Transfer Protocol://World Wide Web (dot) uniprot (dot) org/].
  AraCyc [Hypertext Transfer Protocol://World Wide Web (dot) arabidopsis (dot) org/biocyc/index (dot) jsp].
  ENZYME [Hypertext Transfer Protocol://expasy (dot) org/enzyme/].

Microarray Datasets were Downloaded from:
  GEO (Hypertext Transfer Protocol://World Wide Web.ncbi.nlm nih gov/geo/).
  TAIR (Hypertext Transfer Protocol://World Wide Web.arabidopsis.org/).
  Proprietary microarray data (WO2008/122980 and Example 2 below).

QTL and SNPs Information
  Gramene [Hypertext Transfer Protocol://World Wide Web (dot) gramene (dot) org/qtl/].
  Panzea [Hypertext Transfer Protocol://World Wide Web (dot) panzea (dot) org/index (dot) html].

Database assembly—Was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one to of the most important resource data for identifying genes important for ABST, increased yield, growth rate, vigor, biomass, oil content, WUE, NUE and FUE of a plant.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of Tomato Transcriptom and High Throughput Correlation Analysis Using 44K Tomato Oligonucleotide Micro-Array In order to produce a high throughput correlation analysis between ABST related phenotypes and gene expression, the present inventors utilized a Tomato oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 Tomato genes and transcripts. In order to define correlations between the levels of RNA expression with ABST, NUE, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotypes Grown Under Drought, Low Nitrogen and Regular Growth Conditions Experimental Procedures:

Tomato varieties were grown in 3 repetitive blocks, each containing 6 plants per plot were grown at net house. Briefly, the growing protocol was as follows:

1. Regular growth conditions: Tomato varieties were grown under normal conditions: 4-6 Liters/$m^2$ of water per day and fertilized with NPK (nitrogen, phosphorous and potassium at a ratio 6:6:6, respectively) as recommended in protocols for commercial tomato production.

2. Drought stress: Tomato variety was grown under normal conditions (4-6 Liters/$m^2$ per day with fertilizers) until flowering. At this time, irrigation was reduced to 50% compared to normal conditions.

3. Low Nitrogen fertilization conditions: Tomato varieties were grown under normal conditions (4-6 Liters/$m^2$ per day and fertilized with NPK as recommended in protocols for commercial tomato production) until flowering. At this time, Nitrogen fertilization was stopped.

Plants were phenotyped on a daily basis following the standard descriptor of tomato (Table 2). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large).

Next, analyzed data was saved to text files and processed using the JMP statistical analysis software (SAS institute). Data parameters collected are summarized in Table 2, herein below.

Analyzed tomato tissues—Two tissues at different developmental stages [flower and leaf], representing different plant characteristics, were sampled and RNA was extracted as described above. For convenience, each micro-array expression information tissue type has received a Set ID as summarized in Table 1 below.

TABLE 1

| Tomato transcriptom expression sets | |
|---|---|
| Expression Set | Set ID |
| Leaf grown under Normal Conditions | A |
| Leaf grown under Drought conditions | B |
| Flower grown under Normal Conditions | C |
| Flower grown under Drought conditions | D |
| Leaf grown under Low Nitrogen conditions | E |
| Flower grown under Low Nitrogen conditions | F |

Table 1:
Provided are the identification (ID) letters of each of the tomato expression sets.

The average for each of the measured parameter was calculated using the JMP software and values are summarized in Tables 3-8 below. Subsequent correlation analysis was conducted (Table 9) with the correlation coefficient (R) and the p-values. Results were integrated to the database.

TABLE 2

| Tomato correlated parameters (vectors) | |
|---|---|
| Correlation set | Correlation ID |
| Average red fruit weight (Normal) [gr.] | 1 |
| Average red fruit weight (under low nitrogen conditions) [gr.] | 2 |
| Average red fruit weight Drought [gr.] | 3 |
| Flower cluster weight Drought/under low nitrogen (ratio) | 4 |

TABLE 2-continued

Tomato correlated parameters (vectors)

| Correlation set | Correlation ID |
|---|---|
| Fruit yield/Plant (Normal) [gr.] | 5 |
| Fruit Yield/Plant (Drought) [gr.] | 6 |
| Fruit Yield/Plant (under low nitrogen conditions) [gr.] | 7 |
| FW ratio (Drought/Normal) | 8 |
| FW ratio (under low nitrogen conditions/Normal) | 9 |
| FW/Plant (Normal) [gr.] | 10 |
| FW/Plant (under low nitrogen conditions) [gr.] | 11 |
| FW/Plant Drought [gr.] | 12 |
| HI (Low N) | 13 |
| HI (Normal) | 14 |
| Leaflet Length [cm] (Low N) | 15 |
| Leaflet Length [cm] (Normal) | 16 |
| Leaflet Width (Low N) | 17 |
| Leaflet Width (Normal) | 18 |
| No. of flowers (Normal) [number] | 19 |
| No. of flowers (under low nitrogen conditions) [number] | 20 |
| NUE [yield/SPAD] (Low N) | 21 |
| NUE [yield/SPAD] (Normal) | 22 |
| NUE2 [total biomass/SPAD] (Low N) | 23 |
| NUE2 [total biomass/SPAD] (Normal) | 24 |
| Num. of flowers (Drought) [number] | 25 |
| Ratio Num. Flowers (low nitrogen conditions/Normal) | 26 |
| NUpE [biomass/SPAD] (Low N) | 27 |
| NUpE [biomass/SPAD] (Normal) | 28 |
| Ratio of Cluster Weight (under low nitrogen conditions/Normal) | 29 |
| Ratio of Flower Cluster Weight (Drought/Normal) | 30 |
| Ratio of Fruit Yield (Drought/Normal) | 31 |
| Ratio of Fruits (Drought/NUE) | 32 |
| Ratio of Fruits (under low nitrogen conditions/Normal) | 33 |
| Ratio of Number of Flowers (Drought/Normal) | 34 |
| Ratio of Number of Flowers (Drought/NUE) | 35 |
| Ratio of RWC (under low nitrogen conditions/Normal) | 36 |
| Ratio of SPAD (under low nitrogen conditions/Normal) | 37 |
| Ratio of SPAD 100% RWC (NUE/Normal) | 38 |
| Red fruit weight Drought/Normal | 39 |
| RWC (Normal) [%] | 40 |
| RWC Drought [%] | 41 |
| RWC Drought/Normal | 42 |
| RWC under low nitrogen conditions [%] | 43 |
| SLA [leaf area/plant biomass] (Low N) | 44 |
| SLA [leaf area/plant biomass] (Normal) | 45 |
| SPAD (Normal) [SPAD unit] | 46 |
| SPAD 100% RWC (Normal) [SPAD unit] | 47 |
| SPAD 100% RWC (under low nitrogen conditions) [SPAD unit] | 48 |
| SPAD NUE [SPAD unit] | 49 |
| Total Leaf Area [cm²] (Low N) | 50 |
| Total Leaf Area [cm²] (Normal) | 51 |
| Weight flower clusters (under low nitrogen conditions) [gr.] | 52 |
| Weight flower clusters (Drought) [gr.] | 53 |
| Weight Flower clusters (Normal) [gr.] | 54 |
| Weight of 100 green fruits (Normal) | 55 |
| Weight of 100 green fruits (under low nitrogen conditions) | 56 |
| Weight of 100 red fruits (Normal) | 57 |
| Weight of 100 red fruits (under low nitrogen conditions) | 58 |
| Yield/SLA (Low N) | 59 |
| Yield/SLA (Normal) | 60 |
| Yield/total leaf area (Low N) | 61 |
| Yield/total leaf area (Normal) | 62 |

Table 2.
Provided are the tomato correlated parameters.
"gr." = grams;
"FW" = fresh weight;
"NUE" = nitrogen use efficiency;
"RWC" = relative water content;
"NUpE" = nitrogen uptake efficiency;
"SPAD" = chlorophyll levels;
"HI" = harvest index (vegetative weight divided on yield);
"SLA" = specific leaf area (leaf area divided by leaf dry weight).

Fruit Yield (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Yield/SLA—Fruit yield divided by the specific leaf area, gives a measurement of the balance between reproductive and vegetative processes.

Yield/total leaf area—Fruit yield divided by the total leaf area, gives a measurement of the balance between reproductive and vegetative processes.

Plant Fresh Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two inflorescence from plots within blocks A-C were collected. The inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content.

Experimental Results

TABLE 3

Measured parameters in Tomato accessions under drought conditions

| Seed ID/Corr. ID | 41 | 42 | 25 | 53 | 34 | 35 | 30 | 4 |
|---|---|---|---|---|---|---|---|---|
| 612 | 72.1 | 0.99 | 16.7 | 0.37 | 2.94 | 0.88 | 0.32 | 0.69 |
| 613 | 74.5 | 0.97 | 6.5 | 0.41 | 0.34 | 1.22 | 1.19 | 1.11 |
| 614 | 65.3 | 1.02 | 15.7 | 0.33 | 2.47 | 1.74 | 0.47 | 1.06 |
| 616 | 72.2 | 1.08 | 20.3 | 0.29 | 2.65 | 1.56 | 0.01 | 0.82 |
| 617 | 66.1 | 1.21 | 11.7 | 0.55 | 1.21 | 1.09 | 1.25 | 1.16 |
| 618 | 68.3 | 0.88 | 25.3 | 0.31 | 3.04 | 1.52 | 0.03 | 1.25 |
| 620 | 78.1 | 1.34 | 29.7 | 0.45 | 5.95 | 4.96 | 0.56 | 1.52 |
| 621 | 18.5 | 0.28 | 17.3 | 0.56 | 2.08 | 1.08 | 0.96 | 1.19 |
| 622 | 73.2 | 1.13 | 14.7 | 0.30 | 1.47 | 0.98 | 0.42 | 0.76 |
| 623 | 62.5 | 0.83 | 29.7 | 0.32 | 4.24 | 4.94 | 0.38 | 1.04 |
| 624 | 67.2 | 1.01 | 15.0 | 0.31 | 1.67 | 0.88 | 0.36 | 0.38 |
| 625 | 75.8 | 1.20 | 10.3 | 0.31 | 1.29 | 0.80 | 0.62 | 0.78 |
| 626 | 62.8 | 1.11 | 18.3 | 8.36 | 3.44 | 2.12 | 8.20 | 24.10 |
| 627 | 70.7 | 1.97 | 12.0 | 0.29 | 1.50 | 1.29 | 0.41 | 0.67 |
| 628 | 55.8 | 0.72 | 20.3 | 0.34 | 2.65 | 1.61 | 0.91 | 0.97 |
| 629 | 75.2 | 0.75 | 12.7 | 0.44 | 1.41 | 1.90 | 0.67 | 0.99 |
| 630 | 63.7 | 1.01 | 12.7 | 0.27 | 1.19 | 1.36 | 0.38 | 0.95 |
| 631 | 62.3 | 0.83 | 11.3 | 0.43 | 1.26 | 1.42 | 1.31 | 0.91 |

Table 3: Provided are the values of each of the parameters (as described above) measured in Tomato accessions (Seed ID) under drought conditions.
Growth conditions are specified in the experimental procedure section.

TABLE 4

Additional Measured parameters in Tomato accessions under drought conditions

| Seed ID/Corr. ID | 6 | 12 | 3 | 31 | 32 | 8 | 39 |
|---|---|---|---|---|---|---|---|
| 612 | 0.47 | 2.62 | 0.009 | 0.57 | 1.15 | 1.72 | 0.19 |
| 613 | 0.48 | 1.09 | 0.195 | 1.41 | 0.73 | 0.34 | 24.40 |
| 614 | 0.63 | 1.85 | 0.209 | 1.27 | 1.32 | 0.61 | 25.40 |
| 616 | 0.35 | 2.22 | 0.005 | 2.88 | 0.76 | 2.63 | 0.02 |
| 617 | 2.04 | 2.63 | 0.102 | 4.20 | 1.51 | 1.18 | 20.30 |
| 618 | 0.25 | 2.71 | 0.002 | 0.55 | 0.71 | 1.36 | 0.04 |
| 620 | 0.05 | 3.41 | 0.035 | 0.09 | 5.06 | 4.02 | 0.15 |
| 621 | 0.45 | 2.11 | 0.006 | 1.03 | 0.89 | 1.01 | 0.02 |
| 622 | 0.29 | 1.95 | 0.005 | 1.39 | 0.67 | 0.61 | 0.86 |
| 623 | 1.02 | 1.76 | 0.005 | 3.28 | 2.17 | 0.64 | 0.74 |
| 624 | 0.60 | 1.72 | 0.005 | 0.91 | 0.38 | 0.95 | 0.09 |
| 625 | 0.49 | 1.92 | 0.012 | 2.62 | 1.27 | 0.51 | 1.72 |
| 626 | 0.27 | 2.21 | 0.005 | 0.32 | 0.84 | 1.17 | 0.17 |
| 627 | 0.68 | 3.73 | 0.006 | 2.48 | 1.51 | 1.94 | 0.02 |
| 628 | 0.14 | 0.75 | 0.303 | 0.41 | 0.98 | 0.35 | 10.50 |
| 629 | 0.53 | 1.76 | 0.138 | 1.62 | 1.34 | 1.06 | 27.90 |
| 630 | 0.55 | 0.63 | 0.041 | 1.76 | 0.38 | 0.21 | 11.80 |
| 631 | 0.41 | 1.11 | 0.089 | 1.42 | 0.84 | 0.48 | 9.98 |

Table 4: Provided are the values of each of the parameters (as described above) measured in Tomato accessions (Seed ID) under drought conditions.
Growth conditions are specified in the experimental procedure section.

TABLE 5

Measured parameters in Tomato accessions under normal conditions

| Seed ID/Corr. ID | 5 | 10 | 1 | 46 | 40 | 47 | 19 | 54 | 22 | 28 |
|---|---|---|---|---|---|---|---|---|---|---|
| 612 | 0.83 | 1.53 | 0.05 | 49.7 | 72.8 | 36.2 | 5.7 | 1.2 | 0.017 | 0.031 |
| 613 | 0.34 | 3.17 | 0.01 | 37.2 | 76.5 | 28.4 | 19.3 | 0.3 | 0.009 | 0.085 |
| 614 | 0.49 | 3.02 | 0.01 | 55.8 | 64.3 | 35.9 | 6.3 | 0.7 | 0.009 | 0.054 |
| 616 | 0.12 | 0.84 | 0.29 | 46.4 | 67.1 | 31.1 | 7.7 |  | 0.003 | 0.018 |
| 617 | 0.49 | 2.24 | 0.01 | 48.2 | 54.8 | 26.4 | 9.7 | 0.4 | 0.010 | 0.046 |
| 618 | 0.45 | 1.98 | 0.05 | 43.4 | 77.6 | 33.7 | 8.3 |  | 0.011 | 0.046 |
| 620 | 0.53 | 0.85 | 0.23 | 42.9 | 58.2 | 25.0 | 5.0 | 0.8 | 0.012 | 0.020 |
| 621 | 0.44 | 2.09 | 0.29 | 53.3 | 66.5 | 35.5 | 8.3 | 0.6 | 0.008 | 0.039 |
| 622 | 0.21 | 3.21 | 0.01 | 58.5 | 64.7 | 37.9 | 10.0 | 0.7 | 0.004 | 0.055 |
| 623 | 0.31 | 2.75 | 0.01 | 51.1 | 75.2 | 38.4 | 7.0 | 0.8 | 0.006 | 0.054 |
| 624 | 0.66 | 1.81 | 0.06 | 40.0 | 66.2 | 26.5 | 9.0 | 0.9 | 0.017 | 0.045 |
| 625 | 0.19 | 3.77 | 0.01 | 47.6 | 63.2 | 30.1 | 8.0 | 0.5 | 0.004 | 0.079 |
| 626 | 0.85 | 1.89 | 0.03 | 57.9 | 56.8 | 32.9 | 5.3 | 1.0 | 0.015 | 0.033 |
| 627 | 0.27 | 1.93 | 0.26 | 48.3 | 36.0 | 17.4 | 8.0 | 0.7 | 0.006 | 0.040 |
| 628 | 0.35 | 2.14 | 0.03 | 43.6 | 77.6 | 33.8 | 7.7 | 0.4 | 0.008 | 0.049 |
| 629 | 0.33 | 1.65 | 0.00 | 54.5 | 100.0 | 54.5 | 9.0 | 0.7 | 0.006 | 0.030 |
| 630 | 0.31 | 3.01 | 0.00 | 41.6 | 63.2 | 26.3 | 10.7 | 0.7 | 0.008 | 0.072 |
| 631 | 0.29 | 2.29 | 0.01 | 59.1 | 75.1 | 44.4 | 9.0 | 0.3 | 0.005 | 0.039 |

Table 5: Provided are the values of each of the parameters (as described above) measured in Tomato accessions (Seed ID) under normal growth conditions.
Growth conditions are specified in the experimental procedure section.

TABLE 6

Additional measured parameters in Tomato accessions under normal conditions

| Seed ID/Corr. ID | 14 | 24 | 51 | 16 | 18 | 55 | 57 | 45 | 62 | 60 |
|---|---|---|---|---|---|---|---|---|---|---|
| 612 | 0.35 | 0.05 |  |  |  |  |  |  |  |  |
| 613 | 0.10 | 0.09 |  |  |  |  |  |  |  |  |
| 614 | 0.14 | 0.06 | 426 | 6.3 | 3.7 | 0.6 | 0.82 | 141 | 0.0012 | 0.0035 |
| 616 | 0.13 | 0.02 | 582 | 8.0 | 4.8 | 3.1 | 2.46 | 690 | 0.0002 | 0.0002 |
| 617 | 0.18 | 0.06 | 291 | 5.6 | 3.4 | 0.2 | 0.50 | 130 | 0.0017 | 0.0037 |
| 618 | 0.19 | 0.06 | 594 | 7.7 | 4.6 | 2.6 | 2.76 | 299 | 0.0008 | 0.0015 |
| 620 | 0.38 | 0.03 | 948 | 7.9 | 4.4 | 6.3 | 5.32 | 1120 | 0.0006 | 0.0005 |
| 621 | 0.17 | 0.05 | 233 | 6.2 | 3.2 | 5.8 | 5.24 | 112 | 0.0019 | 0.0039 |
| 622 | 0.06 | 0.06 | 341 | 6.2 | 3.4 | 0.4 | 0.61 | 106 | 0.0006 | 0.0020 |
| 623 | 0.10 | 0.06 | 339 | 5.7 | 3.1 | 0.3 | 0.66 | 123 | 0.0009 | 0.0025 |
| 624 | 0.27 | 0.06 | 190 | 4.4 | 2.4 | 2.0 | 2.70 | 105 | 0.0035 | 0.0063 |
| 625 | 0.05 | 0.08 | 422 | 4.4 | 2.0 | 2.5 | 0.70 | 112 | 0.0004 | 0.0017 |
| 626 | 0.31 | 0.05 | 581 | 6.8 | 3.8 | 1.4 | 2.64 | 308 | 0.0015 | 0.0028 |
| 627 | 0.12 | 0.05 | 808 | 7.4 | 3.7 | 2.0 | 4.67 | 419 | 0.0003 | 0.0007 |
| 628 | 0.14 | 0.06 | 784 | 6.7 | 3.0 | 1.4 | 2.17 | 366 | 0.0004 | 0.0009 |
| 629 | 0.17 | 0.04 | 352 | 5.9 | 3.2 | 2.3 | 0.49 | 213 | 0.0009 | 0.0015 |

TABLE 6-continued

Additional measured parameters in Tomato accessions under normal conditions

| Seed ID/Corr. ID | 14 | 24 | 51 | 16 | 18 | 55 | 57 | 45 | 62 | 60 |
|---|---|---|---|---|---|---|---|---|---|---|
| 630 | 0.09 | 0.08 | 256 | 4.2 | 2.1 | 0.5 | 0.34 | 85 | 0.0012 | 0.0037 |
| 631 | 0.11 | 0.04 | 1080 | 10.3 | 5.9 | 0.4 | 0.75 | 470 | 0.0003 | 0.0006 |

Table 6: Provided are the values of each of the parameters (as described above) measured in Tomato accessions (Seed ID) under normal growth conditions.
Growth conditions are specified in the experimental procedure section.

TABLE 7

Measured parameters in Tomato accessions under low nitrogen conditions

| Seed ID/Corr. ID | 7 | 11 | 2 | 33 | 9 | 49 | 43 | 48 | 37 | 38 | 36 | 20 | 52 | 26 |
|---|---|---|---|---|---|---|---|---|---|---|---|---|---|---|
| 612 | 0.41 | 4.04 | 0.024 | 0.49 | 2.65 | 38.4 | 74.1 | 28.5 | 0.77 | 0.79 | 1.0 | 19.0 | 0.53 | 3.35 |
| 613 | 0.66 | 1.21 | 0.191 | 1.93 | 0.38 | 39.4 | 99.1 | 39.0 | 1.06 | 1.37 | 1.3 | 5.3 | 0.37 | 0.28 |
| 614 | 0.48 | 2.25 | 0.006 | 0.97 | 0.74 | 47.5 | 69.5 | 33.0 | 0.85 | 0.92 | 1.1 | 9.0 | 0.31 | 1.42 |
| 616 | 0.46 | 2.54 | 0.005 | 3.80 | 3.01 | 37.0 | 63.2 | 23.4 | 0.80 | 0.75 | 0.9 | 13.0 | 0.35 | 1.70 |
| 617 | 1.35 | 1.85 | 0.096 | 2.78 | 0.83 | 44.6 | 77.4 | 34.5 | 0.93 | 1.31 | 1.4 | 10.7 | 0.47 | 1.10 |
| 618 | 0.35 | 3.06 | 0.004 | 0.78 | 1.54 | 41.7 | 77.9 | 32.5 | 0.96 | 0.97 | 1.0 | 16.7 | 0.25 | 2.00 |
| 620 | 0.01 | 3.13 | 0.006 | 0.02 | 3.70 | 34.4 | 80.5 | 27.7 | 0.80 | 1.11 | 1.4 | 6.0 | 0.29 | 1.20 |
| 621 | 0.51 | 2.54 | 0.007 | 1.16 | 1.22 | 50.0 | 67.4 | 33.7 | 0.94 | 0.95 | 1.0 | 16.0 | 0.47 | 1.92 |
| 622 | 0.44 | 1.84 | 0.006 | 2.07 | 0.58 | 44.7 | 67.2 | 30.0 | 0.76 | 0.79 | 1.0 | 15.0 | 0.40 | 1.50 |
| 623 | 0.47 | 1.52 | 0.013 | 1.51 | 0.55 | 53.7 | 66.1 | 35.5 | 1.05 | 0.92 | 0.9 | 6.0 | 0.30 | 0.86 |
| 624 | 1.59 | 1.91 | 0.021 | 2.41 | 1.06 | 35.7 | 69.6 | 24.8 | 0.89 | 0.94 | 1.1 | 17.0 | 0.82 | 1.89 |
| 625 | 0.39 | 1.86 | 0.005 | 2.06 | 0.49 | 58.8 | 69.3 | 40.8 | 1.24 | 1.36 | 1.1 | 13.0 | 0.40 | 1.62 |
| 626 | 0.32 | 2.47 | 0.006 | 0.38 | 1.31 | 47.5 | 100.0 | 47.5 | 0.82 | 1.44 | 1.8 | 8.7 | 0.35 | 1.62 |
| 627 | 0.45 | 2.62 | 0.048 | 1.64 | 1.36 | 45.2 | 57.7 | 26.1 | 0.94 | 1.50 | 1.6 | 9.3 | 0.43 | 1.17 |
| 628 | 0.14 | 1.08 | 0.357 | 0.41 | 0.51 | 39.0 | 90.8 | 35.4 | 0.89 | 1.05 | 1.2 | 12.7 | 0.35 | 1.65 |
| 629 | 0.40 | 1.17 | 0.037 | 1.21 | 0.71 | 45.0 | 68.0 | 30.6 | 0.83 | 0.56 | 0.7 | 6.7 | 0.45 | 0.74 |
| 630 | 1.44 | 0.92 | 0.626 | 4.59 | 0.31 | 65.3 | 59.6 | 39.0 | 1.57 | 1.48 | 0.9 | 9.3 | 0.28 | 0.88 |
| 631 | 0.50 | 1.09 | | 1.70 | 0.47 | 51.9 | 72.2 | 37.5 | 0.88 | 0.84 | 1.0 | 8.0 | 0.47 | 0.89 |

Table 7: Provided are the values of each of the parameters (as described above) measured in Tomato accessions (Seed ID) under low nitrogen growth conditions.
Growth conditions are specified in the experimental procedure section.

TABLE 8

Additional measured parameters in Tomato accessions under low nitrogen conditions

| Seed ID/Corr. ID | 29 | 21 | 27 | 13 | 23 | 50 | 15 | 17 | 56 | 44 | 61 | 59 | 58 |
|---|---|---|---|---|---|---|---|---|---|---|---|---|---|
| 612 | 0.46 | 0.014 | 0.14 | 0.09 | 0.16 | 566 | 6.4 | 3.5 | 0.87 | 140 | 0.0007 | 0.003 | 1.1 |
| 613 | 1.07 | 0.017 | 0.03 | 0.35 | 0.05 | 385 | 5.9 | 2.0 | 3.66 | 317 | 0.0017 | 0.002 | 6.9 |
| 614 | 0.44 | 0.014 | 0.07 | 0.18 | 0.08 | 295 | 3.7 | 1.8 | 0.57 | 131 | 0.0016 | 0.004 | 0.6 |
| 616 | 0.01 | 0.020 | 0.11 | 0.15 | 0.13 | 378 | 5.4 | 2.6 | 0.37 | 149 | 0.0012 | 0.003 | 0.5 |
| 617 | 1.08 | 0.039 | 0.05 | 0.42 | 0.09 | 476 | 7.0 | 3.5 | 3.40 | 258 | 0.0028 | 0.005 | 7.2 |
| 618 | 0.02 | 0.011 | 0.09 | 0.10 | 0.11 | 197 | 3.7 | 1.7 | 0.68 | 64 | 0.0018 | 0.006 | 0.4 |
| 620 | 0.37 | 0.000 | 0.11 | 0.00 | 0.11 | 453 | 4.4 | 1.9 | 0.45 | 145 | 0.0000 | 0.000 | |
| 621 | 0.81 | 0.015 | 0.08 | 0.17 | 0.09 | 626 | 6.7 | 3.5 | 0.47 | 246 | 0.0008 | 0.002 | 0.6 |
| 622 | 0.55 | 0.015 | 0.06 | 0.19 | 0.08 | 748 | 6.7 | 3.3 | 0.54 | 406 | 0.0006 | 0.001 | 0.7 |
| 623 | 0.36 | 0.013 | 0.04 | 0.24 | 0.06 | 454 | 4.4 | 2.5 | 0.39 | 299 | 0.0010 | 0.002 | 0.6 |
| 624 | 0.95 | 0.064 | 0.08 | 0.45 | 0.14 | 165 | 3.9 | 2.6 | 0.97 | 86 | 0.0097 | 0.019 | 1.3 |
| 625 | 0.80 | 0.010 | 0.05 | 0.17 | 0.06 | 338 | 5.3 | 2.6 | 0.91 | 182 | 0.0012 | 0.002 | 1.3 |
| 626 | 0.34 | 0.007 | 0.05 | 0.12 | 0.06 | 396 | 6.3 | 3.6 | 0.36 | 160 | 0.0008 | 0.002 | 0.5 |
| 627 | 0.61 | 0.017 | 0.10 | 0.15 | 0.12 | 236 | 5.1 | 2.6 | 0.35 | 90 | 0.0019 | 0.005 | 0.6 |
| 628 | 0.94 | 0.004 | 0.03 | 0.12 | 0.03 | 175 | 4.7 | 2.5 | 0.57 | 161 | 0.0008 | 0.001 | 0.9 |
| 629 | 0.68 | 0.013 | 0.04 | 0.25 | 0.05 | 442 | 6.8 | 3.4 | 4.38 | 379 | 0.0009 | 0.001 | 6.2 |
| 630 | 0.40 | 0.037 | 0.02 | 0.61 | 0.06 | 489 | 7.1 | 3.3 | 2.02 | 531 | 0.0030 | 0.003 | 3.7 |
| 631 | 1.44 | 0.013 | 0.03 | 0.31 | 0.04 | 708 | 8.2 | 3.7 | 8.13 | 651 | 0.0007 | 0.001 | 11.3 |

Table 8: Provided are the values of each of the parameters (as described above) measured in Tomato accessions (Seed ID) under low nitrogen growth conditions.
Growth conditions are specified in the experimental procedure section.

TABLE 9

Correlation between the expression level of selected LAB genes of some embodiments of the invention in various tissues and the phenotypic performance under low nitrogen, normal or drought stress conditions across Tomato accessions

| Gene Name | R | P | Exp. set ID | Corr. ID | Gene Name | R | P | Exp. set ID | Corr. ID |
|---|---|---|---|---|---|---|---|---|---|
| LAB396 | −0.90 | 3.66E−04 | F | 26 | LAB397 | 0.94 | 1.43E−04 | E | 2 |
| LAB396 | −0.89 | 0.001 | F | 9 | LAB397 | 0.89 | 0.001 | E | 37 |
| LAB396 | −0.84 | 0.002 | F | 27 | LAB397 | 0.81 | 0.004 | E | 33 |
| LAB396 | −0.83 | 0.003 | F | 11 | LAB397 | 0.78 | 0.007 | E | 13 |
| LAB396 | 0.79 | 0.007 | E | 48 | LAB397 | 0.78 | 0.008 | B | 8 |
| LAB396 | −0.78 | 0.008 | F | 23 | LAB397 | 0.76 | 0.011 | D | 8 |
| LAB396 | −0.74 | 0.015 | E | 52 | LAB397 | 0.75 | 0.013 | B | 12 |
| LAB396 | −0.73 | 0.016 | C | 1 | LAB397 | 0.75 | 0.013 | C | 1 |
| LAB396 | 0.71 | 0.021 | D | 39 | LAB398 | 0.83 | 0.006 | C | 28 |
| LAB396 | 0.70 | 0.035 | A | 14 | LAB398 | 0.83 | 0.006 | C | 24 |
| LAB398 | −0.75 | 0.013 | F | 43 | LAB399 | 0.74 | 0.014 | F | 43 |
| LAB398 | 0.73 | 0.016 | B | 31 | LAB399 | 0.74 | 0.015 | D | 53 |
| LAB398 | 0.72 | 0.018 | F | 49 | LAB399 | 0.73 | 0.017 | D | 4 |
| LAB398 | −0.70 | 0.024 | B | 4 | LAB399 | −0.71 | 0.021 | C | 40 |
| LAB398 | 0.70 | 0.024 | F | 37 | LAB400 | 0.86 | 0.002 | B | 25 |
| | | | | | LAB400 | 0.78 | 0.008 | A | 54 |
| LAB399 | 0.90 | 3.46E−04 | B | 42 | LAB400 | 0.77 | 0.014 | C | 28 |
| LAB399 | −0.86 | 0.001 | C | 47 | LAB400 | 0.76 | 0.010 | B | 34 |
| LAB399 | 0.80 | 0.006 | D | 30 | LAB400 | 0.76 | 0.011 | A | 1 |
| LAB399 | −0.78 | 0.008 | A | 47 | LAB400 | 0.76 | 0.011 | C | 40 |
| LAB400 | −0.73 | 0.016 | E | 58 | LAB409 | 0.75 | 0.012 | F | 56 |
| LAB400 | −0.71 | 0.021 | E | 56 | LAB409 | 0.71 | 0.022 | B | 25 |
| LAB401 | −0.78 | 0.022 | C | 18 | LAB603 | 0.83 | 0.003 | A | 54 |
| LAB401 | 0.77 | 0.025 | C | 60 | LAB603 | 0.81 | 0.005 | B | 25 |
| LAB401 | −0.77 | 0.026 | C | 16 | LAB603 | −0.80 | 0.006 | E | 15 |
| LAB401 | −0.74 | 0.022 | C | 14 | LAB603 | 0.77 | 0.015 | A | 24 |
| LAB401 | −0.74 | 0.022 | C | 22 | LAB603 | 0.76 | 0.011 | C | 1 |
| LAB401 | −0.72 | 0.046 | C | 45 | LAB409 | 0.92 | 1.40E−04 | B | 35 |
| LAB401 | −0.71 | 0.048 | C | 51 | | | | | |

Table 9. "Corr. ID "—correlation set ID according to the correlated parameters Table above.
"Exp. Set ID" = Expression set.
"R" = Pearson correlation coefficient;
"P" = p value.

Correlation of early vigor traits across collection of Tomato ecotypes under 300 mM NaCl, Low nitrogen and normal growth conditions—Ten tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen solution (the amount of total nitrogen was reduced in a 90% from the full Hoagland solution, final amount of 0.8 mM N), cold temperature solution (Full Hoagland at 10° C.) or at Normal growth solution (Full Hoagland containing 8 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed tomato tissues—All 10 selected Tomato varieties were sample per each treatment. Two types of tissues [leaves and roots] were sampled and RNA was extracted as described above. For convenience, each micro-array expression information tissue type has received a Set ID as summarized in Table 10 below.

TABLE 10

Tomato transcriptom expression sets

| Expression Set | Set ID |
|---|---|
| Leaves at 300 mM NaCl | A |
| Leaves at Normal conditions | B |
| Leaves at Low Nitrogen conditions | C |
| Roots at 100 mM NaCl | D |
| Roots at Normal conditions | E |
| Roots at Low Nitrogen conditions | F |

Table 10.
Provided are the tomato transcriptom experimental sets.

Tomato vigor related parameters—Following 5 weeks of growing, plant were harvested and analyzed for Leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 11, herein below.

TABLE 11

Tomato correlated parameters (vectors)

| Correlation set | Correlation ID |
|---|---|
| Leaf No. NaCl [number] | 1 |
| Leaf No. Normal [number] | 2 |
| Leaf No. NUE [number] | 3 |

TABLE 11-continued

Tomato correlated parameters (vectors)

| Correlation set | Correlation ID |
|---|---|
| Leaf No. Ratio NaCl/Normal | 4 |
| Leaf No. Ratio NaCl/NUE | 5 |
| Leaf number ratio NUE/Normal | 6 |
| NUE roots (Root Biomass [DW]/SPAD) Cold | 7 |
| NUE roots (Root Biomass [DW]/SPAD) Low N | 8 |
| NUE roots (Root Biomass[DW]/SPAD) NaCl | 9 |
| NUE roots (Root Biomass [DW]/SPAD) Normal | 10 |
| NUE roots Low N | 11 |
| NUE roots Normal | 12 |
| NUE shoots (shoot Biomass [DW]/SPAD) Cold | 13 |
| NUE shoots (shoot Biomass [DW]/SPAD) Low N | 14 |
| NUE shoots (shoot Biomass [DW]/SPAD) NaCl | 15 |
| NUE shoots (shoot Biomass [DW]/SPAD) Normal | 16 |
| NUE shoots Low N | 17 |
| NUE shoots Normal | 18 |
| NUE total biomass (Total Biomass [DW]/SPAD) Cold | 19 |
| NUE total biomass (Total Biomass [DW]/SPAD) Low N | 20 |
| NUE total biomass (Total Biomass [DW]/SPAD) NaCl | 21 |
| NUE total biomass (Total Biomass [DW]/SPAD) Normal | 22 |
| NUE total biomass Low N | 23 |
| NUE total biomass Normal | 24 |
| Plant biomass NaCl [gr.] | 25 |
| Plant height NaCl [cm] | 26 |
| Plant height Normal [cm] | 27 |
| Plant height NUE [cm] | 28 |
| Plant Height Ratio NaCl/Normal | 29 |
| Plant Height Ratio NaCl/NUE | 30 |
| Plant Height Ratio NUE/Normal | 31 |
| Ratio Shoot Biomass/Root Biomass Normal | 32 |
| Ratio Shoot Biomass/Root Biomass NUE | 33 |
| Root Biomass reduction compared to normal [%] Low N | 34 |
| Shoot Biomass reduction compared to normal [%] Low N | 35 |
| SPAD Cold [SPAD unit] | 36 |
| SPAD NaCl [SPAD unit] | 37 |
| SPAD Normal [SPAD unit] | 38 |
| SPAD NUE [SPAD unit] | 39 |
| Ratio SPAD NUE/Normal | 40 |

Table 11.
Provided are the tomato correlated parameters,.
"NUE" = nitrogen use efficiency;
"DW" = dry weight;
"cm" = centimeter;

Experimental Results 10 different Tomato varieties were grown and characterized for parameters as described above. The average for each of the measured parameter was calculated using the JMP software and values are summarized in Tables 12-14 below. Subsequent correlation analysis was conducted (Table 15). Follow, results were integrated to the database.

TABLE 12

Measured parameters in Tomato accessions under low nitrogen conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 28 | 36.8 | 39.9 | 34.4 | 47.0 | 46.4 | 45.4 | 47.7 | 39.3 | 41.8 | 41.0 | |
| 27 | 45.3 | 47.8 | 40.8 | 55.3 | 56.2 | 48.7 | 55.8 | 37.4 | 49.6 | 46.3 | |
| 39 | 34.6 | 24.9 | 28.6 | 31.6 | 29.7 | 31.8 | 30.3 | 30.3 | 31.3 | 28.8 | |
| 6 | 0.85 | 0.90 | 0.98 | 1.09 | 0.88 | 1.02 | 0.87 | 1.06 | 0.91 | 1.12 | |
| 31 | 0.81 | 0.83 | 0.84 | 0.85 | 0.83 | 0.93 | 0.85 | 1.05 | 0.84 | 0.88 | |
| 40 | 1.01 | 0.98 | 1.02 | 1.00 | 0.98 | 0.98 | 0.93 | 1.05 | 1.01 | 0.99 | |
| 3 | 5.6 | 6.2 | 7.2 | 6.8 | 5.6 | 6.6 | 5.1 | 5.9 | 5.6 | 6.3 | |
| 14 | 0.004 | 0.004 | 0.003 | 0.007 | 0.005 | 0.005 | 0.012 | 0.007 | 0.007 | 0.007 | 0.006 |
| 8 | 0.001 | 0.001 | 0.000 | 0.001 | 0.001 | 0.001 | 0.001 | 0.001 | 0.001 | 0.001 | 0.001 |
| 20 | 0.005 | 0.005 | 0.003 | 0.008 | 0.005 | 0.006 | 0.013 | 0.008 | 0.008 | 0.008 | 0.007 |
| 39 | 10.9 | 11.5 | 11.4 | 10.4 | 11.2 | 8.9 | 7.9 | 8.0 | 10.3 | 8.6 | 14.5 |
| 33 | 5.0 | 6.4 | 11.4 | 9.5 | 11.6 | 8.2 | 10.4 | 10.5 | 8.2 | 8.0 | 3.9 |
| 35 | 75.4 | 62.2 | 55.1 | 49.7 | 63.2 | 82.7 | 66.9 | 108.0 | 55.4 | 54.4 | 59.7 |
| 34 | 62.6 | 144.0 | 54.2 | 70.5 | 59.7 | 96.1 | 107.0 | 112.0 | 81.6 | 32.2 | 87.5 |
| 17 | 35.4 | 38.4 | 24.1 | 65.0 | 46.7 | 46.7 | 120.0 | 60.1 | 66.3 | 56.5 | 60.3 |
| 11 | 7.0 | 7.7 | 2.5 | 7.0 | 5.0 | 8.0 | 15.1 | 9.0 | 8.8 | 7.3 | 15.9 |
| 23 | 58.5 | 69.7 | 63.8 | 69.3 | 71.1 | 60.5 | 73.9 | 68.8 | 66.7 | 70.8 | 49.7 |

Table 12: Provided are the values of each of the parameters (as described above) measured in Tomato accessions (Line) under low nitrogen growth conditions.
Growth conditions are specified in the experimental procedure section.

TABLE 13

Measured parameters in Tomato accessions under normal conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 2 | 6.6 | 6.9 | 7.3 | 6.2 | 6.3 | 6.4 | 5.9 | 5.6 | 6.1 | 5.7 | |
| 27 | 45.3 | 47.8 | 40.8 | 55.3 | 56.2 | 48.7 | 55.8 | 37.4 | 49.6 | 46.3 | |
| 38 | 34.3 | 25.3 | 28.1 | 31.4 | 30.2 | 32.4 | 32.6 | 28.8 | 30.9 | 29.0 | |
| 16 | 0.005 | 0.006 | 0.005 | 0.014 | 0.008 | 0.005 | 0.017 | 0.007 | 0.011 | 0.012 | 0.009 |
| 10 | 0.001 | 0.001 | 0.001 | 0.001 | 0.001 | 0.001 | 0.001 | 0.001 | 0.001 | 0.003 | 0.002 |
| 22 | 0.006 | 0.007 | 0.006 | 0.016 | 0.009 | 0.006 | 0.019 | 0.008 | 0.012 | 0.014 | 0.011 |
| 38 | 9.3 | 10.2 | 8.9 | 8.4 | 9.8 | 8.6 | 6.6 | 7.0 | 8.7 | 7.4 | 9.4 |

TABLE 13-continued

Measured parameters in Tomato accessions under normal conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 32 | 5.4 | 12.7 | 10.0 | 15.4 | 8.8 | 7.5 | 12.6 | 8.0 | 14.3 | 4.8 | 6.3 |
| 18 | 4.7 | 6.2 | 4.4 | 13.1 | 7.4 | 5.7 | 17.9 | 5.6 | 12.0 | 10.4 | 10.1 |
| 12 | 1.1 | 0.5 | 0.5 | 1.0 | 0.8 | 0.8 | 0.9 | 0.8 | 1.1 | 2.3 | 1.8 |
| 24 | 7.5 | 9.1 | 8.6 | 8.9 | 7.2 | 7.9 | 9.1 | 7.9 | 8.6 | 8.7 | 6.2 |

Table 13: Provided are the values of each of the parameters (as described above) measured in Tomato accessions (Line) under normal growth conditions.
Growth conditions are specified in the experimental procedure section.

TABLE 14

Measured parameters in Tomato accessions under salinity conditions

| Corr. ID/Line | 1139 | 2078 | 2958 | 5077 | 5080 | 5084 | 5085 | 5088 | 5089 | 5092 | 5113 |
|---|---|---|---|---|---|---|---|---|---|---|---|
| 1 | 3.6 | 3.9 | 5.0 | 4.0 | 3.6 | 4.4 | 3.2 | 3.7 | 4.0 | 4.3 | |
| 26 | 5.6 | 6.5 | 8.5 | 8.6 | 8.9 | 7.6 | 8.6 | 5.6 | 5.8 | 9.4 | |
| 25 | 0.36 | 0.44 | 0.26 | 0.71 | 0.46 | 0.54 | 0.66 | 0.40 | 0.52 | 0.45 | |
| 4 | 0.54 | 0.57 | 0.68 | 0.64 | 0.56 | 0.68 | 0.54 | 0.67 | 0.65 | 0.75 | |
| 5 | 0.64 | 0.63 | 0.69 | 0.59 | 0.64 | 0.67 | 0.62 | 0.63 | 0.72 | 0.68 | |
| 29 | 0.12 | 0.14 | 0.21 | 0.15 | 0.16 | 0.16 | 0.15 | 0.15 | 0.12 | 0.20 | |
| 30 | 0.15 | 0.16 | 0.25 | 0.18 | 0.19 | 0.17 | 0.18 | 0.14 | 0.14 | 0.23 | |
| 15 | 0.00051 | 0.00072 | 0.00067 | 0.00117 | 0.00172 | 0.00098 | 0.00117 | 0.00075 | 0.00101 | 0.00102 | 0.00069 |
| 37 | 11.4 | 10.4 | 11.6 | 10.8 | 10.8 | 7.0 | 9.2 | 8.5 | 10.4 | 8.8 | 12.4 |
| 9 | 0.00006 | 0.00005 | 0.00011 | 0.00010 | 0.00007 | 0.00009 | 0.00010 | 0.00008 | 0.00009 | | 0.00005 |
| 21 | 0.00072 | 0.00063 | 0.00081 | 0.00142 | 0.00178 | 0.00107 | 0.00126 | 0.00083 | 0.00111 | | 0.00069 |

Table 14: Provided are the values of each of the parameters (as described above) measured in Tomato accessions (Line) under salinity growth conditions.
Growth conditions are specified in the experimental procedure section.

TABLE 15

Correlation between the expression level of selected LAB genes of some embodiments of the invention in various tissues and the phenotypic performance under low nitrogen, normal or salinity stress conditions across Tomato accessions

| Gene Name | R | P | Exp. set ID | Corr. ID | Gene Name | R | P | Exp. set ID | Corr. ID |
|---|---|---|---|---|---|---|---|---|---|
| LAB396 | −0.89 | 0.001 | E | 38 | LAB396 | 0.71 | 0.047 | C | 31 |
| LAB396 | −0.88 | 0.002 | F | 39 | LAB396 | 0.71 | 0.032 | C | 23 |
| LAB396 | 0.79 | 0.011 | F | 20 | LAB397 | −0.74 | 0.014 | D | 25 |
| LAB396 | 0.79 | 0.012 | F | 14 | LAB397 | 0.73 | 0.040 | C | 3 |
| LAB396 | 0.76 | 0.018 | F | 17 | LAB397 | 0.72 | 0.019 | A | 30 |
| LAB396 | 0.75 | 0.020 | C | 35 | LAB398 | −0.80 | 0.006 | A | 4 |
| LAB396 | 0.74 | 0.024 | F | 8 | LAB398 | 0.79 | 0.021 | F | 6 |
| LAB396 | −0.73 | 0.041 | E | 2 | LAB398 | 0.71 | 0.031 | D | 15 |
| LAB396 | −0.73 | 0.042 | B | 2 | LAB399 | 0.76 | 0.017 | F | 39 |
| LAB396 | 0.73 | 0.027 | F | 11 | LAB399 | 0.73 | 0.026 | E | 38 |
| LAB399 | 0.82 | 0.013 | E | 27 | LAB400 | 0.71 | 0.048 | D | 21 |
| LAB399 | 0.82 | 0.013 | F | 27 | LAB401 | −0.85 | 0.004 | C | 23 |
| LAB399 | 0.82 | 0.013 | D | 9 | LAB401 | 0.81 | 0.014 | B | 2 |
| LAB399 | 0.71 | 0.049 | A | 9 | LAB401 | −0.78 | 0.022 | D | 9 |
| LAB400 | −0.79 | 0.019 | A | 9 | LAB409 | 0.71 | 0.032 | C | 34 |
| LAB400 | 0.74 | 0.022 | D | 15 | LAB603 | −0.80 | 0.017 | A | 9 |
| LAB400 | 0.71 | 0.031 | C | 35 | LAB603 | −0.76 | 0.028 | F | 31 |
| LAB400 | −0.71 | 0.047 | C | 3 | LAB603 | 0.71 | 0.032 | C | 8 |
| LAB603 | 0.70 | 0.034 | C | 11 | | | | | |

Table 15. "Corr. ID "—correlation set ID according to the correlated parameters Table above.
"Exp. Set ID" = Expression set.
"R" = Pearson correlation coefficient;
"P" = p value.

Example 3

Production of Sorghum Transcriptom and High Throughput Correlation Analysis with Yield, NUE, and ABST Related Parameters Measured in Fields Using 44K Sorguhm Oligonucleotide Micro-Arrays In order to produce a high throughput correlation analysis between plant phenotype and gene expression level, the present inventors utilized a sorghum oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Sorghum Varieties Across Ecotypes Grown Under Regular Growth Conditions, Severe Drought Conditions and Low Nitrogen Conditions Experimental Procedures 17 Sorghum varieties were grown in 3 repetitive plots, in field. Briefly, the growing protocol was as follows:

1. Regular growth conditions:—Sorghum plants were grown in the field using commercial fertilization and irrigation protocols, which include 370 m$^3$ water per dunam per entire growth period and fertilization of 14 units of URAN® 21% (Nitrogen Fertilizer Solution; PCS Sales, Northbrook, Ill., USA) (normal growth conditions).

2. Drought conditions:—Sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions:—Sorghum plants were fertilized with 50% less amount of nitrogen in the field than the amount of nitrogen applied in the regular growth treatment. All the fertilizer was applied before flowering.

Analyzed sorghum tissues—All 10 selected Sorghum hybrids were sample per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 16 below.

TABLE 16

Sorghum transcriptom expression sets in field experiments

| Expression Set | Set ID |
| --- | --- |
| Sorghum field/flag leaf/Drought | A |
| Sorghum field/flag leaf/Low N | B |
| Sorghum field/flag leaf/Normal | C |
| Sorghum field/flower meristem/Drought | D |
| Sorghum field/flower meristem/Low N | E |
| Sorghum field/flower meristem/Normal | F |
| Sorghum field/flower/Drought | G |
| Sorghum field/flower/Low N | H |
| Sorghum field/flower/Normal | J |

Table 16:
Provided are the sorghum transcriptom expression sets.
Flag leaf = the leaf below the flower;
Flower meristem = Apical meristem following panicle initiation;
Flower = the flower at the anthesis day.

The following parameters were collected using digital imaging system:

Average Grain Area (cm$^2$)—At the end of the growing period the grains were separated from the Plant 'Head'. A sample of ~200 grains were weighted, photographed and images were processed using the below described image processing system. The grain area was measured from those images and was divided by the number of grains.

Average Grain Length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head Average Area (cm$^2$)—At the end of the growing period 5 'Heads' were, photographed and images were processed using the below described image processing system. The 'Head' area was measured from those images and was divided by the number of 'Heads'.

Head Average Length (cm)—At the end of the growing period 5 'Heads' were, photographed and images were processed using the below described image processing system. The 'Head' length (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight per Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head Per Plant Gram—At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 (FW Head/Plant gr. based on 5 plants) heads.

Plant height—Plants were characterized for height during growing period at 5 time points. In each measure, plants were measured for their height using a measuring tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

Relative Growth Rate—Was calculated using Formulas V and VI.

Relative growth rate of plant height=Regression coefficient of plant height along time course.   Formula V Relative growth rate of plant leaf number=Regression coefficient of plant leaf number along time course.   Formula VI SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative dry weight and Heads—At the end of the experiment (when inflorescence were dry) all inflorescence and vegetative material from plots within blocks A-C were collected. The biomass and heads weight of each plot was separated, measured and divided by the number of heads.

Dry weight=total weight of the vegetative portion above ground (excluding roots) after drying at 70° C. in oven for 48 hours;

Harvest Index (HI) (Sorghum)—The harvest index was calculated using Formula VII.

Harvest Index=Average grain dry weight per Head/(Average vegetative dry weight per Head+Average Head dry weight).   Formula VII FW Heads/(FW Heads+FW Plants)—The total fresh weight of heads and their respective plant biomass was measured at the harvest day. The heads weight was divided by the sum of weights of heads and plants.

Experimental Results 17 different sorghum hybrids were grown and characterized for different parameters (Table 17). The average for each of the measured parameter was calculated using the JMP software (Tables 18-22) and a subsequent correlation analysis was performed (Table 23). Results were then integrated to the database.

TABLE 17

*Sorghum* correlated parameters (vectors)

| Correlation set | Correlation ID |
|---|---|
| [Grain yield/SPAD 64 DPS], Low N | 1 |
| [Grain yield/SPAD 64 DPS], Normal | 2 |
| [Grain Yield + plant biomass/SPAD 64 DPS], Low N | 3 |
| [Grain Yield + plant biomass/SPAD 64 DPS], Normal | 4 |
| [Plant biomass (FW)/SPAD 64 DPS], Drought | 5 |

TABLE 17-continued

*Sorghum* correlated parameters (vectors)

| Correlation set | Correlation ID |
|---|---|
| [Plant biomass (FW)/SPAD 64 DPS], Low N | 6 |
| [Plant biomass (FW)/SPAD 64 DPS], Normal | 7 |
| Average Grain Area ($cm^2$), Drought | 8 |
| Average Grain Area ($cm^2$), Low N | 9 |
| Average Grain Area ($cm^2$), Normal | 10 |
| Final Plant Height (cm), Drought | 11 |
| Final Plant Height (cm), Low N | 12 |
| Final Plant Height (cm), Normal | 13 |
| Head FW (based on 5 heads), Low N | 14 |
| Head FW (based on 5 heads), Normal | 15 |
| FW-Head/Plant gr. (based on plot), Drought | 16 |
| FW-Head/Plant gr. (based on plot), Low N | 17 |
| FW-Head/Plant gr. (based on plot), Normal | 18 |
| FW Heads/(FW Heads + FW Plants) (all plot), Drought | 19 |
| FW Heads/(FW Heads + FW Plants) (all plot), Low N | 20 |
| FW Heads/(FW Heads + FW Plants) (all plot), Normal | 21 |
| FW/Plant gr. (based on plot), Drought | 22 |
| FW/Plant gr. (based on plot), Low N | 23 |
| FW/Plant gr. (based on plot), Normal | 24 |
| Head Average Area ($cm^2$), Drought | 25 |
| Head Average Area ($cm^2$), Low N | 26 |
| Head Average Area ($cm^2$), Normal | 27 |
| Head Average Length (cm), Drought | 28 |
| Head Average Length (cm), Low N | 29 |
| Head Average Length (cm), Normal | 30 |
| Head Average Perimeter (cm), Drought | 31 |
| Head Average Perimeter (cm), Low N | 32 |
| Head Average Perimeter (cm), Normal | 33 |
| Head Average Width (cm), Drought | 34 |
| Head Average Width (cm), Low N | 35 |
| Head Average Width (cm), Normal | 36 |
| Leaf SPAD 64 DPS (Days Post Sowing), Drought | 37 |
| Leaf SPAD 64 DPS (Days Post Sowing), Low N | 38 |
| Leaf SPAD 64 DPS (Days Post Sowing), Normal | 39 |
| Lower Ratio Average Grain Area, Low N | 40 |
| Lower Ratio Average Grain Area, Normal | 41 |
| Lower Ratio Average Grain Length, Low N | 42 |
| Lower Ratio Average Grain Length, Normal | 43 |
| Lower Ratio Average Grain Perimeter, Low N | 44 |
| Lower Ratio Average Grain Perimeter, Normal | 45 |
| Lower Ratio Average Grain Width, Low N | 46 |
| Lower Ratio Average Grain Width, Normal | 47 |
| Total grain weight/Head (based on plot) gr., Low N | 48 |
| Total grain weight/Head gr. (based on 5 heads), Low N | 49 |
| Total grain weight/Head gr. (based on 5 heads), Normal | 50 |
| Total grain weight/Head gr. (based on plot), Normal | 51 |
| Total grain weight/Head gr. (based on plot), Drought | 52 |
| Upper Ratio Average Grain Area, Drought | 53 |
| Upper Ratio Average Grain Area, Low N | 54 |
| Upper Ratio Average Grain Area, Normal | 55 |

Table 17.
Provided are the *Sorghum* correlated parameters (vectors).
"gr." = grams;
"SPAD" = chlorophyll levels;
"FW" = Plant Fresh weight;
"DW" = Plant Dry weight;
"normal" = standard growth conditions;
"DPS" = days post-sowing;
"Low N" = Low Nitrogen conditions;
"Head FW" = fresh weight of the harvested heads was divided by the number of heads that were phenotyped;
"Lower Ratio Average Grain Area" = grain area of the lower fraction of grains.

TABLE 18

Measured parameters in Sorghum accessions under normal conditions

| Seed ID/Correlation ID | 2 | 4 | 7 | 10 | 13 | 15 | 18 | 21 | 24 | 27 | 30 |
|---|---|---|---|---|---|---|---|---|---|---|---|
| 20 | 3.78 | 4.5 | 0.724 | 0.105 | 95.2 | 406 | 175 | 0.51 | 163 | 120 | 25.6 |
| 21 | 7.74 | 8.17 | 0.433 | 0.112 | 79.2 | 518 | 223 | 0.51 | 213 | 168 | 26.8 |
| 22 | 7.01 | 7.87 | 0.858 | 0.131 | 198 | 148 | 56.4 | 0.115 | 335 | 85.1 | 21 |

TABLE 18-continued

Measured parameters in Sorghum accessions under normal conditions

| Seed ID/ Correlation ID | 2 | 4 | 7 | 10 | 13 | 15 | 18 | 21 | 24 | 27 | 30 |
|---|---|---|---|---|---|---|---|---|---|---|---|
| 24 | 10.1 | 10.7 | 0.583 | 0.129 | 234 | 423 | 112 | 0.263 | 313 | 157 | 26.8 |
| 25 | 7.65 | 8.34 | 0.693 | 0.139 | 189 | 92 | 67.3 | 0.12 | 462 | 104 | 23.1 |
| 26 | 3.34 | 4.4 | 1.05 | 0.141 | 195 | 101 | 66.9 | 0.177 | 318 | 102 | 21.8 |
| 27 | 3.05 | 3.73 | 0.687 | 0.11 | 117 | 424 | 126 | 0.459 | 151 | 169 | 31.3 |
| 28 | 3.9 | 4.83 | 0.929 | 0.113 | 92.8 | 386 | 108 | 0.432 | 138 | 109 | 23.2 |
| 29 | 2.83 | 3.67 | 0.841 | 0.102 | 113 | 410 | 124 | 0.425 | 168 | 135 | 25.7 |
| 30 | 2.18 | 2.89 | 0.716 | 0.118 | 97.5 | 329 | 103 | 0.442 | 129 | 169 | 28.8 |
| 31 | 2.19 | 2.91 | 0.721 | 0.121 | 98 | 391 | 82.3 | 0.458 | 97.6 | 156 | 28.1 |
| 32 | 2.41 | 3.12 | 0.705 | 0.111 | 100 | 436 | 77.6 | 0.447 | 99.3 | 112 | 23 |
| 33 | 3.58 | 4.75 | 1.17 | 0.117 | 106 | 430 | 91.2 | 0.447 | 112 | 155 | 28.1 |
| 34 | 2.9 | 3.69 | 0.792 | 0.108 | 151 | 441 | 150 | 0.513 | 157 | 172 | 30 |
| 35 | 3 | 3.85 | 0.849 | 0.105 | 117 | 416 | 109 | 0.46 | 131 | 169 | 30.5 |
| 36 | 4.85 | 5.83 | 0.984 | 0.11 | 124 | 430 | 108 | 0.442 | 136 | 163 | 27.2 |
| 37 | | | | 0.105 | 126 | 428 | 131 | 0.386 | 209 | 170 | 29.3 |

Table 18: Provided are the values of each of the parameters (as described above) measured in Sorghum accessions (Seed ID) under normal conditions.
Growth conditions are specified in the experimental procedure section.

TABLE 19

Additional measured parameters in Sorghum accessions under normal growth conditions

| Seed ID/ Corr. ID | 33 | 36 | 39 | 41 | 43 | 45 | 47 | 50 | 51 | 55 |
|---|---|---|---|---|---|---|---|---|---|---|
| 20 | 61.2 | 5.97 | 43 | 0.825 | 0.914 | 0.914 | 0.908 | 47.4 | 31.1 | 1.22 |
| 21 | 67.9 | 7.92 | 0 | 0.74 | 0.884 | 0.869 | 0.833 | 46.3 | 26.4 | 1.3 |
| 22 | 56.3 | 4.87 | 43.3 | 0.778 | 0.921 | 0.913 | 0.85 | 28.4 | 18.7 | 1.13 |
| 24 | 65.4 | 7.43 | 44.7 | 0.802 | 0.908 | 0.948 | 0.874 | 70.4 | 38.4 | 1.14 |
| 25 | 67.5 | 5.58 | 45.8 | 0.697 | 0.89 | 0.902 | 0.788 | 32.1 | 26.7 | 1.16 |
| 26 | 67.5 | 5.88 | 41.6 | 0.699 | 0.877 | 0.915 | 0.799 | 49.2 | 28.8 | 1.15 |
| 27 | 74.4 | 6.78 | 45.2 | 0.827 | 0.913 | 0.913 | 0.904 | 63.5 | 47.7 | 1.19 |
| 28 | 56.2 | 5.99 | 45.1 | 0.805 | 0.903 | 0.91 | 0.893 | 44.5 | 31 | 1.23 |
| 29 | 61.6 | 6.62 | 43 | 0.841 | 0.92 | 0.918 | 0.915 | 56.6 | 40 | 1.25 |
| 30 | 71.4 | 7.42 | 45.6 | 0.788 | 0.923 | 0.93 | 0.854 | 60 | 38.4 | 1.24 |
| 31 | 68.6 | 6.98 | 44.8 | 0.765 | 0.893 | 0.911 | 0.863 | 45.5 | 32.1 | 1.32 |
| 32 | 56.4 | 6.19 | 45.3 | 0.803 | 0.913 | 0.916 | 0.885 | 58.2 | 32.7 | 1.22 |
| 33 | 67.8 | 7.02 | 46.5 | 0.806 | 0.907 | 0.904 | 0.898 | 70.6 | 32.8 | 1.18 |
| 34 | 71.5 | 7.18 | 44 | 0.821 | 0.911 | 0.912 | 0.905 | 70.1 | 51.5 | 1.18 |
| 35 | 78.9 | 7 | 45.1 | 0.814 | 0.904 | 0.905 | 0.91 | 54 | 35.7 | 1.22 |
| 36 | 67 | 7.39 | 45.1 | 0.818 | 0.903 | 0.909 | 0.902 | 59.9 | 38.3 | 1.25 |
| 37 | 74.1 | 7.35 | 43.1 | 0.817 | 0.913 | 0.905 | 0.899 | 52.6 | 42.4 | 1.22 |

Table 19: Provided are the values of each of the parameters (as described above) measured in Sorghum accessions (Seed ID) under normal conditions.
Growth conditions are specified in the experimental procedure section.

TABLE 20

Measured parameters in Sorghum accessions under low nitrogen conditions

| Seed ID/ Corr. ID | 1 | 3 | 6 | 9 | 12 | 14 | 17 | 20 | 23 | 26 | 29 |
|---|---|---|---|---|---|---|---|---|---|---|---|
| 20 | 0.677 | 6.02 | 5.34 | 0.105 | 104 | 388 | 215 | 0.505 | 205 | 96.2 | 23.2 |
| 21 | 0.784 | 5.91 | 5.12 | 0.111 | 80.9 | 429 | 205 | 0.506 | 200 | 215 | 25.6 |
| 22 | 0.458 | 8.5 | 8.04 | 0.136 | 205 | 298 | 73.5 | 0.166 | 341 | 98.6 | 20.9 |
| 24 | 0.871 | 6.75 | 5.88 | 0.121 | 125 | 280 | 123 | 0.391 | 241 | 183 | 28.4 |
| 25 | 0.584 | 13.1 | 12.5 | 0.141 | 225 | 208 | 153 | 0.21 | 538 | 120 | 24.3 |
| 26 | 0.557 | 9.57 | 9.02 | 0.134 | 208 | 304 | 93.2 | 0.192 | 359 | 110 | 22.6 |
| 27 | 1.17 | 4.67 | 3.5 | 0.119 | 121 | 436 | 134 | 0.476 | 149 | 172 | 32.1 |
| 28 | 0.634 | 3.61 | 2.98 | 0.117 | 100 | 376 | 77.4 | 0.375 | 129 | 84.8 | 20.4 |
| 29 | 1.31 | 5.89 | 4.58 | 0.116 | 121 | 475 | 130 | 0.42 | 179 | 156 | 26.7 |
| 30 | 0.862 | 3.77 | 2.91 | 0.129 | 94.5 | 438 | 99.8 | 0.441 | 124 | 137 | 26.3 |
| 31 | 0.735 | 3.26 | 2.53 | 0.131 | 110 | 383 | 76.9 | 0.429 | 101 | 138 | 25.4 |
| 32 | 0.607 | 3.61 | 3 | 0.12 | 115 | 375 | 84.2 | 0.387 | 132 | 96.5 | 23.1 |
| 33 | 0.648 | 3.24 | 2.59 | 0.116 | 105 | 425 | 92.2 | 0.438 | 118 | 158 | 27.9 |
| 34 | 1.14 | 5.1 | 3.96 | 0.115 | 174 | 434 | 139 | 0.439 | 177 | 164 | 28.9 |

TABLE 20-continued

Measured parameters in Sorghum accessions under low nitrogen conditions

| Seed ID/ Corr. ID | 1 | 3 | 6 | 9 | 12 | 14 | 17 | 20 | 23 | 26 | 29 |
|---|---|---|---|---|---|---|---|---|---|---|---|
| 35 | 0.87 | 4.25 | 3.38 | 0.107 | 116 | 409 | 113 | 0.442 | 144 | 138 | 27.6 |
| 36 | 0.91 | 3.81 | 2.9 | 0.121 | 139 | 378 | 95.5 | 0.43 | 127 | 135 | 25.5 |
| 37 | 0.894 | 4.76 | 3.86 | 0.109 | 144 | 432 | 129 | 0.417 | 180 | 166 | 30.3 |

Table 20: Provided are the values of each of the parameters (as described above) measured in Sorghum accessions (Seed ID) under low nitrogen conditions.
Growth conditions are specified in the experimental procedure section.

TABLE 21

Additional measured parameters in Sorghum accessions under low nitrogen growth conditions

| Seed ID/ Corr. ID | 32 | 35 | 38 | 40 | 42 | 44 | 46 | 48 | 49 | 54 |
|---|---|---|---|---|---|---|---|---|---|---|
| 20 | 56.3 | 5.26 | 38.3 | 0.815 | 0.91 | 0.901 | 0.901 | 25.9 | 50.3 | 1.18 |
| 21 | 79.2 | 10.4 | 39 | 0.77 | 0.9 | 0.884 | 0.852 | 30.6 | 50.9 | 1.31 |
| 22 | 53.2 | 5.93 | 42.3 | 0.81 | 0.921 | 0.915 | 0.893 | 19.4 | 36.1 | 1.11 |
| 24 | 76.2 | 8.25 | 40.9 | 0.793 | 0.898 | 0.897 | 0.88 | 35.6 | 73.1 | 1.21 |
| 25 | 67.3 | 6.19 | 43.1 | 0.78 | 0.908 | 0.919 | 0.863 | 25.2 | 37.9 | 1.19 |
| 26 | 59.5 | 6.12 | 39.9 | 0.799 | 0.926 | 0.918 | 0.871 | 22.2 | 36.4 | 1.18 |
| 27 | 79.3 | 6.8 | 42.7 | 0.834 | 0.918 | 0.916 | 0.91 | 50 | 71.7 | 1.16 |
| 28 | 51.5 | 5.25 | 43.3 | 0.788 | 0.89 | 0.891 | 0.888 | 27.5 | 35 | 1.23 |
| 29 | 69.9 | 7.52 | 39 | 0.806 | 0.901 | 0.898 | 0.899 | 51.1 | 76.7 | 1.17 |
| 30 | 66.2 | 6.59 | 42.7 | 0.772 | 0.909 | 0.907 | 0.857 | 36.8 | 57.6 | 1.22 |
| 31 | 67.4 | 6.85 | 40.1 | 0.741 | 0.886 | 0.895 | 0.842 | 29.4 | 42.9 | 1.24 |
| 32 | 57.9 | 5.32 | 44 | 0.804 | 0.897 | 0.903 | 0.897 | 26.7 | 36.5 | 1.19 |
| 33 | 70.6 | 7.25 | 45.4 | 0.788 | 0.894 | 0.896 | 0.887 | 29.4 | 68.6 | 1.23 |
| 34 | 73.8 | 7.19 | 44.8 | 0.823 | 0.911 | 0.914 | 0.908 | 51.1 | 71.8 | 1.16 |
| 35 | 66.9 | 6.27 | 42.6 | 0.801 | 0.888 | 0.894 | 0.899 | 37 | 49.3 | 1.34 |
| 36 | 65.4 | 6.57 | 43.8 | 0.809 | 0.892 | 0.896 | 0.902 | 39.9 | 43.9 | 1.21 |
| 37 | 76 | 6.82 | 46.7 | 0.807 | 0.901 | 0.897 | 0.897 | 41.8 | 52.1 | 1.21 |

Table 21: Provided are the values of each of the parameters (as described above) measured in Sorghum accessions (Seed ID) under low nitrogen conditions.
Growth conditions are specified in the experimental procedure section.

TABLE 22

Measured parameters in *Sorghum* accessions under drought conditions

| Seed ID | 5 | 8 | 11 | 16 | 19 | 22 | 25 | 28 | 31 | 34 | 37 | 52 | 53 |
|---|---|---|---|---|---|---|---|---|---|---|---|---|---|
| 20 | 5.13 | 0.10 | 89 | 155 | 0.42 | 208 | 83 | 21.6 | 52.8 | 4.83 | 40.6 | 22.1 | 1.31 |
| 21 | 3.38 | 0.12 | 76 | 122 | 0.47 | 138 | 108 | 21.9 | 64.5 | 6.31 | 40.9 | 16.8 | 1.19 |
| 22 | 5.67 | 0.11 | 92 | 131 | 0.42 | 255 | 89 | 21.6 | 56.6 | 5.16 | 45 | 9.19 | 1.29 |
| 24 | 9.51 | 0.09 | 94 | 241 | 0.37 | 402 | 136 | 22.0 | 64.4 | 7.78 | 42.3 | 104 | 1.46 |
| 25 | 5.16 | 0.09 | 151 | 69 | 0.23 | 234 | 91 | 21.0 | 53.2 | 5.28 | 45.2 | 3.24 | 1.21 |
| 26 | 9.66 | 0.11 | 111 | 186 | 0.31 | 392 | 124 | 28.6 | 71.7 | 5.49 | 40.6 | 22 | 1.21 |
| 27 | 1.99 | | 99 | 62 | 0.41 | 89 | 86 | 21.3 | 55.6 | 5.04 | 44.8 | 9.97 | |
| 28 | 1.12 | | 84 | 39 | 0.44 | 51 | 85 | 20.8 | 53.0 | 5.07 | 45.1 | 18.6 | |
| 29 | 2.14 | | 99 | 59 | 0.40 | 87 | 113 | 24.7 | 69.8 | 5.77 | 40.6 | 29.3 | |
| 30 | 2.65 | | 92 | 76 | 0.44 | 120 | 101 | 24.3 | 56.1 | 5.37 | 45.4 | 10.5 | |
| 31 | 0.87 | | 82 | 34 | 0.47 | 37 | 80 | 21.9 | 55.3 | 4.66 | 42.6 | 14.8 | |
| 32 | 1.09 | | 99 | 42 | 0.47 | 48 | 127 | 25.0 | 69.1 | 6.35 | 44.2 | 12.9 | |
| 33 | 0.99 | | 87 | 42 | 0.48 | 44 | 86 | 19.5 | 53.3 | 5.58 | 44.6 | 18.2 | |
| 34 | 5.46 | | 100 | 132 | 0.35 | 232 | 92 | 20.4 | 56.3 | 5.76 | 42.4 | 11.6 | |
| 35 | 2.68 | | 83 | 61 | 0.35 | 116 | 78 | 16.8 | 49.1 | 5.86 | 43.2 | 18.6 | |
| 36 | 3.05 | | 84 | 44 | 0.23 | 123 | 77 | 18.9 | 51.9 | 5.1 | 40.3 | 16.4 | |
| 37 | 8.40 | | 92 | 185 | 0.33 | 342 | | | | | 40.8 | | |

Table 22: Provided are the values of each of the parameters (as described above) measured in *Sorghum* accessions (Seed ID) under drought conditions.
Growth conditions are specified in the experimental procedure section.

TABLE 23

Correlation between the expression level of selected LAB genes of some embodiments of the invention in various tissues and the phenotypic performance under low nitrogen, normal or drought stress conditions across *Sorghum* accessions

| Gene Name | R | P value | Corr. ID | Exp. set ID | Gene Name | R | P value | Corr. ID | Exp set ID |
|---|---|---|---|---|---|---|---|---|---|
| LAB394 | −0.71 | 0.021 | B | 26 | LAB538 | −0.83 | 0.003 | C | 13 |
| LAB394 | −0.71 | 0.023 | B | 35 | LAB538 | −0.78 | 0.008 | C | 51 |
| LAB394 | −0.70 | 0.036 | A | 52 | LAB538 | −0.75 | 0.013 | C | 45 |
| LAB537 | −0.87 | 0.001 | B | 54 | LAB538 | −0.74 | 0.015 | B | 1 |
| LAB537 | 0.84 | 0.002 | B | 46 | LAB538 | −0.73 | 0.018 | B | 44 |
| LAB537 | 0.81 | 0.005 | B | 40 | LAB538 | 0.72 | 0.029 | C | 2 |
| LAB537 | 0.76 | 0.011 | B | 44 | LAB538 | 0.70 | 0.034 | C | 4 |
| LAB537 | 0.75 | 0.013 | B | 12 | LAB539 | −0.86 | 0.001 | B | 44 |
| LAB537 | 0.72 | 0.018 | B | 48 | LAB539 | 0.84 | 0.003 | D | 22 |
| LAB394 | −0.71 | 0.021 | B | 26 | LAB539 | 0.84 | 0.003 | D | 5 |
| LAB539 | −0.82 | 0.003 | C | 51 | LAB540 | −0.80 | 0.005 | E | 29 |
| LAB539 | 0.80 | 0.005 | B | 54 | LAB540 | 0.79 | 0.007 | C | 15 |
| LAB539 | 0.76 | 0.010 | F | 13 | LAB540 | −0.78 | 0.007 | E | 14 |
| LAB539 | 0.75 | 0.012 | F | 51 | LAB540 | 0.78 | 0.007 | C | 21 |
| LAB539 | 0.74 | 0.015 | D | 16 | LAB540 | −0.75 | 0.012 | B | 29 |
| LAB539 | −0.71 | 0.021 | C | 13 | LAB540 | −0.74 | 0.014 | E | 32 |
| LAB539 | −0.70 | 0.023 | B | 12 | LAB540 | −0.72 | 0.019 | C | 39 |
| LAB540 | −0.86 | 0.001 | E | 48 | LAB540 | 0.72 | 0.029 | C | 2 |
| LAB540 | 0.85 | 0.002 | C | 18 | LAB540 | 0.71 | 0.031 | A | 31 |
| LAB540 | −0.80 | 0.005 | E | 1 | LAB541 | 0.88 | 0.001 | C | 18 |
| LAB541 | 0.82 | 0.004 | C | 13 | LAB543 | 0.81 | 0.005 | B | 54 |
| LAB541 | 0.79 | 0.006 | C | 50 | LAB543 | −0.77 | 0.009 | B | 12 |
| LAB541 | 0.78 | 0.008 | B | 44 | LAB543 | −0.74 | 0.023 | G | 52 |
| LAB541 | 0.77 | 0.010 | B | 49 | LAB543 | −0.73 | 0.016 | B | 44 |
| LAB541 | −0.74 | 0.015 | B | 54 | LAB543 | 0.72 | 0.019 | E | 6 |
| LAB541 | 0.72 | 0.018 | B | 42 | LAB543 | 0.71 | 0.022 | E | 23 |
| LAB541 | 0.72 | 0.019 | B | 40 | LAB544 | 0.86 | 0.001 | F | 51 |
| LAB541 | 0.71 | 0.023 | D | 16 | LAB544 | 0.83 | 0.003 | D | 11 |
| LAB542 | 0.72 | 0.018 | C | 50 | LAB544 | −0.82 | 0.004 | B | 12 |
| LAB542 | 0.72 | 0.019 | B | 9 | LAB544 | 0.77 | 0.009 | F | 30 |
| LAB544 | 0.77 | 0.010 | B | 54 | LAB545 | 0.80 | 0.005 | B | 48 |
| LAB544 | 0.76 | 0.011 | F | 13 | LAB545 | 0.79 | 0.006 | B | 44 |
| LAB544 | 0.74 | 0.013 | D | 22 | LAB545 | 0.79 | 0.006 | C | 50 |
| LAB544 | −0.74 | 0.014 | B | 40 | LAB545 | 0.78 | 0.007 | B | 1 |
| LAB544 | −0.73 | 0.017 | B | 46 | LAB545 | −0.77 | 0.009 | B | 54 |
| LAB544 | 0.73 | 0.017 | D | 5 | LAB545 | 0.77 | 0.009 | E | 9 |
| LAB544 | −0.71 | 0.021 | B | 48 | LAB545 | −0.77 | 0.009 | D | 16 |
| LAB545 | −0.84 | 0.004 | G | 52 | LAB545 | 0.76 | 0.011 | B | 42 |
| LAB545 | 0.83 | 0.003 | B | 40 | LAB545 | −0.75 | 0.012 | E | 23 |
| LAB545 | 0.81 | 0.004 | B | 12 | LAB545 | 0.75 | 0.013 | B | 46 |
| LAB545 | 0.75 | 0.013 | C | 51 | LAB546 | 0.74 | 0.014 | F | 4 |
| LAB545 | 0.74 | 0.014 | G | 37 | LAB546 | 0.74 | 0.015 | B | 42 |
| LAB545 | 0.73 | 0.016 | F | 10 | LAB546 | 0.73 | 0.016 | B | 40 |
| LAB545 | −0.72 | 0.018 | F | 47 | LAB546 | 0.73 | 0.016 | B | 44 |
| LAB545 | −0.71 | 0.023 | D | 22 | LAB546 | 0.71 | 0.021 | F | 2 |
| LAB545 | −0.70 | 0.024 | D | 5 | LAB546 | −0.70 | 0.023 | B | 54 |
| LAB546 | −0.87 | 0.001 | F | 45 | LAB547 | 0.88 | 0.001 | B | 48 |
| LAB546 | 0.84 | 0.002 | C | 13 | LAB547 | 0.86 | 0.001 | B | 1 |
| LAB546 | 0.78 | 0.008 | C | 51 | LAB547 | 0.84 | 0.002 | C | 13 |
| LAB546 | −0.77 | 0.009 | F | 43 | LAB547 | 0.83 | 0.003 | B | 12 |
| LAB547 | 0.80 | 0.005 | B | 44 | LAB548 | −0.81 | 0.005 | B | 48 |
| LAB547 | 0.80 | 0.006 | C | 51 | LAB548 | 0.80 | 0.006 | D | 22 |
| LAB547 | 0.78 | 0.008 | B | 29 | LAB548 | −0.79 | 0.006 | B | 12 |
| LAB547 | 0.76 | 0.011 | C | 30 | LAB548 | 0.79 | 0.007 | D | 5 |
| LAB547 | −0.72 | 0.020 | F | 51 | LAB548 | 0.78 | 0.007 | E | 23 |
| LAB547 | 0.70 | 0.023 | F | 55 | LAB548 | 0.78 | 0.008 | C | 15 |
| LAB547 | 0.70 | 0.024 | B | 42 | LAB548 | 0.77 | 0.010 | E | 14 |
| LAB548 | 0.86 | 0.002 | F | 51 | LAB548 | −0.75 | 0.020 | A | 52 |
| LAB548 | 0.85 | 0.002 | F | 13 | LAB548 | 0.74 | 0.015 | E | 3 |
| LAB548 | −0.81 | 0.004 | B | 29 | LAB548 | −0.74 | 0.015 | C | 39 |
| LAB548 | −0.73 | 0.016 | C | 45 | LAB550 | −0.88 | 0.001 | D | 22 |
| LAB548 | −0.72 | 0.019 | F | 55 | LAB550 | −0.87 | 0.001 | D | 5 |
| LAB548 | 0.72 | 0.020 | E | 26 | LAB550 | −0.87 | 0.001 | F | 47 |
| LAB548 | −0.71 | 0.021 | B | 1 | LAB550 | −0.84 | 0.002 | F | 41 |
| LAB548 | −0.71 | 0.021 | F | 10 | LAB550 | 0.84 | 0.003 | A | 22 |
| LAB548 | −0.70 | 0.023 | B | 49 | LAB550 | 0.84 | 0.003 | A | 5 |
| LAB549 | 0.78 | 0.008 | B | 44 | LAB550 | −0.83 | 0.003 | F | 45 |
| LAB549 | −0.76 | 0.011 | A | 11 | LAB550 | −0.83 | 0.003 | F | 39 |
| LAB549 | 0.71 | 0.021 | C | 50 | LAB550 | −0.82 | 0.004 | D | 16 |
| LAB549 | 0.71 | 0.021 | F | 55 | LAB550 | 0.81 | 0.004 | G | 11 |
| LAB550 | −0.81 | 0.005 | F | 13 | LAB550 | 0.71 | 0.033 | C | 4 |
| LAB550 | −0.80 | 0.005 | F | 43 | LAB550 | −0.71 | 0.022 | F | 51 |
| LAB550 | 0.80 | 0.006 | E | 9 | LAB551 | −0.90 | 3.83E−04 | F | 41 |

TABLE 23-continued

Correlation between the expression level of selected LAB genes of some embodiments of the invention in various tissues and the phenotypic performance under low nitrogen, normal or drought stress conditions across *Sorghum* accessions

| Gene Name | R | P value | Corr. ID | Exp. set ID | Gene Name | R | P value | Corr. ID | Exp set ID |
|---|---|---|---|---|---|---|---|---|---|
| LAB550 | −0.79 | 0.007 | B | 9 | LAB551 | −0.85 | 0.002 | F | 47 |
| LAB550 | 0.78 | 0.008 | C | 24 | LAB551 | 0.78 | 0.008 | B | 12 |
| LAB550 | 0.78 | 0.008 | F | 2 | LAB551 | −0.77 | 0.009 | F | 43 |
| LAB550 | 0.76 | 0.010 | C | 36 | LAB551 | −0.72 | 0.018 | F | 51 |
| LAB550 | 0.75 | 0.013 | F | 4 | LAB551 | 0.71 | 0.020 | C | 21 |
| LAB550 | 0.75 | 0.013 | B | 48 | LAB551 | 0.70 | 0.023 | F | 55 |
| LAB550 | 0.73 | 0.024 | C | 2 | LAB551 | 0.70 | 0.024 | B | 48 |
| LAB552 | 0.87 | 0.001 | F | 55 | LAB554 | 0.73 | 0.017 | D | 22 |
| LAB552 | 0.79 | 0.007 | B | 1 | LAB554 | 0.72 | 0.020 | D | 5 |
| LAB552 | −0.78 | 0.008 | F | 41 | LAB554 | 0.76 | 0.011 | E | 1 |
| LAB552 | 0.77 | 0.009 | E | 9 | LAB554 | 0.75 | 0.013 | E | 48 |
| LAB552 | 0.74 | 0.014 | B | 48 | LAB554 | 0.84 | 0.002 | F | 51 |
| LAB552 | −0.74 | 0.015 | F | 47 | LAB554 | 0.76 | 0.010 | F | 13 |
| LAB552 | 0.73 | 0.016 | C | 30 | LAB554 | −0.73 | 0.017 | F | 55 |
| LAB552 | −0.73 | 0.016 | E | 40 | LAB555 | 0.79 | 0.007 | F | 21 |
| LAB552 | 0.70 | 0.024 | B | 29 | LAB555 | 0.72 | 0.019 | B | 9 |
| LAB553 | 0.83 | 0.003 | B | 12 | LAB557 | 0.86 | 0.001 | F | 36 |
| LAB553 | 0.79 | 0.007 | B | 48 | LAB557 | 0.79 | 0.006 | B | 42 |
| LAB554 | −0.82 | 0.004 | B | 12 | LAB557 | 0.77 | 0.010 | B | 1 |
| LAB554 | 0.72 | 0.018 | B | 54 | LAB557 | 0.76 | 0.018 | G | 34 |
| LAB554 | 0.79 | 0.012 | C | 4 | LAB557 | −0.74 | 0.023 | C | 2 |
| LAB554 | 0.73 | 0.027 | C | 2 | LAB557 | 0.74 | 0.015 | C | 51 |
| LAB557 | 0.73 | 0.016 | F | 27 | LAB558 | −0.71 | 0.021 | C | 24 |
| LAB557 | −0.73 | 0.025 | C | 4 | LAB558 | −0.70 | 0.023 | C | 18 |
| LAB557 | 0.73 | 0.017 | C | 13 | LAB558 | −0.70 | 0.034 | C | 2 |
| LAB557 | 0.72 | 0.019 | B | 48 | LAB559 | −0.71 | 0.031 | A | 28 |
| LAB557 | −0.71 | 0.022 | C | 18 | LAB559 | 0.70 | 0.023 | B | 46 |
| LAB557 | 0.70 | 0.024 | C | 10 | LAB561 | 0.89 | 4.80E−04 | D | 22 |
| LAB558 | 0.91 | 2.65E−04 | B | 12 | LAB561 | 0.89 | 0.001 | D | 5 |
| LAB558 | 0.90 | 3.91E−04 | F | 55 | LAB561 | −0.81 | 0.004 | B | 42 |
| LAB558 | −0.80 | 0.005 | B | 20 | LAB561 | 0.80 | 0.006 | D | 16 |
| LAB558 | −0.77 | 0.009 | F | 41 | LAB561 | −0.73 | 0.016 | B | 20 |
| LAB558 | −0.75 | 0.013 | C | 15 | LAB561 | −0.72 | 0.019 | F | 10 |
| LAB558 | −0.75 | 0.020 | A | 52 | LAB562 | 0.90 | 3.29E−04 | B | 35 |
| LAB558 | −0.74 | 0.014 | F | 43 | LAB562 | −0.87 | 0.001 | C | 45 |
| LAB558 | −0.71 | 0.020 | F | 47 | LAB562 | −0.86 | 0.002 | C | 39 |
| LAB558 | −0.71 | 0.031 | C | 4 | LAB562 | 0.83 | 0.005 | A | 28 |
| LAB562 | 0.82 | 0.004 | B | 54 | LAB564 | −0.73 | 0.016 | A | 37 |
| LAB562 | 0.81 | 0.008 | A | 31 | LAB564 | 0.73 | 0.018 | D | 16 |
| LAB562 | −0.81 | 0.004 | C | 43 | LAB565 | 0.89 | 0.001 | A | 28 |
| LAB562 | −0.80 | 0.005 | C | 41 | LAB565 | 0.87 | 0.003 | A | 31 |
| LAB562 | −0.80 | 0.006 | C | 47 | LAB565 | −0.85 | 0.002 | B | 29 |
| LAB562 | 0.80 | 0.010 | A | 25 | LAB565 | 0.83 | 0.006 | A | 25 |
| LAB562 | 0.80 | 0.006 | C | 15 | LAB565 | −0.81 | 0.005 | B | 32 |
| LAB562 | 0.74 | 0.014 | C | 36 | LAB565 | −0.74 | 0.014 | B | 14 |
| LAB562 | 0.71 | 0.020 | A | 19 | LAB565 | −0.74 | 0.014 | B | 26 |
| LAB562 | 0.71 | 0.034 | C | 2 | LAB565 | −0.73 | 0.017 | B | 49 |
| LAB563 | 0.85 | 0.002 | C | 51 | LAB565 | 0.70 | 0.023 | F | 10 |
| LAB563 | 0.73 | 0.016 | C | 30 | LAB566 | 0.94 | 5.97E−05 | B | 48 |
| LAB563 | 0.71 | 0.022 | C | 13 | LAB566 | 0.92 | 1.48E−04 | B | 1 |
| LAB563 | 0.70 | 0.034 | A | 28 | LAB566 | 0.90 | 4.09E−04 | C | 13 |
| LAB563 | 0.70 | 0.023 | C | 50 | LAB566 | 0.87 | 0.002 | G | 34 |
| LAB566 | 0.84 | 0.002 | B | 44 | LAB567 | −0.72 | 0.019 | B | 29 |
| LAB566 | 0.76 | 0.017 | D | 34 | LAB567 | 0.71 | 0.021 | E | 3 |
| LAB566 | 0.76 | 0.011 | B | 29 | LAB568 | 0.82 | 0.004 | A | 37 |
| LAB566 | 0.76 | 0.012 | F | 36 | LAB568 | 0.76 | 0.010 | C | 24 |
| LAB566 | 0.73 | 0.016 | B | 49 | LAB568 | −0.74 | 0.014 | A | 5 |
| LAB566 | 0.73 | 0.017 | C | 51 | LAB568 | 0.73 | 0.016 | C | 18 |
| LAB566 | 0.71 | 0.020 | B | 42 | LAB568 | −0.73 | 0.016 | A | 22 |
| LAB566 | 0.71 | 0.023 | C | 50 | LAB569 | 0.92 | 1.93E−04 | C | 51 |
| LAB567 | 0.94 | 5.15E−05 | D | 22 | LAB569 | 0.88 | 0.001 | C | 13 |
| LAB567 | 0.93 | 8.42E−05 | D | 5 | LAB569 | 0.85 | 0.002 | F | 10 |
| LAB567 | 0.85 | 0.002 | F | 13 | LAB569 | 0.83 | 0.003 | C | 30 |
| LAB567 | 0.84 | 0.002 | D | 16 | LAB569 | 0.80 | 0.006 | C | 50 |
| LAB567 | 0.81 | 0.005 | F | 51 | LAB569 | 0.74 | 0.015 | E | 9 |
| LAB567 | −0.79 | 0.006 | B | 44 | LAB569 | 0.74 | 0.015 | C | 33 |
| LAB567 | 0.76 | 0.011 | E | 23 | LAB569 | −0.71 | 0.020 | D | 22 |
| LAB569 | −0.71 | 0.021 | D | 5 | LAB572 | 0.78 | 0.008 | B | 29 |
| LAB570 | 0.83 | 0.003 | B | 12 | LAB572 | 0.77 | 0.009 | F | 55 |
| LAB570 | −0.76 | 0.011 | G | 11 | LAB572 | 0.76 | 0.010 | F | 10 |
| LAB570 | 0.73 | 0.017 | C | 51 | LAB572 | −0.76 | 0.010 | C | 24 |
| LAB570 | 0.73 | 0.017 | C | 13 | LAB572 | 0.73 | 0.015 | C | 51 |
| LAB570 | 0.72 | 0.019 | B | 38 | LAB572 | −0.73 | 0.017 | B | 23 |

TABLE 23-continued

Correlation between the expression level of selected LAB genes of some embodiments of the invention in various tissues and the phenotypic performance under low nitrogen, normal or drought stress conditions across *Sorghum* accessions

| Gene Name | R | P value | Corr. ID | Exp. set ID | Gene Name | R | P value | Corr. ID | Exp set ID |
|---|---|---|---|---|---|---|---|---|---|
| LAB571 | 0.87 | 0.001 | C | 33 | LAB573 | 0.87 | 0.001 | F | 24 |
| LAB571 | 0.86 | 0.001 | C | 30 | LAB573 | 0.86 | 0.001 | C | 51 |
| LAB571 | 0.82 | 0.004 | C | 27 | LAB573 | 0.85 | 0.002 | B | 12 |
| LAB571 | 0.73 | 0.016 | E | 12 | LAB573 | 0.84 | 0.002 | F | 18 |
| LAB572 | 0.88 | 0.001 | B | 48 | LAB573 | −0.80 | 0.010 | A | 52 |
| LAB572 | 0.85 | 0.002 | B | 9 | LAB573 | 0.77 | 0.010 | C | 13 |
| LAB572 | −0.82 | 0.004 | C | 18 | LAB573 | −0.74 | 0.015 | F | 7 |
| LAB572 | 0.81 | 0.004 | B | 1 | LAB573 | 0.72 | 0.018 | B | 38 |
| LAB572 | 0.81 | 0.005 | B | 12 | LAB573 | 0.71 | 0.031 | A | 31 |
| LAB610 | −0.70 | 0.024 | B | 12 | LAB576 | 0.80 | 0.005 | B | 49 |
| LAB575 | −0.95 | 2.10E−05 | F | 47 | LAB576 | 0.80 | 0.005 | B | 44 |
| LAB575 | −0.93 | 1.05E−04 | B | 44 | LAB576 | 0.79 | 0.006 | G | 11 |
| LAB575 | −0.90 | 4.34E−04 | F | 43 | LAB576 | −0.76 | 0.016 | G | 52 |
| LAB575 | −0.83 | 0.003 | B | 1 | LAB576 | 0.76 | 0.010 | F | 10 |
| LAB575 | 0.83 | 0.003 | F | 55 | LAB576 | 0.76 | 0.011 | F | 55 |
| LAB575 | −0.81 | 0.004 | B | 48 | LAB576 | 0.75 | 0.013 | C | 51 |
| LAB575 | −0.79 | 0.007 | F | 39 | LAB576 | −0.74 | 0.014 | E | 40 |
| LAB575 | 0.78 | 0.007 | B | 42 | LAB576 | 0.73 | 0.016 | C | 13 |
| LAB575 | 0.78 | 0.008 | B | 54 | LAB576 | 0.73 | 0.017 | B | 42 |
| LAB575 | −0.75 | 0.012 | F | 45 | LAB576 | 0.72 | 0.019 | B | 12 |
| LAB575 | −0.73 | 0.016 | E | 40 | LAB576 | 0.71 | 0.021 | E | 9 |
| LAB575 | 0.72 | 0.018 | E | 9 | LAB577 | 0.88 | 0.002 | C | 4 |
| LAB576 | 0.83 | 0.003 | B | 1 | LAB577 | 0.84 | 0.002 | F | 4 |
| LAB576 | 0.83 | 0.003 | B | 48 | LAB577 | 0.84 | 0.003 | F | 2 |
| LAB577 | 0.84 | 0.005 | C | 2 | LAB582 | 0.91 | 0.001 | C | 4 |
| LAB577 | 0.73 | 0.016 | G | 16 | LAB582 | −0.91 | 2.77E−04 | B | 46 |
| LAB578 | 0.80 | 0.006 | C | 51 | LAB582 | −0.91 | 3.00E−04 | C | 45 |
| LAB578 | 0.78 | 0.007 | B | 42 | LAB582 | −0.90 | 4.03E−04 | B | 40 |
| LAB578 | 0.76 | 0.011 | C | 24 | LAB582 | −0.87 | 0.001 | F | 45 |
| LAB578 | 0.72 | 0.019 | C | 18 | LAB582 | 0.87 | 0.001 | B | 54 |
| LAB578 | −0.72 | 0.019 | B | 1 | LAB582 | −0.84 | 0.002 | C | 39 |
| LAB578 | −0.71 | 0.020 | B | 29 | LAB582 | −0.83 | 0.003 | F | 39 |
| LAB578 | 0.71 | 0.021 | C | 50 | LAB582 | 0.83 | 0.003 | F | 2 |
| LAB581 | 0.79 | 0.007 | D | 16 | LAB582 | 0.82 | 0.004 | F | 4 |
| LAB581 | 0.75 | 0.013 | F | 13 | LAB582 | −0.79 | 0.007 | B | 44 |
| LAB581 | 0.71 | 0.020 | B | 44 | LAB582 | −0.79 | 0.007 | F | 47 |
| LAB581 | 0.71 | 0.021 | D | 22 | LAB582 | −0.76 | 0.010 | D | 22 |
| LAB581 | 0.71 | 0.022 | D | 5 | LAB582 | −0.76 | 0.010 | D | 5 |
| LAB582 | 0.92 | 4.78E−04 | C | 2 | LAB582 | −0.74 | 0.014 | D | 16 |
| LAB582 | −0.74 | 0.015 | F | 41 | LAB584 | 0.71 | 0.021 | B | 54 |
| LAB582 | 0.73 | 0.017 | F | 15 | LAB584 | −0.71 | 0.022 | B | 29 |
| LAB582 | 0.72 | 0.018 | B | 49 | LAB584 | −0.70 | 0.023 | D | 16 |
| LAB582 | 0.72 | 0.019 | D | 37 | LAB584 | 0.70 | 0.023 | B | 42 |
| LAB582 | −0.71 | 0.021 | F | 43 | LAB585 | 0.84 | 0.002 | C | 51 |
| LAB584 | 0.83 | 0.003 | F | 55 | LAB585 | −0.75 | 0.012 | G | 37 |
| LAB584 | −0.81 | 0.005 | B | 48 | LAB585 | 0.73 | 0.017 | B | 38 |
| LAB584 | −0.79 | 0.007 | B | 1 | LAB585 | 0.73 | 0.017 | E | 9 |
| LAB584 | −0.78 | 0.007 | F | 43 | LAB585 | 0.72 | 0.018 | B | 12 |
| LAB584 | −0.78 | 0.007 | B | 44 | LAB585 | 0.72 | 0.019 | G | 16 |
| LAB584 | −0.77 | 0.009 | F | 47 | LAB585 | 0.70 | 0.024 | B | 48 |
| LAB584 | −0.76 | 0.010 | F | 41 | LAB586 | 0.95 | 03.48E−05 | E | 6 |
| LAB584 | 0.75 | 0.013 | F | 10 | LAB586 | 0.93 | 8.84E−05 | E | 23 |
| LAB584 | 0.74 | 0.014 | E | 9 | LAB588 | 0.80 | 0.005 | B | 12 |
| LAB584 | −0.72 | 0.020 | E | 23 | LAB588 | −0.74 | 0.015 | E | 1 |
| LAB586 | 0.85 | 0.002 | D | 16 | LAB589 | −0.87 | 0.001 | A | 5 |
| LAB586 | 0.83 | 0.003 | E | 20 | LAB589 | −0.86 | 0.001 | A | 22 |
| LAB586 | −0.82 | 0.003 | E | 9 | LAB589 | −0.85 | 0.002 | B | 48 |
| LAB586 | −0.81 | 0.005 | B | 38 | LAB589 | −0.81 | 0.005 | A | 16 |
| LAB586 | 0.74 | 0.015 | F | 21 | LAB589 | −0.79 | 0.007 | B | 12 |
| LAB586 | 0.71 | 0.020 | A | 16 | LAB589 | −0.75 | 0.012 | B | 1 |
| LAB586 | −0.71 | 0.022 | B | 12 | LAB589 | −0.72 | 0.018 | D | 16 |
| LAB586 | 0.70 | 0.024 | E | 42 | LAB589 | −0.71 | 0.021 | B | 29 |
| LAB587 | 0.88 | 0.001 | B | 44 | LAB589 | 0.71 | 0.022 | A | 37 |
| LAB587 | −0.79 | 0.007 | B | 54 | LAB589 | −0.70 | 0.023 | B | 49 |
| LAB587 | 0.79 | 0.007 | B | 48 | LAB590 | 0.86 | 0.001 | F | 55 |
| LAB587 | −0.76 | 0.011 | A | 19 | LAB590 | 0.76 | 0.011 | F | 10 |
| LAB587 | 0.73 | 0.017 | B | 1 | LAB590 | −0.76 | 0.011 | F | 41 |
| LAB587 | 0.71 | 0.021 | B | 12 | LAB590 | 0.71 | 0.022 | D | 22 |
| LAB588 | 0.85 | 0.002 | B | 49 | LAB592 | 0.71 | 0.023 | D | 5 |
| LAB590 | 0.75 | 0.012 | E | 9 | LAB593 | 0.95 | 3.10E−05 | B | 38 |
| LAB590 | −0.71 | 0.022 | F | 47 | LAB593 | 0.77 | 0.009 | B | 12 |
| LAB590 | 0.71 | 0.022 | C | 13 | LAB593 | 0.70 | 0.035 | C | 4 |
| LAB591 | 0.84 | 0.003 | A | 5 | LAB594 | 0.89 | 0.001 | D | 5 |

TABLE 23-continued

Correlation between the expression level of selected LAB genes of some embodiments of the invention in various tissues and the phenotypic performance under low nitrogen, normal or drought stress conditions across *Sorghum* accessions

| Gene Name | R | P value | Corr. ID | Exp. set ID | Gene Name | R | P value | Corr. ID | Exp set ID |
|---|---|---|---|---|---|---|---|---|---|
| LAB591 | 0.82 | 0.004 | A | 22 | LAB594 | 0.89 | 0.001 | D | 22 |
| LAB591 | −0.77 | 0.009 | A | 37 | LAB594 | 0.83 | 0.003 | D | 16 |
| LAB591 | 0.76 | 0.010 | D | 16 | LAB594 | 0.83 | 0.003 | F | 24 |
| LAB591 | 0.76 | 0.011 | F | 13 | LAB594 | 0.81 | 0.005 | F | 18 |
| LAB591 | 0.76 | 0.011 | C | 13 | LAB594 | 0.78 | 0.008 | B | 54 |
| LAB591 | 0.76 | 0.011 | A | 16 | LAB594 | −0.77 | 0.009 | B | 44 |
| LAB591 | 0.75 | 0.013 | D | 22 | LAB594 | −0.75 | 0.012 | D | 19 |
| LAB591 | 0.74 | 0.014 | D | 5 | LAB594 | −0.73 | 0.017 | B | 40 |
| LAB592 | 0.80 | 0.006 | D | 16 | LAB594 | −0.73 | 0.018 | B | 29 |
| LAB592 | 0.76 | 0.011 | F | 13 | LAB597 | 0.79 | 0.007 | B | 1 |
| LAB592 | 0.71 | 0.020 | B | 38 | LAB597 | 0.77 | 0.009 | B | 48 |
| LAB594 | 0.72 | 0.018 | F | 21 | LAB597 | 0.77 | 0.009 | E | 9 |
| LAB594 | 0.72 | 0.019 | F | 13 | LAB597 | 0.76 | 0.011 | C | 13 |
| LAB594 | −0.71 | 0.021 | C | 30 | LAB597 | 0.75 | 0.013 | B | 44 |
| LAB595 | 0.89 | 0.001 | C | 51 | LAB597 | 0.74 | 0.014 | C | 30 |
| LAB595 | 0.85 | 0.002 | C | 13 | LAB597 | −0.73 | 0.026 | A | 52 |
| LAB595 | −0.81 | 0.009 | A | 52 | LAB597 | 0.73 | 0.026 | A | 28 |
| LAB595 | 0.80 | 0.005 | A | 11 | LAB597 | 0.72 | 0.019 | B | 42 |
| LAB595 | −0.78 | 0.008 | F | 47 | LAB597 | −0.72 | 0.019 | E | 40 |
| LAB595 | 0.77 | 0.009 | B | 12 | LAB597 | 0.71 | 0.021 | C | 50 |
| LAB595 | 0.76 | 0.010 | B | 44 | LAB597 | 0.71 | 0.022 | B | 29 |
| LAB595 | −0.73 | 0.017 | F | 41 | LAB608 | 0.84 | 0.002 | B | 1 |
| LAB596 | 0.79 | 0.006 | B | 12 | LAB608 | 0.81 | 0.004 | C | 13 |
| LAB596 | 0.76 | 0.011 | B | 48 | LAB608 | 0.81 | 0.005 | B | 48 |
| LAB596 | 0.74 | 0.015 | E | 54 | LAB611 | 0.86 | 0.003 | C | 2 |
| LAB597 | 0.85 | 0.002 | C | 51 | LAB611 | −0.85 | 0.004 | C | 7 |
| LAB608 | 0.81 | 0.005 | B | 12 | LAB611 | 0.84 | 0.002 | C | 15 |
| LAB608 | 0.80 | 0.005 | B | 44 | LAB611 | −0.83 | 0.003 | C | 47 |
| LAB608 | 0.75 | 0.012 | B | 42 | LAB611 | 0.81 | 0.008 | C | 4 |
| LAB608 | 0.74 | 0.014 | C | 51 | LAB611 | 0.79 | 0.006 | C | 24 |
| LAB608 | 0.72 | 0.019 | B | 29 | LAB611 | 0.79 | 0.007 | E | 12 |
| LAB608 | −0.71 | 0.022 | G | 19 | LAB611 | −0.77 | 0.009 | C | 41 |
| LAB610 | −0.90 | 3.39E−04 | B | 38 | LAB611 | 0.77 | 0.010 | C | 18 |
| LAB610 | −0.76 | 0.018 | G | 34 | LAB611 | −0.74 | 0.014 | F | 24 |
| LAB610 | 0.73 | 0.016 | C | 45 | LAB611 | −0.73 | 0.017 | C | 43 |
| LAB610 | −0.71 | 0.030 | C | 2 | LAB611 | 0.72 | 0.019 | D | 16 |
| LAB610 | −0.70 | 0.034 | C | 4 | | | | | |

Table 23: "Corr. ID"—correlation set ID according to the correlated parameters Table above.
"Exp. Set ID"—expression set ID according to the expression sets shown in Table 16 above.
"R" = Pearson correlation coefficient;
"P" = p value.

Example 4

Production of Sorghum Transcriptom and High Throughput Correlation Analysis with Biomass, NUE, and ABST Related Parameters Measured in Semi-Hydroponics Conditions Using 44K Sorghum Oligonucleotide Micro-Arrays Sorghum vigor related parameters under 100 mM NaCl, low temperature (10±2° C.), low nitrogen conditions and normal growth conditions—Ten Sorghum hybrids were grown in 3 repetitive plots, each containing 17 plants, at a net house under semi-hydroponics conditions. Briefly, the growing protocol was as follows: *Sorghum* to seeds were sown in trays filled with a mix of vermiculite and peat in a 1:1 ratio. Following germination, the trays were transferred to Normal growth conditions (Full Hoagland containing 16 mM Nitrogen solution, at 28±2° C.), high salinity conditions (100 mM NaCl in addition to the Full Hoagland solution), low temperature conditions (10±2° C. in the presence of Full Hoagland solution), or low nitrogen conditions (the amount of total nitrogen was reduced in 90% from the full Hoagland solution (i.e., to a final concentration of 10% from full Hoagland solution, final amount of 1.2 mM Nitrogen). All plants were grown at 28±2° C. except where otherwise indicated (i.e., in the low temperature conditions).

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed Sorghum tissues—All 10 selected Sorghum hybrids were sampled per each treatment. Three tissues [leaves, meristems and roots] growing at 100 mM NaCl, low temperature (10±2° C.), low Nitrogen (1.2 mM Nitrogen) or under Normal conditions were sampled and RNA was extracted as described above. Each micro-array expression information tissue type has received a Set ID as summarized in Table 24 below.

TABLE 24

*Sorghum* transcriptom expression sets under semi hydroponics conditions

| Expression set | Set Id |
|---|---|
| *Sorghum* roots under Low Nitrogen | A |
| *Sorghum* leaves under Low Nitrogen | B |
| *Sorghum* meristems under Low Nitrogen | C |
| *Sorghum* roots under Normal Growth | D |

TABLE 24-continued

*Sorghum* transcriptom expression sets under semi hydroponics conditions

| Expression set | Set Id |
|---|---|
| *Sorghum* leaves under Normal Growth | E |
| *Sorghum* meristems under Normal Growth | F |
| *Sorghum* roots under 100 mM NaCl | G |
| *Sorghum* leaves under 100 mM NaCl | H |
| *Sorghum* meristems under 100 mM NaCl | I |
| *Sorghum* roots under cold | J |
| *Sorghum* leaves under cold | K |
| *Sorghum* meristems under cold | L |

Table 24:
Provided are the Sorghum transcriptom expression sets.
Cold conditions = 10 ± 2° C.;
NaCl = 100 mM NaCl;
low nitrogen = 1.2 mM Nitrogen;
Normal conditions = 16 mM Nitrogen.

Experimental Results 10 different Sorghum hybrids were grown and characterized for various biomass and nitrogen use efficiency (NUE) parameters as described in Table 25, below. The average for each of the measured parameter was calculated using the JMP software and values are summarized in Table 26-29 below. Subsequent correlation analysis was performed (Table 30). Results were then integrated to the database.

TABLE 25

*Sorghum* correlated parameters (vectors)

| Correlation set | Correlation ID |
|---|---|
| DW Root/Plant - 100 mM NaCl | 1 |
| DW Root/Plant - Cold | 2 |
| DW Root/Plant - Low Nitrogen | 3 |
| DW Root/Plant - Normal | 4 |
| DW Shoot/Plant - 100 mM NaCl | 5 |
| DW Shoot/Plant - Cold | 6 |
| DW Shoot/Plant - Low Nitrogen | 7 |
| DW Shoot/Plant - Normal | 8 |
| Leaf Number TP1 - 100 mM NaCl | 9 |
| Leaf Number TP1 - Cold | 10 |
| Leaf Number TP1 - Low Nitrogen | 11 |
| Leaf Number TP1 - Normal | 12 |
| Leaf Number TP2 - 100 mM NaCl | 13 |
| Leaf Number TP2 - Cold | 14 |
| Leaf Number TP2 - Low Nitrogen | 15 |
| Leaf Number TP2 - Normal | 16 |
| Leaf Number TP3 - 100 mM NaCl | 17 |
| Leaf Number TP3 - Cold | 18 |
| Leaf Number TP3 - Low Nitrogen | 19 |
| Leaf Number TP3 - Normal | 20 |
| Shoot/Root - Normal | 21 |
| NUE per roots - Normal | 22 |
| NUE per shoots - Normal | 23 |
| NUE per total biomass - Normal | 24 |
| NUE per roots biomass - Low N | 25 |
| NUE per shoots biomass - Low N | 26 |
| NUE per total biomass - Low N | 27 |
| Percent of reduction of root biomass compared to normal - Low N | 28 |
| Percent of reduction of shoot biomass compared to normal - Low N | 29 |
| Percent of reduction of total biomass compared to normal - Low N | 30 |
| Plant Height TP1 - 100 mM NaCl | 31 |
| Plant Height TP1 - Cold | 32 |
| Plant Height TP1 - Low N | 33 |
| Plant Height TP1 - Normal | 34 |
| Plant Height TP2 - 100 mM NaCl | 35 |
| Plant Height TP2 - Cold | 36 |
| Plant Height TP2 - Low N | 37 |
| Plant Height TP2 - Normal | 38 |
| Plant Height TP3 - 100 mM NaCl | 39 |
| Plant Height TP3 - Low N | 40 |
| RGR Leaf Num Normal | 41 |
| Root Biomass DW [gr.]/SPAD - 100 mM NaCl | 42 |
| Root Biomass DW [gr.]/SPAD - Cold | 43 |
| Root Biomass DW [gr.]/SPAD - Low N | 44 |
| Root Biomass DW [gr.]/SPAD - Normal | 45 |
| Shoot Biomass DW [gr.]/SPAD - 100 mM NaCl | 46 |
| Shoot Biomass DW [gr.]/SPAD - Cold | 47 |
| Shoot Biomass DW [gr.]/SPAD - Low N | 48 |
| Shoot Biomass DW [gr.]/SPAD - Normal | 49 |
| Shoot/Root - Low N | 50 |
| SPAD - 100 mM NaCl | 51 |
| SPAD - Cold | 52 |
| SPAD - Low Nitrogen | 53 |
| SPAD - Normal | 54 |
| SPAD 100 - mM NaCl | 55 |
| Total Biomass DW [gr.]/SPAD - 100 mM NaCl | 56 |
| Total Biomass DW [gr.]/SPAD - Cold | 57 |
| Total Biomass DW [gr.]/SPAD - Low N | 58 |
| Total Biomass DW [gr.]/SPAD - Normal | 59 |

Table 25:
Provided are the Sorghum correlated parameters.
"N" = nitrogen;
Cold conditions = 10 ± 2° C.;
NaCl = 100 mM NaCl;
Low nitrogen = 1.2 mM Nitrogen;
Normal conditions = 16 mM Nitrogen;
"TP" = time point.
Thus, TP-1-2-3 refers to time points 1, 2 and 3, respectively.

TABLE 26

*Sorghum* accessions, measured parameters under low nitrogen growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 3 | 0.04 | 0.11 | 0.20 | 0.10 | 0.08 | 0.09 | 0.13 | 0.09 | 0.09 | 0.09 |
| 7 | 0.08 | 0.19 | 0.33 | 0.16 | 0.16 | 0.16 | 0.26 | 0.20 | 0.13 | 0.18 |
| 11 | 3.0 | 3.1 | 3.9 | 3.5 | 3.2 | 3.1 | 3.1 | 3.3 | 3.1 | 3.1 |
| 15 | 4.0 | 4.6 | 5.0 | 4.7 | 4.6 | 4.7 | 5.0 | 4.9 | 4.7 | 4.6 |
| 19 | 3.9 | 4.3 | 4.7 | 4.2 | 4.3 | 4.6 | 4.6 | 4.7 | 4.0 | 4.1 |
| 27 | 27.5 | 64.1 | 115.0 | 58.0 | 52.2 | 35.1 | 84.6 | 63.7 | 47.0 | 60.0 |
| 50 | 1.9 | 1.7 | 1.7 | 1.6 | 2.1 | 1.8 | 2.1 | 2.1 | 1.5 | 2.0 |
| 25 | 9.7 | 23.5 | 43.9 | 22.6 | 16.9 | 12.4 | 28.2 | 20.5 | 18.8 | 20.1 |
| 26 | 17.9 | 40.6 | 71.4 | 35.4 | 35.3 | 22.7 | 56.4 | 43.2 | 28.3 | 39.9 |
| 28 | 84.5 | 81.0 | 117.0 | 101.0 | 72.5 | 71.8 | 93.5 | 76.1 | 86.8 | 80.5 |
| 29 | 81.6 | 79.2 | 105.0 | 103.0 | 83.7 | 83.2 | 108.0 | 81.4 | 70.3 | 75.9 |

TABLE 26-continued

Sorghum accessions, measured parameters under low nitrogen growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 30 | 82.6 | 79.8 | 109.0 | 102.0 | 79.7 | 78.8 | 102.0 | 79.6 | 76.1 | 77.4 |
| 53 | 6.89 | 6.57 | 6.31 | 7.45 | 6.89 | 5.87 | 6.15 | 6.05 | 7.68 | 6.74 |
| 33 | 6.73 | 9.77 | 12.70 | 8.67 | 9.77 | 9.23 | 10.30 | 10.10 | 7.93 | 8.23 |
| 37 | 13.3 | 20.6 | 23.7 | 18.0 | 19.3 | 19.2 | 21.9 | 22.1 | 18.2 | 21.0 |
| 40 | 22.2 | 31.1 | 34.7 | 30.0 | 30.8 | 29.9 | 30.9 | 32.4 | 29.4 | 30.7 |
| 44 | 0.002 | 0.004 | 0.007 | 0.003 | 0.003 | 0.003 | 0.005 | 0.003 | 0.003 | 0.003 |
| 48 | 0.003 | 0.007 | 0.011 | 0.005 | 0.005 | 0.006 | 0.009 | 0.007 | 0.004 | 0.007 |
| 53 | 26.9 | 28.0 | 29.6 | 31.5 | 29.6 | 26.8 | 28.5 | 28.2 | 30.5 | 27.6 |
| 58 | 0.005 | 0.011 | 0.018 | 0.008 | 0.008 | 0.009 | 0.014 | 0.010 | 0.007 | 0.010 |

Table 26: Provided are the values of each of the parameters (as described above) measured in Sorghum accessions (Seed ID) under low nitrogen conditions.
Growth conditions are specified in the experimental procedure section.

TABLE 27

Sorghum accessions, measured parameters under 100 mM NaCl growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 1 | 0.05 | 0.10 | 0.12 | 0.07 | 0.08 | 0.08 | 0.14 | 0.10 | 0.17 | 0.14 |
| 5 | 0.09 | 0.19 | 0.20 | 0.14 | 0.13 | 0.13 | 0.15 | 0.19 | 0.10 | 0.12 |
| 9 | 3.0 | 3.1 | 3.4 | 3.1 | 3.3 | 3.1 | 3.1 | 3.3 | 3.0 | 3.1 |
| 13 | 4.0 | 4.4 | 4.9 | 4.6 | 4.5 | 4.5 | 4.5 | 4.8 | 4.3 | 4.2 |
| 17 | 4.0 | 4.1 | 4.6 | 4.4 | 4.1 | 4.3 | 4.1 | 4.5 | 3.8 | 4.2 |
| 51 | 8.2 | 8.5 | 6.1 | 7.0 | 8.5 | 6.9 | 7.8 | 7.1 | 8.6 | 8.2 |
| 31 | 7.9 | 9.5 | 10.9 | 7.9 | 9.7 | 8.5 | 8.9 | 10.4 | 7.0 | 7.8 |
| 35 | 14.2 | 16.3 | 20.4 | 13.3 | 15.9 | 16.5 | 15.5 | 18.9 | 13.7 | 15.8 |
| 39 | 21.8 | 23.2 | 30.4 | 22.8 | 23.7 | 23.3 | 22.5 | 26.8 | 20.3 | 23.6 |
| 42 | 0.002 | 0.003 | 0.004 | 0.002 | 0.002 | 0.003 | 0.004 | 0.003 | 0.005 | 0.004 |
| 46 | 0.003 | 0.005 | 0.007 | 0.004 | 0.004 | 0.004 | 0.005 | 0.006 | 0.003 | 0.004 |
| 55 | 32.7 | 35.1 | 28.0 | 30.9 | 34.5 | 30.0 | 32.1 | 31.9 | 32.5 | 34.3 |
| 56 | 0.004 | 0.008 | 0.012 | 0.007 | 0.006 | 0.007 | 0.009 | 0.009 | 0.008 | 0.008 |

Table 27: Provided are the values of each of the parameters (as described above) measured in Sorghum accessions (Seed ID) under 100 mM NaCl growth conditions.
Growth conditions are specified in the experimental procedure section.

TABLE 28

Sorghum accessions, measured parameters under cold growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 2 | 0.068 | 0.108 | 0.163 | 0.094 | 0.084 | 0.114 | 0.137 | 0.127 | 0.108 | 0.139 |
| 6 | 0.078 | 0.154 | 0.189 | 0.112 | 0.130 | 0.165 | 0.152 | 0.150 | 0.112 | 0.141 |
| 10 | 3.0 | 3.0 | 3.5 | 3.2 | 3.4 | 3.2 | 3.1 | 3.1 | 3.1 | 3.0 |
| 14 | 3.9 | 4.1 | 4.6 | 4.2 | 4.3 | 4.2 | 4.2 | 4.3 | 4.2 | 4.0 |
| 18 | 4.7 | 5.3 | 5.4 | 5.5 | 5.3 | 5.1 | 4.5 | 5.4 | 5.4 | 5.2 |
| 52 | 6.1 | 5.7 | 5.0 | 5.9 | 5.3 | 5.9 | 7.2 | 5.3 | 5.9 | 5.7 |
| 32 | 6.5 | 8.8 | 10.4 | 6.8 | 9.0 | 9.0 | 8.0 | 9.2 | 6.5 | 7.2 |
| 36 | 11.2 | 15.9 | 18.4 | 12.2 | 16.0 | 14.6 | 14.6 | 17.3 | 13.4 | 13.9 |
| 43 | 0.002 | 0.004 | 0.006 | 0.003 | 0.003 | 0.004 | 0.004 | 0.004 | 0.003 | 0.005 |
| 47 | 0.003 | 0.005 | 0.007 | 0.003 | 0.005 | 0.006 | 0.005 | 0.005 | 0.004 | 0.005 |
| 52 | 28.6 | 30.3 | 27.0 | 32.3 | 28.3 | 29.9 | 32.5 | 28.6 | 31.7 | 29.6 |
| 57 | 0.005 | 0.009 | 0.013 | 0.006 | 0.008 | 0.009 | 0.009 | 0.010 | 0.007 | 0.009 |

Table 28: Provided are the values of each of the parameters (as described above) measured in Sorghum accessions (Seed ID) under cold growth conditions.
Growth conditions are specified in the experimental procedure section.

TABLE 29

Sorghum accessions, measured parameters under regular growth conditions

| Corr. ID | Seed ID | | | | | | | | | |
|---|---|---|---|---|---|---|---|---|---|---|
| | 20 | 22 | 26 | 27 | 28 | 29 | 30 | 31 | 34 | 37 |
| 4 | 0.05 | 0.13 | 0.17 | 0.10 | 0.11 | 0.12 | 0.14 | 0.12 | 0.10 | 0.12 |
| 8 | 0.10 | 0.24 | 0.31 | 0.16 | 0.19 | 0.19 | 0.24 | 0.24 | 0.19 | 0.24 |
| 12 | 3.0 | 3.1 | 3.8 | 3.2 | 3.2 | 3.2 | 3.1 | 3.4 | 3.0 | 3.0 |
| 16 | 4.2 | 4.5 | 4.8 | 4.6 | 4.5 | 5.0 | 4.6 | 4.9 | 4.5 | 4.6 |
| 20 | 5.3 | 5.9 | 6.2 | 5.8 | 5.8 | 5.7 | 5.7 | 6.0 | 5.6 | 6.1 |
| 54 | 5.0 | 5.0 | 4.8 | 5.0 | 4.3 | 4.3 | 5.4 | 4.3 | 5.9 | 5.5 |
| 21 | 2.0 | 1.9 | 1.9 | 1.6 | 1.8 | 1.6 | 1.8 | 2.0 | 1.9 | 2.2 |
| 22 | 0.9 | 2.2 | 2.8 | 1.7 | 1.8 | 2.0 | 2.3 | 2.0 | 1.1 | 1.9 |
| 23 | 1.7 | 3.9 | 5.1 | 2.6 | 3.2 | 3.1 | 4.0 | 4.0 | 2.0 | 4.0 |
| 24 | 2.5 | 6.1 | 8.0 | 4.3 | 4.9 | 5.0 | 6.2 | 6.0 | 3.1 | 5.9 |
| 34 | 7.5 | 9.3 | 12.9 | 8.6 | 8.9 | 8.5 | 10.7 | 10.3 | 7.9 | 8.8 |
| 38 | 15.0 | 18.2 | 22.1 | 17.6 | 18.1 | 18.5 | 22.8 | 22.0 | 20.0 | 21.8 |
| 41 | 0.16 | 0.19 | 0.16 | 0.17 | 0.17 | 0.17 | 0.17 | 0.17 | 0.17 | 0.20 |
| 45 | 0.002 | 0.005 | 0.006 | 0.004 | 0.004 | 0.005 | 0.005 | 0.005 | 0.003 | 0.003 |
| 49 | 0.004 | 0.008 | 0.011 | 0.005 | 0.008 | 0.008 | 0.008 | 0.010 | 0.006 | 0.007 |
| 54 | 26.7 | 29.3 | 29.9 | 29.1 | 25.0 | 24.6 | 30.8 | 25.5 | 32.9 | 33.5 |
| 59 | 0.006 | 0.013 | 0.016 | 0.009 | 0.012 | 0.013 | 0.012 | 0.014 | 0.009 | 0.011 |

Table 29: Provided are the values of each of the parameters (as described above) measured in Sorghum accessions (Seed ID) under regular growth conditions.
Growth conditions are specified in the experimental procedure section.

TABLE 30

Correlation between the expression level of selected LAB genes of some embodiments of the invention in various tissues and the phenotypic performance under low nitrogen, normal, cold or salinity stress conditions across Sorghum accessions

| Gene name | R | P | Exp. set | Corr. ID | Gene name | R | P | Exp. set | Corr. ID |
|---|---|---|---|---|---|---|---|---|---|
| LAB394 | −0.81 | 0.027 | A | 50 | LAB539 | −0.86 | 0.003 | L | 52 |
| LAB394 | −0.77 | 0.016 | L | 2 | LAB539 | 0.82 | 0.007 | L | 36 |
| LAB394 | −0.71 | 0.033 | I | 56 | LAB539 | 0.79 | 0.033 | A | 53 |
| LAB537 | −0.94 | 2.09E−04 | L | 14 | LAB539 | 0.78 | 0.013 | L | 32 |
| LAB537 | −0.76 | 0.017 | L | 36 | LAB539 | 0.76 | 0.017 | L | 47 |
| LAB537 | −0.75 | 0.021 | L | 32 | LAB539 | 0.74 | 0.021 | L | 14 |
| LAB537 | −0.73 | 0.025 | I | 51 | LAB539 | 0.72 | 0.028 | I | 42 |
| LAB537 | −0.73 | 0.025 | L | 47 | LAB539 | 0.71 | 0.031 | C | 30 |
| LAB538 | 0.76 | 0.017 | D | 41 | LAB539 | 0.71 | 0.031 | L | 57 |
| LAB538 | −0.72 | 0.029 | L | 10 | LAB539 | 0.71 | 0.032 | C | 29 |
| LAB540 | −0.89 | 0.041 | G | 55 | LAB544 | 0.89 | 0.046 | G | 39 |
| LAB541 | −0.75 | 0.020 | L | 36 | LAB544 | 0.88 | 0.002 | L | 36 |
| LAB541 | 0.75 | 0.012 | J | 2 | LAB544 | 0.87 | 0.003 | L | 6 |
| LAB541 | 0.75 | 0.012 | J | 43 | LAB544 | 0.86 | 0.003 | L | 32 |
| LAB541 | −0.75 | 0.021 | L | 6 | LAB544 | 0.84 | 0.005 | L | 47 |
| LAB541 | −0.75 | 0.021 | L | 14 | LAB544 | 0.81 | 0.008 | L | 57 |
| LAB541 | −0.74 | 0.021 | C | 15 | LAB544 | 0.75 | 0.019 | L | 43 |
| LAB541 | 0.71 | 0.034 | I | 39 | LAB544 | 0.75 | 0.021 | L | 2 |
| LAB541 | 0.70 | 0.036 | F | 34 | LAB544 | 0.74 | 0.024 | L | 10 |
| LAB542 | −0.88 | 0.048 | G | 1 | LAB544 | 0.71 | 0.034 | C | 7 |
| LAB542 | 0.80 | 0.030 | A | 19 | LAB544 | 0.70 | 0.035 | C | 48 |
| LAB543 | −0.89 | 0.044 | G | 55 | LAB544 | 0.70 | 0.035 | D | 38 |
| LAB543 | 0.77 | 0.015 | L | 32 | LAB545 | 0.75 | 0.013 | J | 43 |
| LAB543 | 0.74 | 0.022 | L | 14 | LAB545 | 0.72 | 0.018 | J | 2 |
| LAB543 | 0.70 | 0.034 | L | 47 | LAB546 | −0.88 | 0.002 | L | 36 |
| LAB544 | 0.71 | 0.034 | C | 26 | LAB546 | −0.88 | 0.002 | L | 47 |
| LAB544 | −0.93 | 0.022 | G | 55 | LAB546 | −0.87 | 0.002 | L | 57 |
| LAB544 | 0.91 | 0.001 | L | 14 | LAB546 | −0.84 | 0.005 | L | 2 |
| LAB544 | 0.91 | 0.034 | G | 13 | LAB546 | −0.84 | 0.019 | A | 50 |
| LAB546 | −0.82 | 0.004 | J | 18 | LAB549 | −0.82 | 0.025 | A | 40 |
| LAB546 | −0.82 | 0.007 | L | 43 | LAB549 | −0.76 | 0.017 | L | 36 |
| LAB546 | −0.77 | 0.015 | L | 32 | LAB549 | −0.74 | 0.023 | L | 32 |
| LAB546 | −0.76 | 0.019 | I | 56 | LAB550 | −0.87 | 0.011 | A | 50 |
| LAB546 | −0.72 | 0.028 | L | 14 | LAB550 | −0.78 | 0.014 | C | 30 |
| LAB546 | −0.70 | 0.034 | I | 42 | LAB550 | −0.77 | 0.014 | C | 11 |
| LAB548 | 0.94 | 0.017 | G | 35 | LAB550 | −0.77 | 0.015 | L | 6 |
| LAB548 | 0.91 | 0.031 | G | 31 | LAB550 | −0.74 | 0.024 | C | 29 |
| LAB548 | 0.90 | 0.040 | G | 56 | LAB550 | −0.72 | 0.027 | L | 14 |
| LAB548 | 0.89 | 0.045 | G | 42 | LAB550 | −0.71 | 0.031 | C | 53 |
| LAB548 | 0.78 | 0.013 | L | 36 | LAB550 | −0.71 | 0.031 | L | 2 |
| LAB548 | 0.74 | 0.022 | C | 33 | LAB550 | −0.71 | 0.032 | C | 28 |
| LAB548 | 0.73 | 0.025 | L | 32 | LAB550 | −0.71 | 0.022 | J | 6 |

TABLE 30-continued

Correlation between the expression level of selected LAB genes of some embodiments of the invention in various tissues and the phenotypic performance under low nitrogen, normal, cold or salinity stress conditions across *Sorghum* accessions

| Gene name | R | P | Exp. set | Corr. ID | Gene name | R | P | Exp. set | Corr. ID |
|---|---|---|---|---|---|---|---|---|---|
| LAB548 | 0.72 | 0.028 | L | 47 | LAB551 | 0.91 | 0.005 | A | 28 |
| LAB548 | 0.71 | 0.031 | C | 29 | LAB551 | −0.84 | 0.004 | F | 21 |
| LAB548 | 0.71 | 0.033 | I | 5 | LAB551 | 0.79 | 0.036 | A | 30 |
| LAB549 | −0.86 | 0.014 | A | 26 | LAB551 | −0.73 | 0.026 | C | 37 |
| LAB549 | −0.77 | 0.042 | A | 25 | LAB551 | −0.70 | 0.035 | I | 1 |
| LAB549 | −0.84 | 0.017 | A | 27 | LAB549 | −0.82 | 0.024 | A | 37 |
| LAB552 | −0.90 | 0.006 | A | 37 | LAB557 | −0.75 | 0.020 | I | 55 |
| LAB552 | −0.86 | 0.013 | A | 3 | LAB584 | −0.81 | 0.009 | C | 28 |
| LAB552 | −0.85 | 0.014 | A | 7 | LAB558 | −0.93 | 0.003 | A | 37 |
| LAB552 | −0.83 | 0.022 | A | 44 | LAB558 | −0.88 | 0.010 | A | 15 |
| LAB552 | −0.81 | 0.028 | A | 58 | LAB558 | 0.85 | 0.016 | A | 29 |
| LAB552 | −0.76 | 0.046 | A | 48 | LAB558 | 0.83 | 0.021 | A | 30 |
| LAB552 | −0.76 | 0.048 | A | 33 | LAB558 | −0.81 | 0.026 | A | 7 |
| LAB552 | −0.75 | 0.019 | L | 6 | LAB558 | −0.78 | 0.037 | A | 58 |
| LAB552 | −0.70 | 0.034 | L | 36 | LAB558 | −0.78 | 0.040 | A | 3 |
| LAB554 | 0.76 | 0.049 | A | 53 | LAB558 | −0.77 | 0.041 | A | 44 |
| LAB554 | 0.70 | 0.034 | I | 56 | LAB558 | −0.76 | 0.050 | A | 48 |
| LAB555 | −0.85 | 0.016 | A | 7 | LAB559 | −0.81 | 0.008 | F | 16 |
| LAB555 | −0.83 | 0.021 | A | 48 | LAB559 | −0.70 | 0.035 | L | 6 |
| LAB555 | −0.79 | 0.034 | A | 33 | LAB559 | −0.70 | 0.035 | C | 53 |
| LAB555 | −0.77 | 0.041 | A | 58 | LAB561 | 0.74 | 0.022 | D | 34 |
| LAB555 | 0.73 | 0.026 | L | 32 | LAB562 | −0.82 | 0.024 | A | 50 |
| LAB555 | 0.70 | 0.034 | L | 14 | LAB562 | −0.81 | 0.008 | L | 36 |
| LAB557 | 0.83 | 0.021 | A | 19 | LAB562 | −0.79 | 0.011 | L | 6 |
| LAB557 | 0.80 | 0.009 | L | 52 | LAB562 | −0.77 | 0.016 | L | 14 |
| LAB557 | −0.77 | 0.044 | A | 50 | LAB562 | −0.74 | 0.024 | L | 32 |
| LAB562 | −0.72 | 0.030 | L | 47 | LAB564 | 0.73 | 0.027 | F | 4 |
| LAB563 | 0.85 | 0.016 | A | 33 | LAB564 | 0.72 | 0.028 | I | 46 |
| LAB563 | 0.77 | 0.014 | D | 54 | LAB564 | 0.72 | 0.030 | F | 45 |
| LAB564 | 0.73 | 0.024 | D | 24 | LAB565 | −0.90 | 0.001 | L | 10 |
| LAB564 | 0.73 | 0.024 | D | 22 | LAB565 | −0.90 | 0.038 | G | 35 |
| LAB564 | 0.72 | 0.028 | D | 23 | LAB565 | −0.88 | 0.002 | L | 14 |
| LAB564 | 0.96 | 0.009 | G | 56 | LAB565 | −0.86 | 0.003 | L | 32 |
| LAB564 | 0.95 | 0.012 | G | 13 | LAB565 | 0.84 | 0.004 | D | 41 |
| LAB564 | 0.92 | 0.025 | G | 42 | LAB565 | −0.83 | 0.005 | L | 47 |
| LAB564 | 0.92 | 0.026 | G | 46 | LAB565 | −0.83 | 0.006 | L | 36 |
| LAB564 | 0.92 | 0.028 | G | 39 | LAB565 | −0.77 | 0.016 | L | 6 |
| LAB564 | 0.92 | 0.028 | G | 9 | LAB565 | −0.76 | 0.018 | L | 57 |
| LAB564 | 0.90 | 0.036 | G | 17 | LAB566 | 0.78 | 0.013 | L | 52 |
| LAB564 | −0.89 | 0.043 | G | 51 | LAB566 | 0.72 | 0.029 | D | 41 |
| LAB564 | 0.83 | 0.006 | I | 31 | LAB567 | 0.87 | 0.002 | C | 26 |
| LAB564 | 0.83 | 0.006 | I | 35 | LAB567 | 0.79 | 0.012 | C | 25 |
| LAB564 | 0.77 | 0.016 | I | 5 | LAB567 | 0.87 | 0.002 | C | 7 |
| LAB564 | 0.75 | 0.020 | I | 9 | LAB567 | 0.86 | 0.003 | C | 48 |
| LAB564 | 0.74 | 0.022 | I | 13 | LAB567 | 0.85 | 0.004 | C | 27 |
| LAB564 | 0.74 | 0.022 | D | 20 | LAB567 | 0.84 | 0.004 | C | 58 |
| LAB567 | 0.84 | 0.005 | L | 32 | LAB569 | −0.79 | 0.033 | A | 28 |
| LAB567 | 0.83 | 0.006 | L | 36 | LAB570 | 0.83 | 0.003 | J | 52 |
| LAB567 | 0.79 | 0.012 | D | 34 | LAB570 | −0.76 | 0.049 | A | 37 |
| LAB567 | 0.79 | 0.012 | C | 3 | LAB570 | −0.73 | 0.016 | J | 18 |
| LAB567 | 0.79 | 0.012 | C | 44 | LAB571 | 0.92 | 0.028 | G | 5 |
| LAB567 | 0.77 | 0.016 | C | 29 | LAB571 | −0.90 | 0.001 | L | 6 |
| LAB567 | 0.75 | 0.019 | C | 33 | LAB571 | −0.87 | 0.002 | L | 47 |
| LAB567 | 0.75 | 0.020 | C | 19 | LAB571 | −0.82 | 0.006 | L | 32 |
| LAB567 | 0.75 | 0.020 | C | 30 | LAB571 | −0.79 | 0.011 | L | 57 |
| LAB567 | 0.74 | 0.022 | L | 47 | LAB571 | −0.78 | 0.013 | L | 36 |
| LAB567 | 0.74 | 0.023 | C | 15 | LAB571 | −0.76 | 0.048 | A | 28 |
| LAB567 | 0.74 | 0.023 | I | 35 | LAB571 | −0.75 | 0.020 | F | 45 |
| LAB567 | −0.74 | 0.023 | L | 52 | LAB572 | −0.76 | 0.046 | A | 50 |
| LAB567 | 0.74 | 0.024 | C | 37 | LAB573 | 0.92 | 0.003 | A | 30 |
| LAB567 | 0.70 | 0.035 | L | 14 | LAB573 | 0.86 | 0.013 | A | 11 |
| LAB567 | 0.70 | 0.036 | I | 56 | LAB573 | 0.84 | 0.018 | A | 29 |
| LAB568 | −0.75 | 0.020 | I | 1 | LAB573 | 0.78 | 0.037 | A | 28 |
| LAB568 | −0.73 | 0.025 | I | 56 | LAB575 | −0.77 | 0.016 | F | 16 |
| LAB568 | −0.72 | 0.029 | I | 42 | LAB575 | −0.74 | 0.022 | C | 15 |
| LAB568 | −0.71 | 0.033 | C | 15 | LAB575 | −0.72 | 0.027 | F | 4 |
| LAB576 | −0.87 | 0.011 | A | 50 | LAB581 | 0.84 | 0.005 | C | 58 |
| LAB576 | 0.82 | 0.006 | L | 52 | LAB581 | 0.83 | 0.005 | C | 7 |
| LAB577 | 0.80 | 0.031 | A | 15 | LAB581 | 0.83 | 0.005 | C | 3 |
| LAB578 | −0.78 | 0.013 | F | 16 | LAB581 | 0.83 | 0.005 | C | 40 |
| LAB578 | −0.76 | 0.019 | F | 20 | LAB581 | −0.83 | 0.020 | A | 33 |
| LAB578 | −0.71 | 0.032 | L | 32 | LAB581 | 0.82 | 0.006 | C | 37 |
| LAB581 | 0.83 | 0.005 | C | 26 | LAB581 | 0.82 | 0.006 | C | 48 |

TABLE 30-continued

Correlation between the expression level of selected LAB genes of some embodiments of the invention in various tissues and the phenotypic performance under low nitrogen, normal, cold or salinity stress conditions across Sorghum accessions

| Gene name | R | P | Exp. set | Corr. ID | Gene name | R | P | Exp. set | Corr. ID |
|---|---|---|---|---|---|---|---|---|---|
| LAB581 | 0.83 | 0.005 | C | 25 | LAB581 | −0.82 | 0.024 | A | 58 |
| LAB581 | −0.77 | 0.045 | A | 48 | LAB581 | 0.76 | 0.017 | C | 33 |
| LAB581 | 0.94 | 0.019 | G | 17 | LAB584 | −0.73 | 0.025 | I | 1 |
| LAB581 | −0.93 | 0.021 | G | 55 | LAB584 | −0.71 | 0.033 | C | 30 |
| LAB581 | 0.92 | 0.028 | G | 39 | LAB587 | −0.94 | 0.002 | A | 40 |
| LAB581 | −0.90 | 0.006 | A | 37 | LAB587 | −0.93 | 0.003 | A | 15 |
| LAB581 | −0.86 | 0.013 | A | 3 | LAB587 | −0.90 | 0.005 | A | 37 |
| LAB581 | −0.85 | 0.014 | A | 7 | LAB587 | −0.85 | 0.015 | A | 44 |
| LAB581 | −0.85 | 0.015 | A | 44 | LAB587 | −0.83 | 0.020 | A | 58 |
| LAB581 | 0.84 | 0.004 | C | 27 | LAB587 | −0.81 | 0.028 | A | 3 |
| LAB581 | 0.84 | 0.005 | C | 44 | LAB587 | −0.80 | 0.029 | A | 7 |
| LAB587 | −0.79 | 0.035 | A | 48 | LAB590 | 0.77 | 0.042 | A | 33 |
| LAB587 | −0.77 | 0.043 | A | 33 | LAB590 | 0.76 | 0.047 | A | 44 |
| LAB588 | −0.85 | 0.003 | C | 28 | LAB590 | 0.75 | 0.020 | L | 32 |
| LAB588 | −0.78 | 0.012 | L | 43 | LAB590 | 0.73 | 0.025 | L | 6 |
| LAB588 | −0.78 | 0.013 | C | 30 | LAB591 | 0.91 | 0.001 | C | 19 |
| LAB588 | 0.77 | 0.009 | J | 43 | LAB591 | 0.80 | 0.009 | C | 33 |
| LAB588 | −0.76 | 0.017 | L | 2 | LAB591 | −0.75 | 0.021 | D | 4 |
| LAB588 | 0.75 | 0.012 | J | 57 | LAB591 | 0.71 | 0.033 | C | 15 |
| LAB588 | −0.74 | 0.023 | I | 42 | LAB592 | 0.73 | 0.025 | C | 25 |
| LAB588 | −0.74 | 0.023 | L | 57 | LAB592 | 0.86 | 0.003 | C | 11 |
| LAB588 | −0.73 | 0.024 | I | 1 | LAB592 | 0.82 | 0.007 | F | 12 |
| LAB589 | −0.78 | 0.012 | I | 1 | LAB592 | 0.77 | 0.014 | C | 28 |
| LAB589 | −0.78 | 0.014 | I | 42 | LAB592 | 0.73 | 0.025 | C | 3 |
| LAB589 | −0.76 | 0.017 | D | 54 | LAB592 | 0.72 | 0.028 | C | 44 |
| LAB589 | −0.71 | 0.033 | L | 10 | LAB593 | 0.89 | 0.041 | G | 1 |
| LAB590 | 0.86 | 0.012 | A | 48 | LAB593 | 0.82 | 0.006 | C | 3 |
| LAB590 | 0.85 | 0.015 | A | 58 | LAB593 | 0.89 | 0.001 | F | 4 |
| LAB590 | 0.80 | 0.010 | L | 36 | LAB593 | 0.78 | 0.013 | D | 4 |
| LAB590 | 0.78 | 0.038 | A | 7 | LAB593 | 0.76 | 0.018 | C | 7 |
| LAB590 | 0.78 | 0.041 | A | 37 | LAB593 | 0.82 | 0.007 | F | 8 |
| LAB593 | 0.75 | 0.021 | D | 8 | LAB593 | 0.83 | 0.006 | F | 49 |
| LAB593 | 0.81 | 0.009 | C | 11 | LAB593 | 0.90 | 0.036 | G | 56 |
| LAB593 | 0.85 | 0.004 | D | 22 | LAB593 | 0.78 | 0.012 | C | 58 |
| LAB593 | 0.82 | 0.006 | F | 22 | LAB593 | 0.86 | 0.003 | D | 59 |
| LAB593 | 0.82 | 0.006 | D | 23 | LAB593 | 0.86 | 0.003 | F | 59 |
| LAB593 | 0.77 | 0.016 | F | 23 | LAB594 | −0.71 | 0.031 | F | 22 |
| LAB593 | 0.84 | 0.004 | D | 24 | LAB594 | −0.70 | 0.035 | F | 24 |
| LAB593 | 0.79 | 0.011 | F | 24 | LAB594 | 0.84 | 0.017 | A | 29 |
| LAB593 | 0.82 | 0.006 | C | 25 | LAB594 | −0.84 | 0.005 | I | 42 |
| LAB593 | 0.76 | 0.018 | C | 26 | LAB594 | 0.82 | 0.023 | A | 11 |
| LAB593 | 0.79 | 0.011 | C | 27 | LAB594 | −0.77 | 0.015 | I | 1 |
| LAB593 | 0.70 | 0.034 | L | 32 | LAB594 | 0.76 | 0.047 | A | 30 |
| LAB593 | 0.80 | 0.010 | C | 33 | LAB594 | −0.75 | 0.012 | J | 10 |
| LAB593 | 0.83 | 0.006 | F | 34 | LAB595 | −0.94 | 0.002 | A | 15 |
| LAB593 | 0.83 | 0.006 | C | 44 | LAB595 | −0.92 | 0.003 | A | 40 |
| LAB593 | 0.89 | 0.001 | F | 45 | LAB595 | 0.85 | 0.004 | F | 41 |
| LAB593 | 0.85 | 0.004 | D | 45 | LAB595 | −0.80 | 0.032 | A | 37 |
| LAB593 | 0.74 | 0.022 | C | 48 | LAB595 | −0.80 | 0.033 | A | 33 |
| LAB593 | 0.85 | 0.004 | D | 49 | LAB595 | −0.79 | 0.007 | J | 14 |
| LAB595 | −0.76 | 0.018 | L | 6 | LAB595 | −0.79 | 0.036 | A | 7 |
| LAB595 | −0.70 | 0.035 | L | 47 | LAB610 | 0.87 | 0.002 | C | 50 |
| LAB596 | −0.82 | 0.023 | A | 50 | LAB610 | −0.86 | 0.012 | A | 15 |
| LAB596 | −0.81 | 0.008 | L | 2 | LAB610 | −0.79 | 0.033 | A | 37 |
| LAB596 | 0.72 | 0.019 | J | 52 | LAB610 | −0.79 | 0.006 | J | 32 |
| LAB596 | −0.71 | 0.032 | L | 6 | LAB610 | −0.77 | 0.014 | C | 28 |
| LAB597 | 0.87 | 0.011 | A | 28 | LAB610 | 0.71 | 0.031 | F | 41 |
| LAB597 | 0.76 | 0.011 | J | 52 | LAB610 | 0.70 | 0.024 | J | 52 |
| LAB597 | −0.75 | 0.013 | J | 18 | LAB611 | −0.91 | 0.005 | A | 26 |
| LAB608 | −0.92 | 0.001 | L | 6 | LAB611 | −0.91 | 0.004 | A | 7 |
| LAB608 | 0.90 | 0.006 | A | 28 | LAB611 | 0.89 | 0.001 | C | 29 |
| LAB608 | −0.88 | 0.002 | L | 47 | LAB611 | −0.86 | 0.012 | A | 48 |
| LAB608 | −0.87 | 0.010 | A | 50 | LAB611 | −0.85 | 0.015 | A | 27 |
| LAB608 | −0.84 | 0.004 | L | 57 | LAB611 | −0.84 | 0.018 | A | 37 |
| LAB608 | −0.83 | 0.005 | L | 36 | LAB611 | 0.84 | 0.005 | C | 30 |
| LAB608 | −0.76 | 0.019 | L | 32 | LAB611 | −0.83 | 0.021 | A | 58 |
| LAB608 | −0.75 | 0.020 | L | 43 | LAB611 | −0.82 | 0.023 | A | 33 |
| LAB608 | −0.74 | 0.023 | L | 2 | LAB611 | −0.82 | 0.023 | A | 40 |
| LAB610 | 0.91 | 0.032 | G | 55 | LAB611 | −0.80 | 0.009 | L | 14 |

TABLE 30-continued

Correlation between the expression level of selected LAB genes of some embodiments of the invention in various tissues and the phenotypic performance under low nitrogen, normal, cold or salinity stress conditions across *Sorghum* accessions

| Gene name | R | P | Exp. set | Corr. ID | Gene name | R | P | Exp. set | Corr. ID |
|---|---|---|---|---|---|---|---|---|---|
| LAB610 | −0.87 | 0.010 | A | 40 | LAB611 | 0.75 | 0.012 | J | 10 |
| LAB611 | 0.71 | 0.033 | D | 21 | | | | | |

Table 30. "Corr. ID"—correlation set ID according to the correlated parameters Table above.
"Exp. Set" = Expression set.
"R" = Pearson correlation coefficient;
"P" = p value.

Example 5

Production of Maize Transcriptom and High Throughput Correlation Analysis with Yield and NUE Related Parameters Using 44K Maize Oligonucleotide Micro-Arrays In order to produce a high throughput correlation analysis between plant phenotype and gene expression level, the present inventors utilized a maize oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 maize genes and transcripts.

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with stress and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize tissues—All 10 selected maize hybrids were sampled per 3 time points (TP2=V6-V8, TP5=R1-R2, TP6=R3-R4). Four types of plant tissues [Ear, flag leaf indicated in Table 31 as "leaf", grain distal part, and internode] growing under Normal conditions were sampled and RNA was extracted as described above. Each micro-array expression information tissue type has received a Set ID as summarized in Table 31 below.

TABLE 31

Maize transcriptom expression sets NORMAL

| Expression Set | Set ID |
|---|---|
| Maize field/Normal/Ear TP5 | A |
| Maize field/Normal/Ear TP6 | B |
| Maize field/Normal/Grain Distal | C |
| Maize field/Normal/Internode TP2 | D |
| Maize field/Normal/Internode TP5 | E |
| Maize field/Normal/Internode TP6 | F |
| Maize field/Normal/Leaf TP2 | G |
| Maize field/Normal/Leaf TP5 | H |

Table 31:
Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.
TP = time point.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were, photographed and images were processed using the below described image processing system. The Ear area was measured from those images and was divided by the number of Ears.

Ear Length and Ear Width (cm)—At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate was calculated using Formulas V and VI (described above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index was calculated using Formula VIII.

$$\text{Harvest Index} = \text{Average grain dry weight per Ear}/(\text{Average vegetative dry weight per Ear} + \text{Average Ear dry weight}).$$ Formula VIII Percent Filled Ear [%]—it was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 12 different maize hybrids were grown and characterized for different parameters. The correlated parameters are described in Table 32 below. The average for each of the measured parameter was calculated using the JMP software (Tables 33-34) and a subsequent correlation analysis was performed (Table 35). Results were then integrated to the database.

TABLE 32

Maize correlated parameters (vectors)

| Correlation set | Correlation ID |
|---|---|
| SPAD 54DPS [SPAD units] | 1 |
| SPAD 46DPS [SPAD units] | 2 |
| Growth Rate Leaf Number | 3 |
| Plant Height per Plot [cm] | 4 |
| Ear Height [cm] | 5 |
| Leaf Number per Plant [number] | 6 |
| Ear Length [cm] | 7 |
| Percent Filled Ear [%] | 8 |
| Cob Diameter [mm] | 9 |
| Kernel Row Number per Ear [number] | 10 |
| DW per Plant [gr.] | 11 |
| Ear FW per Plant [gr.] | 12 |
| Normalized Grain Weight per plant [gr.] | 13 |
| Ears FW per plot [gr.] | 14 |
| Normalized Grain Weight per plot [gr.] | 15 |
| Ear Area [cm$^2$] | 16 |
| Ear Width [cm] | 17 |
| Grain Area [cm$^2$] | 18 |
| Grain Length [cm] | 19 |
| Grain Width [cm] | 20 |

Table 32.
SPAD 46DPS and SPAD 54DPS: Chlorophyl level after 46 and 54 days after sowing (DPS).
"FW" = fresh weight;
"DW" = dry weight.

TABLE 33

Measured parameters in Maize accessions under normal conditions

| Seed ID | 1 | 2 | 3 | 4 | 5 | 6 | 7 | 8 | 9 | 10 | 11 |
|---|---|---|---|---|---|---|---|---|---|---|---|
| Line 1 | 54.8 | 55.3 | 0.306 | 287 | 135 | 11.9 | 20.9 | 80.4 | 28.7 | 16.2 | 656 |
| Line 2 | 54.3 | 51.7 | 0.283 | 278 | 135 | 12 | 19.7 | 80.6 | 29 | 16.2 | 658 |
| Line 3 | 57.2 | 56.4 | 0.221 | 270 | 116 | 8.4 | 19.1 | 94.3 | 23.8 | 15 | 472 |
| Line 4 | 56 | 53.5 | 0.281 | 275 | 132 | 11.7 | 20.5 | 82.1 | 28.1 | 16.2 | 641 |
| Line 5 | 59.7 | 55.2 | 0.269 | 238 | 114 | 11.8 | 21.3 | 92.7 | 25.7 | 15.9 | 581 |
| Line 6 | 59.1 | 59.4 | 0.244 | 225 | 94.3 | 12.3 | 18.2 | 82.8 | 25.8 | 15.2 | 569 |
| Line 7 | 58 | 58.5 | 0.244 | 264 | 121 | 12.4 | 19 | 73.2 | 26.4 | 16 | 511 |
| Line 8 | 60.4 | 55.9 | 0.266 | 252 | 108 | 12.2 | 18.6 | 81.1 | 25.2 | 14.8 | 544 |
| Line 9 | 54.8 | 53 | | | | | | | | | |
| Line 10 | 53.3 | 50 | | | | | | | | | |
| Line 11 | 61.1 | 59.7 | 0.301 | 278 | 112 | 12.6 | 21.7 | 91.6 | 26.7 | 15.4 | 522 |
| Line 12 | 51.4 | 53.9 | 0.194 | 164 | 60.4 | 9.28 | 16.7 | 81.1 | 14.3 | 574 | 141 |

Table 33. Provided are the values of each of the parameters (as described above) measured in maize accessions (Seed ID) under regular growth conditions.
Growth conditions are specified in the experimental procedure section.

TABLE 34

Additional measured parameters in Maize accessions under regular growth conditions

| Seed ID | 12  | 13  | 14  | 15  | 16   | 17   | 18    | 19   | 20    |
|---------|-----|-----|-----|-----|------|------|-------|------|-------|
| Line 1  | 272 | 157 | 280 | 140 | 91.6 | 5.73 | 0.806 | 1.23 | 0.824 |
| Line 2  | 246 | 141 | 278 | 154 | 85.1 | 5.58 | 0.753 | 1.17 | 0.81  |
| Line 3  | 190 | 129 | 190 | 121 | 77.9 | 5.1  | 0.674 | 1.07 | 0.794 |
| Line 4  | 262 | 154 | 288 | 152 | 90.5 | 5.67 | 0.755 | 1.18 | 0.803 |
| Line 5  | 264 | 177 | 248 | 159 | 96   | 5.53 | 0.766 | 1.2  | 0.803 |
| Line 6  | 178 | 120 | 176 | 117 | 72.4 | 5.23 | 0.713 | 1.12 | 0.803 |
| Line 7  | 189 | 120 | 192 | 123 | 74   | 5.22 | 0.714 | 1.14 | 0.791 |
| Line 8  | 197 | 134 | 205 | 131 | 76.5 | 5.33 | 0.753 | 1.13 | 0.837 |
| Line 9  |     |     |     |     |      |      |       |      |       |
| Line 10 |     |     |     |     |      |      |       |      |       |
| Line 11 | 261 | 173 | 264 | 171 | 95.4 | 5.58 | 0.762 | 1.18 | 0.812 |
| Line 12 | 54.3| 143 | 40.8| 55.2| 4.12 | 0.796| 0.921 | 0.675|       |

Table 34. Provided are the values of each of the parameters (as described above) measured in maize accessions (Seed ID) under regular growth conditions.
Growth conditions are specified in the experimental procedure section.

TABLE 35

Correlation between the expression level of selected LAB genes of some embodiments of the invention in various tissues and the phenotypic performance under normal across maize accessions

| Gene Name | R     | P        | Exp. set | Corr. ID | Gene Name | R     | P     | Exp. set | Corr. ID |
|-----------|-------|----------|----------|----------|-----------|-------|-------|----------|----------|
| LAB503 | 0.96  | 0.001    | A | 19 | LAB503 | 0.86  | 0.013 | E | 18 |
| LAB503 | 0.95  | 0.001    | E | 5  | LAB503 | 0.86  | 0.014 | A | 18 |
| LAB503 | 0.95  | 0.001    | A | 6  | LAB503 | 0.85  | 0.016 | A | 5  |
| LAB503 | 0.94  | 0.001    | A | 4  | LAB503 | 0.84  | 0.017 | E | 15 |
| LAB503 | 0.94  | 0.002    | A | 15 | LAB503 | 0.84  | 0.017 | E | 3  |
| LAB503 | 0.94  | 0.002    | A | 3  | LAB503 | 0.84  | 0.005 | D | 18 |
| LAB503 | 0.93  | 0.002    | A | 8  | LAB503 | 0.83  | 0.005 | D | 20 |
| LAB503 | 0.90  | 0.006    | A | 13 | LAB503 | 0.83  | 0.020 | E | 4  |
| LAB503 | 0.90  | 0.006    | A | 20 | LAB503 | 0.83  | 0.021 | E | 20 |
| LAB503 | 0.90  | 0.006    | A | 17 | LAB503 | 0.83  | 0.006 | D | 3  |
| LAB503 | 0.88  | 0.009    | E | 19 | LAB503 | 0.82  | 0.022 | A | 16 |
| LAB503 | 0.87  | 0.011    | E | 17 | LAB503 | 0.82  | 0.023 | E | 13 |
| LAB503 | 0.82  | 0.024    | E | 16 | LAB503 | −0.80 | 0.016 | F | 19 |
| LAB503 | 0.82  | 0.007    | D | 6  | LAB503 | 0.80  | 0.030 | E | 10 |
| LAB503 | 0.80  | 0.032    | A | 12 | LAB504 | −0.82 | 0.023 | A | 16 |
| LAB503 | 0.80  | 0.010    | D | 19 | LAB504 | −0.81 | 0.026 | A | 15 |
| LAB503 | 0.80  | 0.032    | A | 7  | LAB504 | 0.81  | 0.014 | C | 9  |
| LAB503 | 0.79  | 0.034    | A | 14 | LAB504 | −0.79 | 0.035 | A | 3  |
| LAB503 | 0.77  | 0.043    | E | 8  | LAB504 | −0.79 | 0.036 | A | 18 |
| LAB503 | 0.77  | 0.016    | D | 4  | LAB504 | −0.76 | 0.045 | A | 17 |
| LAB503 | 0.75  | 0.050    | E | 14 | LAB504 | 0.71  | 0.049 | C | 11 |
| LAB503 | 0.75  | 0.019    | D | 17 | LAB505 | −0.84 | 0.009 | C | 11 |
| LAB503 | 0.75  | 0.020    | D | 13 | LAB505 | −0.83 | 0.021 | A | 8  |
| LAB503 | 0.75  | 0.034    | D | 9  | LAB505 | −0.81 | 0.026 | A | 6  |
| LAB503 | 0.74  | 0.023    | D | 15 | LAB505 | 0.76  | 0.048 | E | 5  |
| LAB503 | −0.74 | 0.038    | F | 10 | LAB505 | −0.73 | 0.041 | C | 3  |
| LAB503 | 0.73  | 0.039    | F | 20 | LAB505 | −0.71 | 0.047 | C | 10 |
| LAB503 | −0.71 | 0.048    | F | 3  | LAB505 | −0.71 | 0.049 | C | 17 |
| LAB504 | −0.93 | 0.007    | B | 8  | LAB506 | −0.83 | 0.003 | G | 10 |
| LAB504 | 0.87  | 0.023    | E | 9  | LAB506 | −0.79 | 0.019 | F | 20 |
| LAB504 | −0.87 | 0.011    | A | 13 | LAB506 | −0.78 | 0.014 | G | 9  |
| LAB504 | −0.84 | 0.018    | A | 7  | LAB506 | 0.75  | 0.021 | D | 6  |
| LAB504 | −0.83 | 0.022    | A | 19 | LAB506 | 0.73  | 0.025 | D | 18 |
| LAB504 | −0.83 | 0.022    | A | 12 | LAB506 | −0.73 | 0.017 | G | 14 |
| LAB506 | 0.72  | 0.029    | D | 20 | LAB507 | −0.85 | 0.015 | E | 17 |
| LAB506 | −0.71 | 0.020    | G | 11 | LAB507 | −0.85 | 0.017 | E | 15 |
| LAB506 | 0.71  | 0.032    | D | 19 | LAB507 | −0.84 | 0.018 | E | 18 |
| LAB507 | −0.94 | 1.39E−04 | D | 6  | LAB507 | −0.83 | 0.006 | D | 5  |
| LAB507 | −0.94 | 1.49E−04 | D | 20 | LAB507 | −0.83 | 0.006 | D | 8  |
| LAB507 | −0.94 | 1.50E−04 | D | 19 | LAB507 | −0.82 | 0.023 | E | 10 |
| LAB507 | −0.94 | 0.002    | A | 17 | LAB507 | −0.81 | 0.014 | C | 3  |
| LAB507 | −0.94 | 2.14E−04 | D | 17 | LAB507 | −0.81 | 0.026 | E | 6  |
| LAB507 | −0.93 | 2.90E−04 | D | 18 | LAB507 | −0.81 | 0.028 | E | 16 |
| LAB507 | −0.92 | 0.003    | A | 19 | LAB507 | −0.80 | 0.030 | E | 7  |
| LAB507 | −0.91 | 0.004    | A | 6  | LAB507 | −0.79 | 0.033 | E | 8  |
| LAB507 | −0.91 | 0.005    | A | 15 | LAB507 | −0.79 | 0.033 | A | 16 |
| LAB507 | −0.91 | 0.005    | E | 19 | LAB507 | −0.79 | 0.020 | C | 11 |
| LAB507 | −0.90 | 0.001    | D | 15 | LAB507 | −0.78 | 0.021 | C | 19 |
| LAB507 | −0.90 | 0.001    | D | 4  | LAB507 | −0.77 | 0.016 | D | 16 |
| LAB507 | −0.87 | 0.010    | A | 4  | LAB507 | −0.77 | 0.045 | E | 12 |
| LAB507 | −0.87 | 0.002    | D | 13 | LAB507 | −0.77 | 0.016 | D | 3  |
| LAB507 | −0.87 | 0.011    | A | 13 | LAB507 | −0.76 | 0.045 | E | 3  |
| LAB507 | −0.87 | 0.012    | E | 13 | LAB507 | 0.73  | 0.038 | F | 10 |
| LAB507 | −0.86 | 0.012    | A | 5  | LAB507 | 0.73  | 0.040 | F | 11 |
| LAB507 | 0.72  | 0.043    | F | 5  | LAB508 | 0.78  | 0.038 | E | 13 |

TABLE 35-continued

Correlation between the expression level of selected LAB genes of some embodiments of the invention in various tissues and the phenotypic performance under normal across maize accessions

| Gene Name | R | P | Exp. set | Corr. ID | Gene Name | R | P | Exp. set | Corr. ID |
|---|---|---|---|---|---|---|---|---|---|
| LAB507 | −0.72 | 0.044 | C | 18 | LAB508 | 0.77 | 0.045 | E | 17 |
| LAB507 | −0.72 | 0.029 | D | 7 | LAB508 | 0.72 | 0.043 | C | 3 |
| LAB507 | −0.72 | 0.046 | C | 17 | LAB508 | −0.72 | 0.029 | D | 3 |
| LAB507 | −0.72 | 0.046 | C | 9 | LAB508 | −0.70 | 0.024 | G | 6 |
| LAB507 | 0.71 | 0.048 | F | 14 | LAB509 | 0.94 | 0.006 | B | 20 |
| LAB507 | 0.71 | 0.034 | G | 9 | LAB509 | 0.87 | 0.011 | H | 2 |
| LAB507 | −0.71 | 0.034 | D | 10 | LAB509 | 0.84 | 0.017 | E | 20 |
| LAB508 | 0.87 | 0.011 | E | 3 | LAB509 | 0.84 | 0.010 | F | 11 |
| LAB508 | 0.82 | 0.022 | E | 19 | LAB509 | 0.80 | 0.030 | E | 18 |
| LAB508 | 0.82 | 0.024 | E | 12 | LAB509 | −0.78 | 0.022 | C | 11 |
| LAB508 | 0.81 | 0.026 | E | 10 | LAB509 | 0.76 | 0.047 | E | 6 |
| LAB508 | 0.81 | 0.026 | E | 7 | LAB509 | 0.74 | 0.036 | F | 18 |
| LAB508 | −0.80 | 0.030 | A | 20 | LAB509 | 0.74 | 0.036 | F | 17 |
| LAB509 | −0.71 | 0.048 | C | 9 | LAB510 | −0.93 | 0.002 | E | 16 |
| LAB510 | −0.94 | 0.001 | E | 13 | LAB510 | −0.93 | 0.002 | E | 12 |
| LAB510 | −0.91 | 0.005 | E | 19 | LAB510 | −0.89 | 0.007 | E | 15 |
| LAB510 | −0.85 | 0.015 | E | 17 | LAB511 | 0.88 | 0.004 | F | 20 |
| LAB510 | −0.84 | 0.017 | A | 8 | LAB511 | −0.86 | 0.012 | A | 5 |
| LAB510 | −0.83 | 0.021 | E | 10 | LAB511 | −0.85 | 0.015 | A | 4 |
| LAB510 | −0.82 | 0.024 | E | 14 | LAB511 | −0.84 | 0.017 | A | 13 |
| LAB510 | −0.81 | 0.027 | E | 18 | LAB511 | −0.84 | 0.009 | C | 11 |
| LAB510 | −0.81 | 0.027 | E | 3 | LAB511 | −0.83 | 0.006 | G | 9 |
| LAB510 | −0.81 | 0.028 | E | 8 | LAB511 | 0.80 | 0.029 | E | 6 |
| LAB510 | −0.80 | 0.010 | D | 14 | LAB511 | −0.77 | 0.043 | A | 16 |
| LAB510 | −0.79 | 0.020 | F | 8 | LAB511 | 0.76 | 0.046 | E | 20 |
| LAB510 | −0.78 | 0.038 | A | 13 | LAB511 | −0.76 | 0.029 | C | 10 |
| LAB510 | −0.76 | 0.018 | D | 12 | LAB511 | −0.76 | 0.030 | C | 3 |
| LAB510 | 0.72 | 0.046 | F | 5 | LAB511 | −0.74 | 0.036 | C | 19 |
| LAB510 | −0.71 | 0.049 | C | 7 | LAB511 | −0.72 | 0.044 | C | 17 |
| LAB510 | −0.71 | 0.049 | C | 11 | LAB512 | −0.95 | 0.001 | E | 17 |
| LAB511 | −0.96 | 0.001 | A | 18 | LAB512 | −0.95 | 0.001 | A | 8 |
| LAB511 | −0.94 | 0.001 | A | 8 | LAB512 | −0.94 | 0.002 | E | 8 |
| LAB511 | −0.92 | 0.004 | A | 17 | LAB512 | −0.94 | 0.002 | E | 19 |
| LAB511 | −0.90 | 0.006 | A | 19 | LAB512 | −0.93 | 0.002 | A | 6 |
| LAB511 | −0.88 | 0.008 | A | 15 | LAB512 | −0.93 | 0.002 | A | 17 |
| LAB511 | −0.88 | 0.009 | A | 6 | LAB512 | −0.93 | 0.002 | E | 15 |
| LAB512 | 0.92 | 0.003 | H | 7 | LAB512 | −0.76 | 0.017 | D | 3 |
| LAB512 | −0.91 | 0.004 | A | 19 | LAB512 | −0.76 | 0.049 | E | 3 |
| LAB512 | −0.91 | 0.005 | A | 15 | LAB513 | −0.91 | 0.002 | F | 12 |
| LAB512 | −0.91 | 0.005 | A | 18 | LAB513 | −0.90 | 0.003 | C | 9 |
| LAB512 | −0.90 | 0.006 | E | 13 | LAB513 | −0.88 | 0.004 | F | 17 |
| LAB512 | −0.89 | 0.007 | E | 6 | LAB513 | −0.88 | 0.021 | B | 16 |
| LAB512 | −0.89 | 0.007 | E | 4 | LAB513 | −0.87 | 0.023 | B | 7 |
| LAB512 | −0.89 | 0.008 | E | 5 | LAB513 | −0.86 | 0.027 | B | 19 |
| LAB512 | −0.87 | 0.010 | A | 4 | LAB513 | −0.85 | 0.032 | B | 12 |
| LAB512 | −0.87 | 0.012 | A | 13 | LAB513 | −0.83 | 0.011 | F | 13 |
| LAB512 | −0.86 | 0.012 | A | 5 | LAB513 | 0.83 | 0.021 | A | 11 |
| LAB512 | 0.86 | 0.014 | H | 8 | LAB513 | −0.83 | 0.011 | F | 16 |
| LAB512 | −0.86 | 0.002 | G | 1 | LAB513 | −0.83 | 0.012 | F | 14 |
| LAB512 | 0.86 | 0.014 | H | 12 | LAB513 | −0.82 | 0.045 | B | 13 |
| LAB512 | −0.83 | 0.022 | E | 16 | LAB513 | −0.82 | 0.013 | F | 19 |
| LAB512 | 0.81 | 0.050 | B | 20 | LAB513 | −0.81 | 0.014 | F | 15 |
| LAB512 | 0.80 | 0.030 | H | 16 | LAB513 | −0.81 | 0.014 | F | 18 |
| LAB512 | −0.79 | 0.033 | A | 16 | LAB513 | 0.80 | 0.031 | E | 19 |
| LAB512 | −0.79 | 0.020 | F | 6 | LAB513 | −0.78 | 0.023 | F | 7 |
| LAB512 | 0.76 | 0.046 | H | 13 | LAB513 | 0.77 | 0.043 | E | 10 |
| LAB513 | 0.76 | 0.047 | E | 18 | LAB513 | −0.75 | 0.030 | C | 11 |
| LAB513 | 0.76 | 0.048 | A | 18 | LAB609 | 0.81 | 0.049 | B | 13 |

Table 35. "Corr. ID"—correlation set ID according to the correlated parameters Table above.
"Exp. Set"—Expression set.
"R" = Pearson correlation coefficient;
"P" = p value.

Example 6

Production of Maize Transcriptom and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60,000 maize genes and transcripts.

Correlation of Maize Hybrids Across Ecotypes Grown Under Low Nitrogen Conditions Experimental Procedures 12 Maize hybrids were grown in 3 repetitive plots, in field. Maize seeds were planted and plants were grown in the field using commercial fertilization and irrigation protocols, which included 485 $m^3$ water per dunam per entire growth period and to fertilization of 30 units of URAN® 21% fertilization per dunam per entire growth period (normal conditions). In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize tissues—All 10 selected maize hybrids were sampled per each treatment (low N and normal conditions), in three time points (TP2=V6-V8 (six to eight collar leaf are visible, rapid growth phase and kernel row determination begins), TP5=R1-R2 (silking-blister), TP6=R3-R4 (milk-dough). Four types of plant tissues [Ear, flag leaf indicated in Table 36 as leaf, grain distal part, and internode] were sampled and RNA was extracted as described above. Each micro-array expression information tissue type has received a Set ID as summarized in Table 36 below.

TABLE 36

Maize transcriptom expression sets

| Expression Set | Set ID |
|---|---|
| Maize field/Low/N/Ear/TP5 | A |
| Maize field/Low/N/Ear/TP6 | B |
| Maize field/Low/N/Internodes/TP2 | C |
| Maize field/Low/N/Internodes/TP5 | D |
| Maize field/Low/N/Leaf/TP5 | E |
| Maize field/Low/N/Leaf/TP6 | F |
| Maize field/Normal/Ear/R1-R2 | G |
| Maize field/Normal/Grain/Distal/R4-R5 | H |
| Maize field/Normal/Internode/R3-R4 | J |
| Maize field/Normal/Internode/V6-V8 | K |
| Maize field/Normal/Leaf/R1-R2 | L |
| Maize field/Normal/Leaf/V6-V8 | M |
| Maize field/Low/N/Internodes/TP6 | N |
| Maize field/Low/N/Leaf/TP2 | O |

TABLE 36-continued

Maize transcriptom expression sets

| Expression Set | Set ID |
|---|---|
| Maize field/Normal/Ear/R3-R4 | P |
| Maize field/Normal/Internode/R1-R2 | Q |

Table 36:
Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

The following parameters were collected using digital imaging system:

Grain Area ($cm^2$)—At the end of the growing period the grains were separated from the ear. A sample of ~200 grains were weighted, photographed and images were to processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were photographed and images were processed using the below described image processing system. The Ear area was measured from those images and was divided by the number of Ears.

Ear Length and Ear Width (cm)—At the end of the growing period 5 ears were photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by to number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate was calculated using Formulas V and VI (described above).

SPAD—Chlorophyll content was determined using a Minolta SPAD 502 chlorophyll meter and measurement was performed at early stages of grain filling (R1-R2) and late stage of grain filling (R3-R4). SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index per plant was calculated using Formula IX.

Harvest Index=Average grain weight per plant/(Average vegetative dry weight per plant plus Average grain weight per plant).    Formula IX Percent Filled Ear [%]—it was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 11 different maize hybrids were grown and characterized for different parameters. Table 37 describes the Maize correlated parameters. The average for each of the measured parameter was calculated using the JMP software (Tables 38-39) and a subsequent correlation analysis was performed (Table 40). Results were then integrated to the database.

TABLE 37

| Maize correlated parameters (vectors) | |
| --- | --- |
| Correlation set | Correlation ID |
| Ear Length [cm] Low N | 1 |
| Ear Length [cm] Normal | 2 |
| Ear Length of filled area [cm] Low N | 3 |
| Ear Length of filled area [cm] Normal | 4 |
| Ear width [mm] Low N | 5 |
| Ear width [mm] Normal | 6 |
| Ears weight per plot [kg] Low N | 7 |
| Ears weight per plot [kg] Normal | 8 |
| Final Leaf Area [number] Low N | 9 |
| Final Leaf Area [number] Normal | 10 |
| Final Leaf Number [number] Low N | 11 |
| Final Leaf Number [number] Normal | 12 |
| Final Main Ear Height [cm] Low N | 13 |
| Final Main Ear Height [cm] Normal | 14 |
| Final Plant DW [kg] Low N | 15 |
| Final Plant DW [kg] Normal | 16 |
| Final Plant Height [cm] Low N | 17 |
| Final Plant Height [cm] Normal | 18 |
| No of rows per ear [number] Low N | 19 |
| No of rows per ear [number] Normal | 20 |
| NUE at early grain filling [R1-R2] yield kg/N in plant per SPAD Low N | 21 |
| NUE at early grain filling [R1-R2] yield kg/N in plant per SPAD Normal | 22 |
| NUE at grain filling [R3-R4] yield kg/N in plant per SPAD Low N | 23 |
| NUE at grain filling [R3-R4] yield kg/N in plant per SPAD Normal | 24 |
| NUE yield kg/N applied in soil kg Low N | 25 |
| NUE yield kg/N applied in soil kg Normal | 26 |
| NUpE [biomass/N applied] Low N | 27 |
| NUpE [biomass/N applied] Normal | 28 |
| Seed yield per dunam [kg] Low N | 29 |
| Seed yield per dunam [kg] Normal | 30 |
| seed yield per plant [kg] Normal | 31 |
| seed yield per plant [kg] Low N | 32 |
| SPAD at R1-R2 [number] Low N | 33 |
| SPAD at R1-R2 [number] Normal | 34 |
| SPAD at R3-R4 [number] Low N | 35 |
| SPAD at R3-R4 [number] Normal | 36 |
| Stalk width at TP5 Normal | 37 |
| Stalk width at TP5 Low N | 38 |
| Yield/LAI Low N | 39 |
| Yield/LAI Normal | 40 |
| Yield/stalk width Normal | 41 |
| Yield/stalk width Low N | 42 |

Table 37.
"cm" = centimeters';
"mm" = millimeters;
"kg" = kilograms;
SPAD at R1-R2 and SPAD R3-R4: Chlorophyl level after early and late stages of grain filling;
"NUE" = nitrogen use efficiency;
"NUpE" = nitrogen uptake efficiency;
"LAI" = leaf area;
"N" = nitrogen;
Low N = under low Nitrogen conditions;
"Normal" = under normal conditions;
"dunam" = 1000 m$^2$.

TABLE 38

| | Measured parameters in Maize accessions under normal conditions | | | | | | | | | | |
| --- | --- | --- | --- | --- | --- | --- | --- | --- | --- | --- | --- |
| Corr. | Line | | | | | | | | | | |
| ID | 1 | 2 | 3 | 4 | 5 | 6 | 7 | 8 | 9 | 10 | 11 |
| 16 | 1.27 | 1.30 | 1.33 | 1.50 | 1.30 | 1.58 | 1.42 | 1.37 | 1.70 | 11.40 | 0.42 |
| 8 | 8.94 | 7.02 | 7.53 | 7.99 | 8.48 | 5.63 | 6.10 | 6.66 | 8.21 | 8.40 | 1.88 |
| 31 | 0.17 | 0.14 | 0.15 | 0.16 | 0.15 | 0.12 | 0.12 | 0.13 | 0.15 | 0.17 | 0.04 |
| 30 | 1340 | 1090 | 1200 | 1270 | 1200 | 937 | 986 | 1050 | 1230 | 1370 | 301 |
| 18 | 273 | 260 | 288 | 238 | 287 | 225 | 264 | 252 | 279 | 278 | 164 |
| 14 | 130.0 | 122.0 | 128.0 | 113.0 | 135.0 | 94.3 | 121.0 | 108.0 | 140.0 | 112.0 | 60.4 |
| 12 | 11.8 | 11.1 | 13.3 | 11.8 | 11.9 | 12.3 | 12.4 | 12.2 | 11.7 | 12.6 | 9.3 |
| 37 | 2.9 | 2.6 | 2.7 | 2.9 | 2.7 | 2.6 | 2.9 | 2.7 | 2.7 | 2.8 | 2.3 |

TABLE 38-continued

Measured parameters in Maize accessions under normal conditions

| Corr. ID | \multicolumn{11}{c}{Line} | | | | | | | | | | |
|---|---|---|---|---|---|---|---|---|---|---|---|
| | 1 | 2 | 3 | 4 | 5 | 6 | 7 | 8 | 9 | 10 | 11 |
| 2 | 19.9 | 20.2 | 18.1 | 19.9 | 19.5 | 17.7 | 17.7 | 17.3 | 17.5 | 20.5 | 19.9 |
| 6 | 51.1 | 46.3 | 45.9 | 47.6 | 51.4 | 47.4 | 47.3 | 46.8 | 48.3 | 49.3 | 41.8 |
| 4 | 16.2 | 17.5 | 17.7 | 18.4 | 15.7 | 14.7 | 12.9 | 14.0 | 12.3 | 18.8 | 16.1 |
| 20 | 16.1 | 14.7 | 15.4 | 15.9 | 16.2 | 15.2 | 16.0 | 14.8 | 17.7 | 15.4 | 14.3 |
| 34 | 56.9 | 57.2 | 59.3 | 61.6 | 58.6 | 61.2 | 60.2 | 61.1 | 57.5 | 62.2 | 52.0 |
| 36 | 59.9 | 60.9 | 56.9 | 58.7 | 58.7 | 63.2 | 59.8 | 62.4 | 57.2 | 61.9 | 49.3 |
| 26 | 4.5 | 3.6 | 4.0 | 4.2 | 4.0 | 3.1 | 3.3 | 3.5 | 4.1 | 4.6 | 1.0 |
| 24 | 25.0 | 17.8 | 20.3 | 20.0 | 19.0 | 13.9 | 16.2 | 17.2 | 21.5 | 21.0 | 5.5 |
| 22 | 23.4 | 19.1 | 20.3 | 20.7 | 20.5 | 15.4 | 16.4 | 17.2 | 21.0 | 22.0 | 5.7 |
| 41 | 457 | 412 | 443 | 439 | 447 | 357 | 337 | 386 | 472 | 482 | 140 |
| 28 | 0.008 | 0.009 | 0.009 | 0.010 | 0.009 | 0.011 | 0.009 | 0.009 | 0.004 | 0.076 | 0.003 |
| 10 | 3.2 | 4.0 | 3.3 | 4.0 | 3.9 | 4.2 | 4.0 | 4.3 | 4.3 | 2.9 | |
| 40 | 426 | 313 | 307 | 362 | 314 | 225 | 266 | 262 | | 482 | |

Table 38. Provided are the values of each of the parameters (as described above) measured in maize accessions (line) under regular growth conditions. Growth conditions are specified in the experimental procedure section.

TABLE 39

Additional measured parameters in Maize accessions under low Nitrogen conditions

| Corr. ID | \multicolumn{11}{c}{Line} | | | | | | | | | | |
|---|---|---|---|---|---|---|---|---|---|---|---|
| | 1 | 2 | 3 | 4 | 5 | 6 | 7 | 8 | 9 | 10 | 11 |
| 15 | 1.59 | 1.43 | 1.53 | 1.95 | 1.48 | 1.60 | 1.58 | 1.28 | 1.51 | 1.52 | 0.43 |
| 7 | 6.61 | 7.97 | 9.63 | 9.22 | 7.63 | 7.21 | 7.92 | 29.0 | 7.80 | 9.78 | 2.41 |
| 32 | 0.14 | 0.16 | 0.19 | 0.19 | 0.14 | 0.15 | 0.15 | 0.16 | 0.14 | 0.20 | 0.05 |
| 29 | 1080 | 1260 | 1550 | 1500 | 1140 | 1160 | 1210 | 1250 | 1150 | 1590 | 383 |
| 17 | 306 | 271 | 291 | 252 | 260 | 227 | 272 | 249 | 279 | 270 | 171 |
| 13 | 158 | 136 | 128 | 133 | 138 | 100 | 130 | 115 | 144 | 114 | 62 |
| 11 | 15.0 | 11.6 | 13.5 | 11.6 | 11.8 | 11.9 | 12.6 | 11.7 | 12.4 | 13.2 | 9.3 |
| 38 | 2.8 | 2.4 | 2.7 | 2.8 | 2.7 | 2.6 | 3.0 | 2.6 | 2.7 | 2.8 | 2.3 |
| 1 | 20.6 | 21.0 | 20.2 | 20.1 | 20.1 | 18.5 | 19.1 | 18.2 | 20.1 | 21.2 | 17.8 |
| 5 | 46.7 | 48.2 | 48.3 | 49.9 | 52.9 | 47.4 | 49.6 | 48.6 | 52.4 | 50.0 | 42.6 |
| 3 | 18.4 | 18.4 | 19.8 | 18.8 | 16.2 | 16.0 | 15.3 | 15.7 | 16.8 | 19.6 | 14.1 |
| 19 | 14.2 | 15.2 | 15.0 | 15.7 | 16.0 | 15.9 | 15.6 | 14.5 | 16.4 | 15.7 | 14.4 |
| 33 | 60.2 | 57.9 | 58.8 | 59.5 | 58.5 | 64.0 | 56.4 | 60.0 | 58.3 | 61.7 | 53.1 |
| 35 | 59.3 | 57.6 | 58.4 | 59.2 | 58.2 | 62.7 | 61.0 | 59.9 | 57.5 | 61.9 | 49.6 |
| 25 | 7.2 | 8.4 | 10.3 | 10.0 | 7.6 | 7.7 | 8.1 | 8.3 | 7.6 | 10.6 | 2.6 |
| 23 | 18.4 | 21.9 | 26.5 | 25.3 | 19.7 | 18.5 | 19.8 | 20.9 | 19.9 | 25.9 | 7.7 |
| 21 | 18.0 | 21.8 | 26.3 | 25.1 | 19.5 | 18.0 | 21.4 | 20.8 | 19.7 | 25.7 | 7.2 |
| 42 | 417 | 528 | 583 | 541 | 428 | 444 | 407 | 477 | 446 | 562 | 168 |
| 27 | 0.011 | 0.010 | 0.010 | 0.013 | 0.010 | 0.011 | 0.011 | 0.009 | 0.010 | 0.010 | 0.003 |
| 9 | 2.92 | 3.15 | 3.33 | 2.87 | 2.79 | 3.76 | 3.50 | 5.02 | | 3.16 | |
| 39 | 342 | 408 | 465 | 522 | 440 | 313 | 346 | 288 | | 501 | |

Table 39. Provided are the values of each of the parameters (as described above) measured in maize accessions (line) under low nitrogen growth conditions. Growth conditions are specified in the experimental procedure section.

TABLE 40

Correlation between the expression level of selected LAB genes of some embodiments of the invention in various tissues and the phenotypic performance under normal conditions across maize accessions

| Gene Name | R | P | Exp. ID | Corr. ID | Gene Name | R | P | Exp. ID | Corr. ID |
|---|---|---|---|---|---|---|---|---|---|
| LAB503 | 0.95 | 0.001 | G | 18 | LAB503 | 0.86 | 0.012 | Q | 8 |
| LAB503 | 0.94 | 0.001 | Q | 14 | LAB503 | 0.86 | 0.014 | Q | 30 |
| LAB503 | 0.90 | 0.005 | G | 41 | LAB503 | 0.86 | 0.014 | Q | 26 |
| LAB503 | −0.89 | 0.017 | G | 10 | LAB503 | 0.86 | 0.014 | Q | 31 |
| LAB503 | 0.89 | 0.007 | Q | 41 | LAB503 | 0.86 | 0.014 | Q | 18 |
| LAB503 | 0.89 | 0.008 | G | 24 | LAB503 | 0.85 | 0.015 | G | 34 |
| LAB503 | 0.89 | 0.008 | Q | 22 | LAB503 | 0.85 | 0.015 | G | 14 |
| LAB503 | 0.88 | 0.009 | G | 31 | LAB503 | 0.84 | 0.005 | K | 34 |
| LAB503 | 0.88 | 0.009 | G | 26 | LAB503 | 0.84 | 0.018 | G | 37 |
| LAB503 | 0.88 | 0.009 | G | 30 | LAB503 | −0.83 | 0.043 | P | 37 |

TABLE 40-continued

Correlation between the expression level of selected LAB genes of some embodiments of the invention in various tissues and the phenotypic performance under normal conditions across maize accessions

| Gene Name | R | P | Exp. ID | Corr. ID | Gene Name | R | P | Exp. ID | Corr. ID |
|---|---|---|---|---|---|---|---|---|---|
| LAB503 | 0.88 | 0.010 | G | 22 | LAB503 | −0.82 | 0.012 | J | 37 |
| LAB503 | 0.87 | 0.010 | Q | 24 | LAB503 | 0.82 | 0.012 | K | 40 |
| LAB503 | 0.87 | 0.011 | G | 12 | LAB503 | 0.82 | 0.025 | Q | 20 |
| LAB503 | 0.87 | 0.012 | G | 8 | LAB503 | 0.81 | 0.026 | Q | 12 |
| LAB503 | 0.80 | 0.032 | G | 6 | LAB503 | 0.88 | 0.004 | B | 5 |
| LAB503 | 0.79 | 0.012 | K | 16 | LAB503 | −0.87 | 0.005 | E | 21 |
| LAB503 | 0.79 | 0.012 | K | 28 | LAB503 | −0.86 | 0.006 | E | 38 |
| LAB503 | −0.79 | 0.021 | J | 20 | LAB503 | 0.86 | 0.013 | A | 42 |
| LAB503 | 0.78 | 0.038 | Q | 37 | LAB503 | −0.86 | 0.006 | E | 13 |
| LAB503 | 0.72 | 0.028 | K | 31 | LAB503 | −0.85 | 0.007 | E | 17 |
| LAB503 | 0.72 | 0.028 | K | 26 | LAB503 | 0.85 | 0.016 | D | 1 |
| LAB503 | 0.72 | 0.028 | K | 30 | LAB503 | −0.85 | 0.008 | E | 32 |
| LAB503 | 0.71 | 0.031 | K | 6 | LAB503 | −0.85 | 0.008 | E | 25 |
| LAB503 | 0.71 | 0.032 | K | 8 | LAB503 | −0.85 | 0.008 | E | 29 |
| LAB503 | 0.71 | 0.034 | K | 41 | LAB503 | −0.84 | 0.009 | E | 11 |
| LAB503 | 0.96 | 0.001 | E | 9 | LAB503 | 0.84 | 0.019 | A | 25 |
| LAB503 | −0.94 | 0.005 | O | 11 | LAB503 | 0.84 | 0.019 | A | 29 |
| LAB503 | −0.93 | 0.007 | O | 17 | LAB503 | 0.84 | 0.019 | A | 32 |
| LAB503 | 0.92 | 0.001 | E | 7 | LAB503 | 0.83 | 0.020 | A | 38 |
| LAB503 | −0.92 | 0.001 | E | 15 | LAB503 | 0.83 | 0.020 | A | 17 |
| LAB503 | −0.92 | 0.001 | E | 27 | LAB503 | −0.83 | 0.021 | D | 9 |
| LAB503 | 0.91 | 2.08E−04 | C | 3 | LAB503 | −0.82 | 0.012 | E | 23 |
| LAB503 | −0.91 | 0.002 | E | 5 | LAB503 | 0.82 | 0.024 | A | 21 |
| LAB503 | −0.90 | 0.016 | O | 38 | LAB503 | 0.82 | 0.024 | A | 23 |
| LAB503 | 0.81 | 0.014 | B | 21 | LAB504 | −0.90 | 0.006 | G | 37 |
| LAB503 | 0.81 | 0.005 | C | 1 | LAB504 | −0.83 | 0.020 | Q | 36 |
| LAB503 | 0.81 | 0.015 | B | 32 | LAB504 | −0.82 | 0.024 | G | 8 |
| LAB503 | 0.81 | 0.015 | B | 25 | LAB504 | −0.81 | 0.027 | G | 24 |
| LAB503 | 0.81 | 0.015 | B | 29 | LAB504 | −0.81 | 0.028 | G | 31 |
| LAB503 | 0.81 | 0.028 | A | 11 | LAB504 | −0.81 | 0.028 | G | 26 |
| LAB503 | −0.79 | 0.033 | D | 7 | LAB504 | −0.81 | 0.028 | G | 30 |
| LAB503 | 0.79 | 0.019 | B | 23 | LAB504 | −0.79 | 0.035 | Q | 6 |
| LAB503 | 0.79 | 0.020 | B | 19 | LAB504 | −0.78 | 0.037 | G | 22 |
| LAB503 | −0.78 | 0.021 | E | 36 | LAB504 | 0.76 | 0.028 | H | 20 |
| LAB503 | 0.77 | 0.043 | A | 5 | LAB504 | −0.76 | 0.049 | G | 41 |
| LAB503 | −0.76 | 0.029 | E | 42 | LAB504 | 0.96 | 0.003 | O | 3 |
| LAB503 | −0.75 | 0.034 | E | 1 | LAB504 | 0.93 | 0.006 | O | 1 |
| LAB503 | 0.74 | 0.035 | B | 42 | LAB504 | 0.92 | 0.001 | F | 7 |
| LAB503 | −0.74 | 0.036 | F | 5 | LAB504 | 0.92 | 0.009 | O | 42 |
| LAB503 | 0.73 | 0.039 | B | 36 | LAB504 | 0.91 | 0.013 | O | 39 |
| LAB503 | −0.73 | 0.040 | E | 19 | LAB504 | 0.85 | 0.030 | O | 23 |
| LAB504 | 0.93 | 0.001 | H | 6 | LAB504 | 0.82 | 0.047 | O | 32 |
| LAB504 | 0.82 | 0.047 | O | 29 | LAB504 | 0.78 | 0.038 | D | 13 |
| LAB504 | 0.82 | 0.047 | O | 25 | LAB505 | 0.78 | 0.013 | N | 17 |
| LAB504 | 0.76 | 0.046 | F | 9 | LAB505 | 0.77 | 0.015 | N | 13 |
| LAB505 | 0.94 | 0.002 | L | 16 | LAB505 | 0.76 | 0.018 | N | 21 |
| LAB505 | 0.94 | 0.002 | L | 28 | LAB505 | 0.75 | 0.019 | N | 32 |
| LAB505 | −0.86 | 0.013 | G | 36 | LAB505 | 0.75 | 0.019 | N | 29 |
| LAB505 | −0.77 | 0.026 | J | 12 | LAB505 | 0.75 | 0.019 | N | 25 |
| LAB505 | 0.76 | 0.046 | Q | 14 | LAB505 | 0.75 | 0.020 | N | 11 |
| LAB505 | 0.96 | 0.003 | O | 9 | LAB505 | 0.74 | 0.022 | N | 42 |
| LAB505 | 0.93 | 3.08E−04 | N | 3 | LAB506 | 0.92 | 0.001 | H | 6 |
| LAB505 | −0.90 | 0.006 | A | 38 | LAB506 | 0.85 | 0.007 | J | 12 |
| LAB505 | −0.89 | 0.007 | A | 36 | LAB506 | −0.83 | 0.040 | P | 12 |
| LAB505 | 0.89 | 0.003 | E | 7 | LAB506 | 0.79 | 0.012 | M | 10 |
| LAB505 | 0.88 | 0.002 | N | 1 | LAB506 | 0.78 | 0.012 | K | 6 |
| LAB505 | −0.86 | 0.029 | O | 15 | LAB506 | −0.73 | 0.017 | M | 20 |
| LAB505 | −0.86 | 0.029 | O | 27 | LAB506 | 0.71 | 0.046 | H | 8 |
| LAB505 | 0.81 | 0.014 | N | 39 | LAB506 | 0.71 | 0.031 | K | 36 |
| LAB505 | −0.80 | 0.030 | D | 33 | LAB506 | 0.71 | 0.049 | K | 10 |
| LAB505 | −0.80 | 0.017 | B | 19 | LAB506 | 0.93 | 0.003 | A | 3 |
| LAB505 | 0.79 | 0.012 | N | 23 | LAB506 | 0.92 | 0.001 | B | 13 |
| LAB506 | 0.92 | 0.010 | A | 39 | LAB506 | 0.84 | 0.019 | D | 9 |
| LAB506 | 0.90 | 0.006 | A | 23 | LAB506 | 0.83 | 0.003 | C | 36 |
| LAB506 | 0.88 | 0.009 | A | 32 | LAB506 | 0.83 | 0.022 | A | 15 |
| LAB506 | 0.88 | 0.009 | A | 29 | LAB506 | 0.83 | 0.022 | A | 27 |
| LAB506 | 0.88 | 0.009 | A | 25 | LAB506 | −0.78 | 0.039 | D | 17 |
| LAB506 | 0.87 | 0.010 | A | 21 | LAB506 | 0.77 | 0.041 | A | 1 |
| LAB506 | −0.87 | 0.011 | D | 13 | LAB506 | 0.74 | 0.038 | B | 17 |
| LAB506 | 0.87 | 0.012 | A | 42 | LAB506 | 0.73 | 0.016 | C | 38 |
| LAB506 | 0.86 | 0.029 | O | 38 | LAB507 | −0.94 | 0.001 | Q | 20 |
| LAB506 | 0.86 | 0.007 | B | 38 | LAB507 | −0.93 | 0.002 | G | 41 |
| LAB506 | 0.85 | 0.007 | B | 27 | LAB507 | −0.93 | 0.001 | J | 36 |

TABLE 40-continued

Correlation between the expression level of selected LAB genes of some embodiments of the invention in various tissues and the phenotypic performance under normal conditions across maize accessions

| Gene Name | R | P | Exp. ID | Corr. ID | Gene Name | R | P | Exp. ID | Corr. ID |
|---|---|---|---|---|---|---|---|---|---|
| LAB506 | 0.85 | 0.007 | B | 15 | LAB507 | −0.92 | 0.004 | G | 31 |
| LAB506 | 0.85 | 0.004 | C | 9 | LAB507 | −0.92 | 0.004 | G | 26 |
| LAB506 | 0.84 | 0.002 | C | 7 | LAB507 | −0.92 | 0.004 | G | 30 |
| LAB506 | 0.84 | 0.036 | O | 5 | LAB507 | −0.91 | 0.004 | G | 22 |
| LAB507 | −0.91 | 0.004 | G | 8 | LAB507 | −0.85 | 0.004 | K | 8 |
| LAB507 | 0.90 | 0.013 | P | 12 | LAB507 | −0.84 | 0.017 | Q | 41 |
| LAB507 | −0.90 | 0.001 | K | 12 | LAB507 | −0.84 | 0.018 | Q | 22 |
| LAB507 | −0.90 | 0.006 | G | 24 | LAB507 | −0.84 | 0.018 | Q | 8 |
| LAB507 | −0.90 | 0.006 | Q | 34 | LAB507 | −0.83 | 0.010 | H | 20 |
| LAB507 | −0.89 | 0.007 | Q | 37 | LAB507 | −0.82 | 0.007 | K | 14 |
| LAB507 | −0.89 | 0.001 | K | 36 | LAB507 | −0.81 | 0.015 | H | 6 |
| LAB507 | −0.89 | 0.007 | G | 36 | LAB507 | −0.80 | 0.009 | K | 24 |
| LAB507 | −0.89 | 0.007 | G | 34 | LAB507 | −0.80 | 0.030 | Q | 24 |
| LAB507 | −0.88 | 0.008 | G | 6 | LAB507 | −0.78 | 0.013 | K | 6 |
| LAB507 | −0.88 | 0.009 | G | 37 | LAB507 | −0.78 | 0.038 | Q | 12 |
| LAB507 | −0.88 | 0.009 | G | 14 | LAB507 | −0.95 | 0.001 | A | 5 |
| LAB507 | −0.88 | 0.002 | K | 31 | LAB507 | −0.95 | 1.17E−04 | N | 27 |
| LAB507 | −0.88 | 0.002 | K | 26 | LAB507 | −0.95 | 1.17E−04 | N | 15 |
| LAB507 | −0.88 | 0.002 | K | 30 | LAB507 | −0.94 | 4.19E−04 | E | 27 |
| LAB507 | −0.88 | 0.009 | Q | 6 | LAB507 | −0.94 | 4.19E−04 | E | 15 |
| LAB507 | −0.87 | 0.002 | K | 37 | LAB507 | −0.94 | 2.05E−04 | N | 36 |
| LAB507 | −0.87 | 0.012 | G | 12 | LAB507 | −0.93 | 0.002 | A | 25 |
| LAB507 | −0.87 | 0.003 | K | 41 | LAB507 | −0.93 | 0.002 | A | 29 |
| LAB507 | −0.86 | 0.013 | Q | 30 | LAB507 | −0.93 | 0.002 | A | 32 |
| LAB507 | −0.86 | 0.013 | Q | 31 | LAB507 | −0.92 | 0.003 | A | 36 |
| LAB507 | −0.86 | 0.013 | Q | 26 | LAB507 | −0.92 | 0.004 | A | 27 |
| LAB507 | −0.85 | 0.015 | G | 18 | LAB507 | −0.92 | 0.004 | A | 15 |
| LAB507 | −0.85 | 0.004 | K | 34 | LAB507 | −0.91 | 0.005 | A | 21 |
| LAB507 | −0.85 | 0.004 | K | 18 | LAB507 | −0.90 | 0.006 | A | 42 |
| LAB507 | −0.85 | 0.004 | K | 22 | LAB507 | −0.90 | 0.002 | E | 5 |
| LAB507 | −0.90 | 0.003 | E | 36 | LAB507 | −0.85 | 0.002 | C | 36 |
| LAB507 | −0.89 | 0.007 | A | 23 | LAB507 | −0.84 | 0.005 | N | 21 |
| LAB507 | −0.89 | 0.001 | C | 27 | LAB507 | −0.83 | 0.011 | F | 27 |
| LAB507 | −0.89 | 0.001 | C | 15 | LAB507 | −0.83 | 0.011 | F | 15 |
| LAB507 | −0.88 | 0.008 | A | 13 | LAB507 | −0.83 | 0.006 | N | 42 |
| LAB507 | −0.88 | 0.002 | N | 5 | LAB507 | −0.83 | 0.011 | E | 25 |
| LAB507 | −0.88 | 0.001 | C | 25 | LAB507 | −0.83 | 0.011 | E | 29 |
| LAB507 | −0.88 | 0.001 | C | 29 | LAB507 | −0.83 | 0.011 | E | 32 |
| LAB507 | −0.88 | 0.001 | C | 32 | LAB507 | 0.83 | 0.042 | A | 9 |
| LAB507 | −0.88 | 0.001 | C | 21 | LAB507 | −0.82 | 0.012 | E | 42 |
| LAB507 | −0.88 | 0.001 | C | 17 | LAB507 | −0.82 | 0.007 | N | 23 |
| LAB507 | −0.87 | 0.001 | C | 42 | LAB507 | −0.81 | 0.014 | E | 21 |
| LAB507 | −0.87 | 0.001 | C | 13 | LAB507 | −0.80 | 0.010 | N | 17 |
| LAB507 | −0.86 | 0.001 | C | 23 | LAB507 | −0.80 | 0.006 | C | 5 |
| LAB507 | −0.86 | 0.012 | A | 17 | LAB507 | −0.80 | 0.018 | E | 23 |
| LAB507 | −0.86 | 0.003 | N | 25 | LAB507 | −0.79 | 0.011 | N | 13 |
| LAB507 | −0.86 | 0.003 | N | 29 | LAB507 | −0.77 | 0.015 | N | 38 |
| LAB507 | −0.86 | 0.003 | N | 32 | LAB507 | −0.77 | 0.025 | E | 17 |
| LAB507 | −0.86 | 0.014 | A | 11 | LAB507 | −0.75 | 0.031 | B | 27 |
| LAB507 | −0.86 | 0.007 | E | 13 | LAB507 | −0.75 | 0.031 | B | 15 |
| LAB507 | −0.74 | 0.035 | B | 13 | LAB508 | −0.76 | 0.045 | L | 26 |
| LAB507 | −0.74 | 0.023 | N | 11 | LAB508 | −0.76 | 0.045 | L | 31 |
| LAB507 | −0.74 | 0.024 | N | 33 | LAB508 | −0.76 | 0.048 | L | 6 |
| LAB507 | −0.73 | 0.039 | F | 36 | LAB508 | −0.74 | 0.015 | M | 36 |
| LAB507 | −0.72 | 0.020 | C | 11 | LAB508 | 0.73 | 0.041 | H | 24 |
| LAB507 | −0.71 | 0.047 | F | 38 | LAB508 | 0.72 | 0.044 | H | 31 |
| LAB507 | −0.71 | 0.048 | B | 38 | LAB508 | 0.72 | 0.044 | H | 26 |
| LAB507 | −0.71 | 0.049 | E | 11 | LAB508 | 0.72 | 0.044 | H | 30 |
| LAB508 | −0.94 | 0.005 | G | 10 | LAB508 | −0.70 | 0.024 | M | 12 |
| LAB508 | 0.91 | 0.005 | Q | 20 | LAB508 | 0.94 | 0.001 | B | 38 |
| LAB508 | 0.88 | 0.004 | H | 6 | LAB508 | 0.92 | 0.008 | O | 9 |
| LAB508 | 0.86 | 0.030 | P | 36 | LAB508 | 0.89 | 0.003 | B | 27 |
| LAB508 | 0.81 | 0.028 | Q | 37 | LAB508 | 0.89 | 0.003 | B | 15 |
| LAB508 | −0.81 | 0.028 | L | 12 | LAB508 | 0.89 | 0.019 | A | 39 |
| LAB508 | −0.80 | 0.033 | L | 41 | LAB508 | 0.89 | 0.008 | A | 3 |
| LAB508 | 0.78 | 0.037 | G | 4 | LAB508 | 0.88 | 0.004 | B | 13 |
| LAB508 | −0.78 | 0.038 | L | 18 | LAB508 | 0.87 | 0.010 | D | 5 |
| LAB508 | 0.78 | 0.023 | H | 8 | LAB508 | 0.87 | 0.010 | D | 38 |
| LAB508 | −0.77 | 0.045 | L | 22 | LAB508 | −0.84 | 0.008 | N | 9 |
| LAB508 | −0.76 | 0.045 | L | 30 | LAB508 | 0.83 | 0.005 | N | 1 |
| LAB508 | 0.83 | 0.021 | A | 23 | LAB509 | 0.84 | 0.018 | L | 20 |
| LAB508 | 0.83 | 0.022 | A | 42 | LAB509 | 0.83 | 0.021 | Q | 37 |
| LAB508 | 0.81 | 0.015 | B | 17 | LAB509 | 0.80 | 0.029 | Q | 34 |

TABLE 40-continued

Correlation between the expression level of selected LAB genes of some embodiments of the invention in various tissues and the phenotypic performance under normal conditions across maize accessions

| Gene Name | R | P | Exp. ID | Corr. ID | Gene Name | R | P | Exp. ID | Corr. ID |
|---|---|---|---|---|---|---|---|---|---|
| LAB508 | 0.81 | 0.028 | A | 29 | LAB509 | 0.80 | 0.031 | Q | 6 |
| LAB508 | 0.81 | 0.028 | A | 25 | LAB509 | 0.80 | 0.032 | Q | 36 |
| LAB508 | 0.81 | 0.028 | A | 32 | LAB509 | 0.78 | 0.023 | J | 6 |
| LAB508 | 0.80 | 0.017 | B | 5 | LAB509 | 0.77 | 0.041 | L | 37 |
| LAB508 | 0.79 | 0.012 | N | 11 | LAB509 | 0.77 | 0.026 | J | 24 |
| LAB508 | 0.78 | 0.013 | N | 3 | LAB509 | 0.77 | 0.044 | Q | 8 |
| LAB508 | 0.78 | 0.041 | A | 21 | LAB509 | 0.76 | 0.049 | Q | 31 |
| LAB508 | 0.77 | 0.024 | F | 17 | LAB509 | 0.76 | 0.049 | Q | 26 |
| LAB508 | 0.76 | 0.029 | F | 11 | LAB509 | 0.76 | 0.049 | Q | 30 |
| LAB508 | 0.75 | 0.033 | B | 21 | LAB509 | 0.87 | 0.025 | O | 36 |
| LAB508 | 0.75 | 0.020 | N | 17 | LAB509 | −0.86 | 0.028 | O | 13 |
| LAB508 | 0.75 | 0.033 | N | 39 | LAB509 | 0.83 | 0.042 | O | 33 |
| LAB508 | 0.74 | 0.035 | F | 13 | LAB509 | 0.83 | 0.012 | F | 33 |
| LAB508 | 0.71 | 0.047 | B | 25 | LAB509 | 0.82 | 0.025 | A | 33 |
| LAB508 | 0.71 | 0.047 | B | 32 | LAB509 | 0.80 | 0.018 | E | 33 |
| LAB508 | 0.71 | 0.047 | B | 29 | LAB509 | 0.80 | 0.032 | B | 9 |
| LAB509 | −0.85 | 0.007 | H | 6 | LAB509 | −0.78 | 0.024 | B | 1 |
| LAB509 | 0.76 | 0.028 | E | 13 | LAB510 | −0.94 | 0.002 | A | 27 |
| LAB509 | −0.76 | 0.030 | B | 13 | LAB510 | 0.85 | 0.031 | A | 9 |
| LAB509 | −0.74 | 0.036 | B | 11 | LAB510 | −0.85 | 0.015 | A | 25 |
| LAB509 | 0.73 | 0.016 | C | 38 | LAB510 | −0.85 | 0.015 | A | 32 |
| LAB510 | 0.95 | 0.004 | P | 12 | LAB510 | −0.85 | 0.015 | A | 29 |
| LAB510 | −0.95 | 0.001 | Q | 20 | LAB510 | −0.85 | 0.032 | A | 39 |
| LAB510 | −0.92 | 0.004 | Q | 37 | LAB510 | −0.85 | 0.016 | A | 23 |
| LAB510 | −0.88 | 0.010 | Q | 31 | LAB510 | −0.84 | 0.018 | A | 13 |
| LAB510 | −0.88 | 0.010 | Q | 30 | LAB510 | −0.84 | 0.018 | A | 21 |
| LAB510 | −0.88 | 0.010 | Q | 26 | LAB510 | −0.84 | 0.019 | A | 42 |
| LAB510 | −0.86 | 0.012 | Q | 8 | LAB510 | −0.82 | 0.022 | A | 5 |
| LAB510 | −0.85 | 0.015 | Q | 22 | LAB510 | −0.82 | 0.044 | O | 33 |
| LAB510 | −0.85 | 0.016 | Q | 24 | LAB510 | −0.78 | 0.039 | A | 1 |
| LAB510 | −0.84 | 0.019 | G | 37 | LAB510 | −0.78 | 0.040 | A | 3 |
| LAB510 | −0.83 | 0.020 | Q | 41 | LAB511 | −0.90 | 0.006 | G | 41 |
| LAB510 | −0.82 | 0.023 | G | 20 | LAB511 | 0.88 | 0.020 | P | 12 |
| LAB510 | −0.78 | 0.039 | Q | 6 | LAB511 | −0.88 | 0.009 | G | 22 |
| LAB510 | −0.77 | 0.041 | G | 6 | LAB511 | −0.88 | 0.010 | G | 14 |
| LAB510 | −0.76 | 0.046 | Q | 34 | LAB511 | −0.87 | 0.010 | G | 8 |
| LAB510 | −0.94 | 0.002 | A | 15 | LAB511 | −0.87 | 0.010 | G | 31 |
| LAB511 | −0.87 | 0.010 | G | 26 | LAB511 | −0.94 | 0.002 | A | 32 |
| LAB511 | −0.87 | 0.010 | G | 30 | LAB511 | −0.93 | 0.007 | O | 39 |
| LAB511 | −0.87 | 0.011 | G | 36 | LAB511 | −0.92 | 0.003 | A | 36 |
| LAB511 | −0.86 | 0.013 | G | 24 | LAB511 | −0.92 | 0.003 | A | 27 |
| LAB511 | 0.85 | 0.031 | G | 40 | LAB511 | −0.92 | 0.003 | A | 15 |
| LAB511 | −0.85 | 0.017 | G | 34 | LAB511 | −0.92 | 0.003 | A | 21 |
| LAB511 | −0.84 | 0.017 | G | 37 | LAB511 | −0.91 | 0.004 | A | 42 |
| LAB511 | 0.84 | 0.019 | Q | 34 | LAB511 | −0.91 | 0.005 | A | 23 |
| LAB511 | −0.84 | 0.019 | G | 12 | LAB511 | −0.90 | 0.005 | A | 13 |
| LAB511 | −0.83 | 0.022 | G | 6 | LAB511 | −0.89 | 0.016 | O | 5 |
| LAB511 | −0.82 | 0.025 | G | 18 | LAB511 | −0.88 | 0.009 | A | 17 |
| LAB511 | −0.81 | 0.026 | L | 2 | LAB511 | 0.88 | 0.021 | O | 9 |
| LAB511 | 0.80 | 0.031 | Q | 36 | LAB511 | −0.87 | 0.012 | A | 11 |
| LAB511 | −0.76 | 0.050 | L | 4 | LAB511 | 0.86 | 0.029 | A | 9 |
| LAB511 | 0.76 | 0.050 | Q | 6 | LAB511 | −0.84 | 0.017 | D | 17 |
| LAB511 | 0.73 | 0.026 | M | 10 | LAB511 | −0.82 | 0.047 | O | 11 |
| LAB511 | −0.72 | 0.044 | H | 20 | LAB511 | −0.82 | 0.047 | O | 1 |
| LAB511 | −0.95 | 0.001 | A | 5 | LAB511 | −0.82 | 0.048 | O | 38 |
| LAB511 | −0.94 | 0.002 | A | 25 | LAB511 | −0.78 | 0.041 | A | 33 |
| LAB511 | −0.94 | 0.002 | A | 29 | LAB512 | −0.95 | 0.001 | Q | 41 |
| LAB512 | −0.93 | 0.002 | G | 41 | LAB512 | −0.88 | 0.009 | G | 6 |
| LAB512 | −0.93 | 0.002 | Q | 8 | LAB512 | −0.88 | 0.009 | Q | 34 |
| LAB512 | −0.93 | 0.002 | Q | 22 | LAB512 | −0.88 | 0.009 | G | 14 |
| LAB512 | −0.93 | 0.002 | Q | 31 | LAB512 | −0.88 | 0.010 | G | 37 |
| LAB512 | −0.93 | 0.002 | Q | 26 | LAB512 | −0.87 | 0.010 | Q | 6 |
| LAB512 | −0.93 | 0.002 | Q | 30 | LAB512 | −0.87 | 0.005 | H | 12 |
| LAB512 | 0.93 | 0.008 | L | 40 | LAB512 | −0.87 | 0.011 | Q | 18 |
| LAB512 | −0.92 | 0.003 | G | 36 | LAB512 | −0.87 | 0.012 | Q | 36 |
| LAB512 | −0.92 | 0.003 | Q | 24 | LAB512 | −0.86 | 0.014 | Q | 12 |
| LAB512 | −0.91 | 0.004 | G | 22 | LAB512 | −0.86 | 0.014 | G | 12 |
| LAB512 | −0.91 | 0.004 | G | 31 | LAB512 | −0.85 | 0.015 | G | 18 |
| LAB512 | −0.91 | 0.004 | G | 26 | LAB512 | 0.84 | 0.017 | L | 4 |
| LAB512 | −0.91 | 0.004 | G | 30 | LAB512 | 0.74 | 0.036 | J | 12 |
| LAB512 | −0.91 | 0.004 | G | 8 | LAB512 | −0.95 | 0.001 | A | 5 |
| LAB512 | −0.90 | 0.006 | Q | 37 | LAB512 | −0.95 | 0.001 | A | 36 |
| LAB512 | −0.90 | 0.006 | Q | 14 | LAB512 | −0.94 | 0.001 | B | 36 |

TABLE 40-continued

Correlation between the expression level of selected LAB genes of some embodiments of the invention in various tissues and the phenotypic performance under normal conditions across maize accessions

| Gene Name | R | P | Exp. ID | Corr. ID | Gene Name | R | P | Exp. ID | Corr. ID |
|---|---|---|---|---|---|---|---|---|---|
| LAB512 | −0.90 | 0.006 | G | 24 | LAB512 | −0.93 | 0.001 | B | 27 |
| LAB512 | −0.89 | 0.007 | G | 34 | LAB512 | −0.93 | 0.001 | B | 15 |
| LAB512 | 0.89 | 0.018 | P | 12 | LAB512 | −0.91 | 0.004 | A | 27 |
| LAB512 | 0.89 | 0.008 | L | 20 | LAB512 | −0.91 | 0.004 | A | 15 |
| LAB512 | −0.90 | 0.006 | A | 25 | LAB512 | 0.85 | 0.034 | O | 33 |
| LAB512 | −0.90 | 0.006 | A | 29 | LAB512 | −0.85 | 0.016 | A | 13 |
| LAB512 | −0.90 | 0.006 | A | 32 | LAB512 | −0.84 | 0.008 | B | 21 |
| LAB512 | −0.89 | 0.018 | O | 13 | LAB512 | −0.83 | 0.011 | B | 23 |
| LAB512 | −0.87 | 0.004 | B | 5 | LAB512 | −0.83 | 0.006 | N | 5 |
| LAB512 | −0.87 | 0.011 | A | 21 | LAB512 | −0.82 | 0.007 | N | 13 |
| LAB512 | −0.87 | 0.002 | N | 17 | LAB512 | −0.81 | 0.027 | A | 11 |
| LAB512 | −0.86 | 0.006 | B | 25 | LAB512 | −0.81 | 0.015 | B | 17 |
| LAB512 | −0.86 | 0.006 | B | 29 | LAB512 | −0.81 | 0.028 | A | 17 |
| LAB512 | −0.86 | 0.006 | B | 32 | LAB512 | −0.81 | 0.016 | B | 13 |
| LAB512 | −0.86 | 0.013 | A | 42 | LAB512 | −0.81 | 0.016 | B | 38 |
| LAB512 | −0.85 | 0.007 | B | 42 | LAB512 | 0.79 | 0.033 | B | 9 |
| LAB512 | −0.85 | 0.015 | A | 23 | LAB512 | −0.79 | 0.011 | N | 21 |
| LAB512 | −0.77 | 0.016 | N | 32 | LAB512 | −0.79 | 0.007 | C | 1 |
| LAB512 | −0.77 | 0.016 | N | 29 | LAB513 | 0.76 | 0.050 | G | 12 |
| LAB512 | −0.77 | 0.016 | N | 25 | LAB513 | −0.74 | 0.037 | J | 22 |
| LAB512 | −0.76 | 0.018 | N | 42 | LAB513 | −0.74 | 0.037 | J | 8 |
| LAB512 | −0.75 | 0.019 | N | 23 | LAB513 | 0.70 | 0.035 | K | 34 |
| LAB512 | −0.75 | 0.033 | B | 33 | LAB513 | 0.92 | 0.003 | A | 27 |
| LAB512 | −0.74 | 0.035 | B | 11 | LAB513 | 0.92 | 0.003 | A | 15 |
| LAB512 | −0.73 | 0.026 | N | 36 | LAB513 | 0.86 | 0.013 | A | 13 |
| LAB512 | −0.70 | 0.035 | N | 27 | LAB513 | −0.84 | 0.036 | O | 5 |
| LAB512 | −0.70 | 0.035 | N | 15 | LAB513 | 0.84 | 0.018 | A | 25 |
| LAB513 | 0.92 | 0.010 | Q | 10 | LAB513 | 0.84 | 0.018 | A | 29 |
| LAB513 | −0.89 | 0.018 | P | 4 | LAB513 | 0.84 | 0.018 | A | 32 |
| LAB513 | −0.85 | 0.007 | J | 4 | LAB513 | 0.84 | 0.019 | A | 21 |
| LAB513 | −0.84 | 0.009 | J | 41 | LAB513 | 0.83 | 0.010 | E | 27 |
| LAB513 | −0.81 | 0.016 | K | 40 | LAB513 | 0.83 | 0.010 | E | 15 |
| LAB513 | −0.80 | 0.016 | H | 6 | LAB513 | 0.81 | 0.028 | A | 23 |
| LAB513 | 0.80 | 0.030 | Q | 20 | LAB513 | 0.79 | 0.033 | A | 36 |
| LAB513 | −0.80 | 0.017 | J | 30 | LAB513 | 0.78 | 0.038 | A | 38 |
| LAB513 | −0.80 | 0.017 | J | 26 | LAB513 | 0.77 | 0.009 | C | 38 |
| LAB513 | −0.80 | 0.017 | J | 31 | LAB513 | 0.76 | 0.049 | A | 42 |
| LAB513 | 0.76 | 0.049 | G | 34 | LAB513 | −0.73 | 0.041 | E | 1 |
| LAB513 | 0.72 | 0.044 | B | 19 | LAB609 | 0.73 | 0.026 | K | 31 |
| LAB609 | 0.94 | 0.005 | G | 40 | LAB609 | 0.73 | 0.026 | K | 30 |
| LAB609 | 0.88 | 0.004 | K | 40 | LAB609 | 0.73 | 0.026 | K | 26 |
| LAB609 | 0.86 | 0.014 | G | 2 | LAB609 | 0.70 | 0.035 | K | 37 |
| LAB609 | −0.84 | 0.038 | P | 36 | LAB609 | 0.70 | 0.036 | K | 6 |
| LAB609 | 0.83 | 0.043 | P | 12 | LAB609 | −0.94 | 0.005 | O | 19 |
| LAB609 | 0.81 | 0.008 | K | 24 | LAB609 | 0.90 | 0.001 | N | 13 |
| LAB609 | 0.81 | 0.026 | G | 4 | LAB609 | 0.84 | 0.005 | N | 17 |
| LAB609 | 0.77 | 0.016 | K | 22 | LAB609 | −0.82 | 0.024 | A | 19 |
| LAB609 | −0.76 | 0.028 | K | 10 | LAB609 | 0.78 | 0.008 | C | 1 |
| LAB609 | 0.74 | 0.023 | K | 8 | | | | | |

Table 40.
"Corr. ID"—correlation set ID according to the correlated parameters Table above.
"Exp. Set"—Expression set.
"R" = Pearson correlation coefficient;
"P" = p value.

Example 7

Production of Barley Transcriptom and High Throughput Correlation Analysis Using 44K Barley Oligonucleotide Micro-Array In order to produce a high throughput correlation analysis comparing between plant phenotype and gene expression level under normal conditions, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—Five tissues at different developmental stages [meristem, flower, booting spike, stem and flag leaf], representing different plant characteristics, were sampled and RNA was extracted as described above. Each micro-array expression information tissue type has received a Set ID as summarized in Table 41 below.

TABLE 41

Barley transcriptom expression sets

| Expression Set | Set ID |
| --- | --- |
| Meristem | A |
| Flower | B |
| Booting spike | C |
| Stem | D |
| Flag leaf | E |

Table 41.
Provided are the Barley transcriptom expression sets.

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 42, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 [Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 42

Barley standard descriptors

| Trait | Parameter | Range | Description |
| --- | --- | --- | --- |
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 42.

Grains per spike—At the end of the experiment (50% of the spikes were dry) all spikes from plots within blocks A-D were collected. The total number of grains from 5 spikes that were manually threshed was counted. The average grain per spike is calculated by dividing the total grain number by the number of spikes.

Grain average size (cm)—At the end of the experiment (50% of the spikes were dry) all spikes from plots within blocks A-D were collected. The total grains from 5 spikes that were manually threshed were scanned and images were analyzed using the to digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D were collected. The total grains from 5 spikes that were manually threshed were counted and weight. The average weight was calculated by dividing the total weight by the total grain number. "Mgr"=milligrams.

Grain yield per spike (gr.)—At the end of the experiment (50% of the spikes were dry) all spikes from plots within blocks A-D were collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D were collected. The five chosen spikes per plant were measured using measuring tape excluding the awns.

Spike number analysis—At the end of the experiment (50% of the spikes were dry) all spikes from plots within blocks A-D were collected. The spikes per plant were counted.

Growth habit scoring—At the growth stage 10 (booting), each of the plants was scored for its growth habit nature. The scale that was used was 1 for prostate nature till 9 for erect.

Hairiness of basal leaves—At the growth stage 5 (leaf sheath strongly erect; end of tillering), each of the plants was scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr.) after drying at 30° C. in oven for 48 hours.

Harvest Index (for barley)—The harvest index is calculated using Formula X.

Harvest Index=Average spike dry weight per plant/ (Average vegetative dry weight per plant+Average spike dry weight per plant).     Formula X

TABLE 43

Barley correlated parameters (vectors)

| Correlation set | Correlation ID |
|---|---|
| Grains per spike (numbers) | 1 |
| Grains size (mm$^2$) | 2 |
| Grain weight (milligrams) | 3 |
| Grain Yield per spike (gr./spike) | 4 |
| Spike length (cm) | 5 |
| Spikes per plant (numbers) | 6 |
| Growth habit (scores 1-9) | 7 |
| Hairiness of basal leaves (scoring 1-2) | 8 |
| Plant height (cm) | 9 |
| Days to flowering (days) | 10 |
| Stem pigmentation (scoring 1-5) | 11 |
| Vegetative dry weight (gram) | 12 |
| Harvest Index (ratio) | 13 |

Table 43.
Provided are the barley correlated parameters.
"mm$^2$" square millimeters;
"gr." = Grams;
"cm" = centimeters;

Experimental Results 13 different Barley accessions were grown and characterized for 13 parameters as described above. The average for each of the measured parameter was calculated using the JMP software and values are summarized in Tables 44-45 below. Subsequent correlation analysis between the various transcriptom sets (Table 41) and the measured parameters (Tables 44-45) was conducted (Table 46). Follow, results were integrated to to the database.

TABLE 44

Measured parameters of correlation IDs in Barley accessions

| Accession/Parameter | 6 | 10 | 3 | 5 | 2 | 1 | 7 |
|---|---|---|---|---|---|---|---|
| Amatzya | 48.85 | 62.40 | 35.05 | 12.04 | 0.27 | 20.23 | 2.60 |
| Ashqelon | 48.27 | 64.08 | 28.06 | 10.93 | 0.23 | 17.98 | 2.00 |
| Canada park | 37.42 | 65.15 | 28.76 | 11.83 | 0.24 | 17.27 | 1.92 |
| Havarim stream | 61.92 | 58.92 | 17.87 | 9.90 | 0.17 | 17.73 | 3.17 |
| Jordan est | 33.27 | 63.00 | 41.22 | 11.68 | 0.29 | 14.47 | 4.33 |
| Klil | 41.69 | 70.54 | 29.73 | 11.53 | 0.28 | 16.78 | 2.69 |
| Maale Efraim | ND | 52.80 | 25.22 | 8.86 | 0.22 | 13.47 | 3.60 |
| Mt Arbel | 40.63 | 60.88 | 34.99 | 11.22 | 0.28 | 14.07 | 3.50 |
| Mt Harif | 62.00 | 58.10 | 20.58 | 11.11 | 0.19 | 21.54 | 3.00 |
| Neomi | 49.33 | 53.00 | 27.50 | 8.58 | 0.22 | 12.10 | 3.67 |
| Neot Kdumim | 50.60 | 60.40 | 37.13 | 10.18 | 0.27 | 14.36 | 2.47 |
| Oren canyon | 43.09 | 64.58 | 29.56 | 10.51 | 0.27 | 15.28 | 3.50 |
| Yeruham | 51.40 | 56.00 | 19.58 | 9.80 | 0.18 | 17.07 | 3.00 |

Table 44.
Provided are the values of each of the parameters measured in Barley accessions according to the following correlation identifications (Correlation Ids):
6 = Spikes per plant;
10 = Days to flowering;
3 = Grain weight;
5 = Spike length;
2 = Grains Size;
1 = Grains per spike;
7 = Growth habit.

TABLE 45

Barley accessions, additional measured parameters

| Accession/Parameter | 8 | 9 | 4 | 11 | 12 | 13 |
|---|---|---|---|---|---|---|
| Amatzya | 1.53 | 134.27 | 3.56 | 1.13 | 78.87 | 0.45 |
| Ashqelon | 1.33 | 130.50 | 2.54 | 2.50 | 66.14 | 0.42 |
| Canada park | 1.69 | 138.77 | 2.58 | 1.69 | 68.49 | 0.40 |
| Havarim stream | 1.08 | 114.58 | 1.57 | 1.75 | 53.39 | 0.44 |
| Jordan est | 1.42 | 127.75 | 3.03 | 2.33 | 68.30 | 0.43 |
| Klil | 1.69 | 129.38 | 2.52 | 2.31 | 74.17 | 0.40 |
| Maale Efraim | 1.30 | 103.89 | 1.55 | 1.70 | 35.35 | 0.52 |
| Mt Arbel | 1.19 | 121.63 | 2.62 | 2.19 | 58.33 | 0.48 |
| Mt Harif | 1.00 | 126.80 | 2.30 | 2.30 | 62.23 | 0.44 |
| Neomi | 1.17 | 99.83 | 1.68 | 1.83 | 38.32 | 0.49 |
| Neot Kdumim | 1.60 | 121.40 | 2.68 | 3.07 | 68.31 | 0.45 |
| Oren canyon | 1.08 | 118.42 | 2.35 | 1.58 | 56.15 | ND |
| Yeruham | 1.17 | 117.17 | 1.67 | 2.17 | 42.68 | ND |

Table 45.
Provided are the values of each of the parameters measured in Barley accessions according to the following correlation identifications (Correlation Ids):
8 = Hairiness of basal leaves;
9 = Plant height;
4 = Grain yield per spike;
11 = Stem pigmentation;
12 = Vegetative dry weight;
13 = Harvest Index.

TABLE 46

Correlation between the expression level of selected LAB genes of some embodiments of the invention in various tissues and the phenotypic performance under normal fertilization conditions across barley accessions

| Gene Name | R | P value | Exp. Set | Corr. ID | Gene Name | R | P value | Exp. Set | Corr. ID |
|---|---|---|---|---|---|---|---|---|---|
| LAB390 | 0.81 | 0.007 | C | 7 | LAB402 | 0.71 | 0.047 | A | 6 |
| LAB390 | -0.73 | 0.041 | B | 8 | LAB403 | 0.93 | 2.74E-04 | A | 2 |
| LAB390 | -0.72 | 0.042 | B | 2 | LAB403 | 0.89 | 0.001 | A | 3 |
| LAB390 | -0.71 | 0.050 | B | 3 | LAB403 | -0.83 | 0.011 | A | 6 |
| LAB391 | -0.83 | 0.010 | B | 1 | LAB403 | 0.78 | 0.004 | A | 4 |
| LAB391 | -0.81 | 0.008 | C | 12 | LAB404 | 0.86 | 0.003 | C | 2 |
| LAB391 | -0.78 | 0.008 | B | 12 | LAB404 | 0.83 | 0.005 | C | 3 |
| LAB391 | -0.78 | 0.014 | A | 12 | LAB410 | 0.91 | 0.002 | B | 1 |
| LAB391 | -0.75 | 0.008 | A | 10 | LAB410 | 0.73 | 0.024 | C | 1 |
| LAB391 | -0.72 | 0.043 | B | 9 | LAB410 | 0.72 | 0.012 | C | 5 |
| LAB391 | -0.71 | 0.021 | B | 5 | LAB410 | 0.70 | 0.017 | C | 9 |
| LAB391 | -0.71 | 0.034 | A | 5 | LAB412 | 0.83 | 0.006 | C | 2 |
| LAB392 | 0.88 | 0.004 | A | 6 | LAB412 | 0.81 | 0.008 | C | 3 |
| LAB392 | -0.84 | 0.001 | A | 2 | LAB412 | 0.79 | 0.012 | C | 4 |
| LAB392 | -0.74 | 0.010 | A | 3 | LAB412 | 0.76 | 0.029 | B | 11 |
| LAB402 | 0.93 | 2.75E-04 | C | 3 | LAB413 | 0.84 | 0.009 | A | 6 |

TABLE 46-continued

Correlation between the expression level of selected LAB genes of some embodiments of the invention in various tissues and the phenotypic performance under normal fertilization conditions across barley accessions

| Gene Name | R | P value | Exp. Set | Corr. ID | Gene Name | R | P value | Exp. Set | Corr. ID |
|---|---|---|---|---|---|---|---|---|---|
| LAB402 | 0.91 | 0.001 | C | 2 | LAB415 | 0.79 | 0.004 | C | 2 |
| LAB402 | 0.80 | 0.017 | B | 7 | LAB415 | −0.76 | 0.029 | C | 6 |
| LAB402 | 0.79 | 0.004 | C | 4 | LAB415 | 0.75 | 0.008 | C | 3 |
| LAB402 | −0.72 | 0.027 | A | 8 | LAB415 | 0.73 | 0.011 | A | 9 |
| LAB417 | 0.76 | 0.029 | A | 6 | LAB421 | −0.75 | 0.021 | A | 2 |
| LAB417 | 0.71 | 0.020 | B | 2 | LAB421 | 0.74 | 0.021 | A | 1 |
| LAB418 | −0.77 | 0.016 | A | 7 | LAB421 | −0.74 | 0.023 | A | 3 |
| LAB418 | 0.76 | 0.011 | B | 2 | LAB421 | 0.70 | 0.016 | C | 12 |
| LAB418 | 0.75 | 0.021 | C | 2 | LAB423 | 0.86 | 0.003 | A | 2 |
| LAB418 | 0.74 | 0.035 | A | 6 | LAB423 | −0.85 | 0.007 | A | 6 |
| LAB418 | 0.73 | 0.038 | B | 3 | LAB423 | 0.85 | 0.002 | B | 2 |
| LAB418 | 0.70 | 0.034 | A | 10 | LAB423 | 0.85 | 0.002 | B | 3 |
| LAB418 | 0.70 | 0.038 | C | 3 | LAB423 | 0.84 | 0.005 | A | 3 |
| LAB419 | −0.87 | 0.005 | B | 11 | LAB423 | −0.83 | 0.011 | C | 6 |
| LAB419 | −0.84 | 0.005 | A | 2 | LAB423 | 0.75 | 0.032 | B | 8 |
| LAB419 | 0.82 | 0.012 | A | 6 | LAB423 | −0.75 | 0.021 | A | 12 |
| LAB419 | −0.80 | 0.010 | A | 3 | LAB423 | −0.73 | 0.038 | B | 1 |
| LAB419 | −0.71 | 0.031 | C | 8 | LAB424 | 0.86 | 0.003 | C | 8 |
| LAB420 | 0.88 | 0.004 | A | 6 | LAB424 | 0.80 | 0.009 | C | 4 |
| LAB420 | −0.77 | 0.005 | A | 2 | LAB424 | 0.78 | 0.014 | C | 2 |
| LAB421 | −0.83 | 0.005 | C | 7 | LAB424 | 0.75 | 0.021 | C | 3 |
| LAB421 | 0.76 | 0.045 | B | 6 | LAB424 | 0.71 | 0.034 | C | 12 |
| LAB421 | −0.76 | 0.027 | B | 1 | LAB425 | 0.74 | 0.014 | B | 2 |
| LAB421 | −0.75 | 0.013 | B | 12 | LAB425 | 0.70 | 0.025 | B | 3 |
| LAB430 | 0.73 | 0.010 | C | 5 | LAB435 | 0.79 | 0.034 | B | 6 |
| LAB431 | −0.84 | 0.010 | B | 12 | LAB435 | −0.74 | 0.035 | B | 8 |
| LAB431 | −0.81 | 0.014 | A | 6 | LAB437 | 0.82 | 0.012 | C | 6 |
| LAB431 | −0.78 | 0.022 | B | 10 | LAB437 | 0.77 | 0.025 | B | 7 |
| LAB431 | 0.75 | 0.007 | A | 5 | LAB437 | 0.74 | 0.023 | C | 1 |
| LAB431 | −0.75 | 0.032 | B | 9 | LAB438 | 0.86 | 0.003 | C | 3 |
| LAB431 | 0.73 | 0.024 | C | 8 | LAB438 | 0.83 | 0.005 | C | 2 |
| LAB431 | −0.72 | 0.028 | C | 5 | LAB439 | −0.80 | 0.018 | A | 6 |
| LAB431 | −0.71 | 0.048 | B | 1 | LAB439 | 0.75 | 0.008 | A | 2 |
| LAB431 | −0.71 | 0.049 | B | 5 | LAB439 | 0.74 | 0.022 | C | 8 |
| LAB431 | 0.70 | 0.016 | A | 4 | LAB439 | −0.74 | 0.036 | C | 6 |
| LAB432 | 0.82 | 0.007 | A | 3 | LAB444 | 0.72 | 0.027 | C | 11 |
| LAB432 | 0.79 | 0.012 | A | 2 | LAB444 | −0.72 | 0.044 | B | 10 |
| LAB432 | −0.77 | 0.026 | A | 6 | LAB445 | −0.88 | 0.004 | B | 5 |
| LAB433 | −0.84 | 0.005 | A | 10 | LAB445 | 0.81 | 0.015 | A | 6 |
| LAB433 | 0.78 | 0.024 | A | 6 | LAB445 | −0.80 | 0.016 | B | 4 |
| LAB433 | −0.73 | 0.025 | A | 5 | LAB445 | −0.78 | 0.021 | B | 9 |
| LAB433 | −0.73 | 0.027 | C | 8 | LAB445 | −0.72 | 0.042 | B | 10 |
| LAB434 | −0.78 | 0.014 | A | 9 | LAB445 | −0.72 | 0.045 | B | 12 |
| LAB434 | −0.71 | 0.034 | C | 8 | LAB445 | −0.70 | 0.037 | C | 11 |
| LAB446 | 0.75 | 0.020 | C | 1 | LAB453 | 0.77 | 0.026 | A | 6 |
| LAB446 | −0.74 | 0.009 | C | 2 | LAB453 | −0.76 | 0.006 | C | 10 |
| LAB446 | −0.73 | 0.010 | C | 3 | LAB453 | −0.76 | 0.007 | C | 9 |
| LAB446 | −0.72 | 0.029 | A | 10 | LAB453 | −0.73 | 0.011 | C | 12 |
| LAB446 | −0.71 | 0.033 | A | 12 | LAB454 | 0.80 | 0.010 | C | 8 |
| LAB446 | −0.71 | 0.033 | A | 9 | LAB455 | −0.89 | 0.003 | A | 6 |
| LAB446 | 0.70 | 0.017 | C | 6 | LAB455 | 0.85 | 0.004 | A | 2 |
| LAB447 | 0.89 | 0.003 | A | 6 | LAB455 | 0.83 | 0.005 | A | 4 |
| LAB448 | −0.74 | 0.037 | B | 11 | LAB455 | 0.83 | 0.002 | A | 3 |
| LAB448 | 0.73 | 0.039 | A | 6 | LAB455 | −0.82 | 0.014 | B | 3 |
| LAB451 | −0.78 | 0.014 | A | 5 | LAB455 | −0.74 | 0.036 | B | 2 |
| LAB451 | 0.74 | 0.037 | B | 11 | LAB455 | 0.73 | 0.026 | A | 12 |
| LAB451 | −0.73 | 0.024 | C | 10 | LAB455 | 0.70 | 0.036 | C | 8 |
| LAB452 | 0.80 | 0.016 | A | 6 | LAB456 | 0.88 | 3.88E−04 | A | 6 |
| LAB452 | −0.73 | 0.025 | A | 2 | LAB456 | 0.82 | 0.004 | B | 7 |
| LAB453 | −0.90 | 0.001 | C | 2 | LAB456 | −0.75 | 0.007 | A | 2 |
| LAB453 | −0.86 | 0.003 | C | 3 | LAB457 | −0.78 | 0.013 | C | 2 |
| LAB453 | 0.84 | 0.009 | C | 6 | LAB457 | −0.72 | 0.027 | C | 3 |
| LAB453 | −0.80 | 0.010 | C | 4 | LAB459 | 0.76 | 0.029 | A | 6 |
| LAB453 | −0.77 | 0.006 | C | 5 | LAB460 | −0.88 | 0.004 | A | 6 |
| LAB460 | 0.86 | 0.001 | A | 2 | LAB466 | 0.79 | 0.004 | C | 6 |
| LAB460 | 0.79 | 0.019 | B | 8 | LAB466 | −0.76 | 0.028 | B | 2 |
| LAB460 | 0.77 | 0.005 | A | 3 | LAB466 | −0.75 | 0.019 | C | 2 |
| LAB460 | 0.76 | 0.010 | B | 10 | LAB466 | −0.73 | 0.039 | B | 3 |
| LAB461 | 0.84 | 0.005 | C | 4 | LAB466 | −0.71 | 0.032 | C | 3 |
| LAB461 | 0.83 | 0.002 | C | 9 | LAB466 | −0.71 | 0.033 | A | 2 |
| LAB461 | 0.81 | 0.003 | C | 5 | LAB467 | 0.85 | 0.004 | C | 2 |
| LAB461 | 0.79 | 0.012 | C | 12 | LAB467 | 0.83 | 0.006 | C | 3 |
| LAB461 | 0.73 | 0.011 | A | 9 | LAB468 | −0.85 | 0.003 | A | 2 |

TABLE 46-continued

Correlation between the expression level of selected LAB genes of some embodiments of the invention in various tissues and the phenotypic performance under normal fertilization conditions across barley accessions

| Gene Name | R | P value | Exp. Set | Corr. ID | Gene Name | R | P value | Exp. Set | Corr. ID |
|---|---|---|---|---|---|---|---|---|---|
| LAB461 | 0.73 | 0.027 | A | 10 | LAB468 | 0.85 | 0.001 | C | 1 |
| LAB462 | −0.88 | 0.002 | A | 9 | LAB468 | −0.81 | 0.008 | A | 3 |
| LAB462 | −0.88 | 0.002 | A | 12 | LAB468 | 0.79 | 0.020 | B | 1 |
| LAB462 | −0.86 | 0.003 | A | 10 | LAB468 | 0.76 | 0.027 | A | 6 |
| LAB462 | −0.84 | 0.004 | A | 5 | LAB469 | 0.88 | 0.004 | A | 6 |
| LAB462 | −0.78 | 0.013 | A | 4 | LAB469 | −0.71 | 0.015 | A | 2 |
| LAB463 | −0.72 | 0.018 | B | 7 | LAB470 | 0.91 | 0.002 | A | 6 |
| LAB463 | 0.70 | 0.023 | B | 9 | LAB470 | −0.81 | 0.008 | C | 7 |
| LAB464 | 0.88 | 0.004 | A | 6 | LAB472 | −0.81 | 0.015 | B | 1 |
| LAB466 | 0.85 | 0.008 | A | 6 | LAB472 | 0.80 | 0.016 | B | 7 |
| LAB466 | −0.82 | 0.013 | B | 8 | LAB472 | −0.75 | 0.032 | B | 9 |
| LAB472 | −0.74 | 0.034 | B | 10 | LAB473 | 0.70 | 0.017 | C | 4 |
| LAB472 | −0.72 | 0.042 | B | 12 | LAB474 | 0.84 | 0.004 | C | 8 |
| LAB472 | 0.71 | 0.014 | A | 6 | LAB474 | 0.79 | 0.019 | B | 11 |
| LAB473 | 0.81 | 0.003 | C | 5 | LAB474 | −0.79 | 0.021 | C | 6 |
| LAB473 | 0.79 | 0.004 | C | 9 | LAB478 | 0.82 | 0.007 | C | 8 |
| LAB473 | 0.78 | 0.004 | C | 12 | LAB478 | 0.79 | 0.004 | A | 2 |
| LAB473 | 0.71 | 0.015 | C | 10 | LAB478 | 0.71 | 0.014 | A | 3 |

Table 46.
"Corr. ID"—correlation set ID according to the correlated parameters Table above.
"Exp. Set"—Expression set.
"R" = Pearson correlation coefficient;
"P" = p value.

Example 8

Production of Barley Transcriptom and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60K Barley genes and to transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—Four tissues at different developmental stages [leaf, meristem, root tip and adventitious root], representing different plant characteristics, were sampled and RNA was extracted as described above. Each micro-array expression information tissue type has received a Set ID as summarized in Table 47 below.

TABLE 47

Barley transcriptom expression sets

| Expression Set | Set ID |
|---|---|
| Leaf/drought/reproductive | A |
| Leaf/drought/vegetative | B |
| Leaf/low N/TP3 | C |
| Leaf/normal/TP3 | D |
| Root tip/low N/TP3 | E |
| Root tip/normal/TP3 | F |
| Root tip/drought/vegetative | G |
| Root tip/recovery drought/vegetative | H |
| Adv root/low N/TP3 | I |
| Adv root/normal/TP3 | J |
| Meristem/drought/vegetative | K |
| Booting spike/drought/reproductive | L |
| Booting spike/low N/reproductive | M |
| Booting spike/normal/reproductive | N |
| Leaf/normal/reproductive | O |
| Leaf/low N/reproductive | P |
| Stem/normal/reproductive | Q |
| Stem/low N/reproductive | R |

Table 47.
Provided are the barley transcriptome expression sets.

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting (as recommended for commercial growth, normal growth conditions which included irrigation 2-3 times a week, and fertilization given in the first 1.5 months of the growth period), or under low Nitrogen (80% percent less Nitrogen) or under drought stress (cycles of drought and re-irrigating were conducted throughout the whole experiment, overall 40% less water were given in the drought treatment). Plants were phenotyped on a daily basis following the parameters listed in Table 48 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—The Root/Shoot Ratio is calculated using Formula XI.

> Root/Shoot Ratio=total weight of the root at harvest/ total weight of the vegetative portion above ground at harvest. Formula XI Total No. of tillers—all tillers were counted per plot at two time points at the Vegetative growth (30 days after sowing) and at harvest.

Percent of reproductive tillers—the number of reproductive tillers barring a spike at harvest was divided by the total numbers o tillers.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area ($cm^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Harvest Index (for barley)—The harvest index is calculated using Formula X above.

Relative growth rate: the relative growth rate (RGR) of Plant Height (Formula V above), SPAD (Formula XII) and number of tillers (Formula XIII) are calculated as follows:

> Relative growth rate of SPAD=Regression coefficient of SPAD measurements along time course. Formula XII > Relative growth rate of Number of tillers=Regression coefficient of Number of tillers along time course. Formula XIII RATIO Drought/Normal: Represent ratio for the specified parameter of Drought condition results divided by Normal conditions results (maintenance of phenotype under drought in comparison to normal conditions).

TABLE 48

Barley correlated parameters (vectors)

| Correlation set | Correlation ID |
|---|---|
| Lateral roots per plant vegetative [number] Drought | 1 |
| Lateral roots per plant at TP3 [number] Low N | 2 |
| Lateral roots per plant at TP3 [number] Normal | 3 |
| Lateral roots per plant vegetative [number] RATIO Drought/normal | 4 |
| Root DW per plant [gr.]/Shoot DW [gr.] per plant Drought | 5 |
| Root DW per plant [gr.]/Shoot DW [gr.] per plant RATIO Drought/normal | 6 |
| Root DW per plant vegetative stage [gr.] Drought | 7 |
| Root DW per plant vegetative stage [gr.] RATIO Drought/normal | 8 |
| Root FW per plant vegetative stage [gr.] Drought | 9 |
| Root FW per plant at vegetative stage [gr.] Low N | 10 |
| Root FW per plant at vegetative stage [gr.] Normal | 11 |
| Root FW per plant vegetative stage [gr.] RATIO Drought/normal | 12 |
| Root length per plant vegetative [cm] Drought | 13 |
| Root length per plant at vegetative stage [cm] Low N | 14 |
| Root length per plant at vegetative stage [cm] Normal | 15 |
| Root length per plant vegetative [cm] RATIO Drought/normal | 16 |
| Leaf Area at TP4 [$cm^2$] Low N | 17 |
| Leaf Area at TP4 [$cm^2$] Normal | 18 |
| Leaf maximal length at TP4 [mm] Low N | 19 |
| Leaf maximal length at TP4 [mm] Normal | 20 |
| Leaf maximal width at TP4 [mm] Low N | 21 |
| Leaf maximal width at TP4 [mm] Normal | 22 |
| Number of leaves per plant at TP4 [number] Low N | 23 |
| Number of leaves per plant at TP4 [number] Normal | 24 |
| Shoot DW at vegetative stage [gr.] Drought | 25 |

TABLE 48-continued

Barley correlated parameters (vectors)

| Correlation set | Correlation ID |
|---|---|
| Shoot DW at vegetative stage [gr.] RATIO Drought/normal | 26 |
| Shoot DW at harvest per plant [gr.] Drought | 27 |
| Shoot DW at harvest per plant [gr.] Drought RATIO Drought/normal | 28 |
| Shoot FW per plant at harvest [gr.] Drought | 29 |
| Shoot FW per plant at vegetative stage [gr.] Normal | 30 |
| Shoot FW per plant at harvest [gr.] RATIO Drought/normal | 31 |
| Shoot FW per plant at vegetative stage [gr.] Low N | 32 |
| Chlorophyll level vegetative stage [SPAD] Drought | 33 |
| Chlorophyll level at vegetative stage [SPAD] Normal | 34 |
| Chlorophyll level at vegetative stage [SPAD] RATIO Drought/normal | 35 |
| Chlorophyll level at vegetative stage [SPAD] Low N | 36 |
| RGR by chlorophyll levels Drought | 37 |
| RGR by chlorophyll levels vegetative stage RATIO Drought/normal | 38 |
| Shoot DW at harvest [gr.] Normal | 39 |
| Plant height per plant at vegetative stage [cm] Low N | 40 |
| Plant height per plot at harvest [cm] Drought | 41 |
| Plant height per plot at harvest [cm] Normal | 42 |
| Plant height per plot at harvest [cm] RATIO Drought/normal | 43 |
| Plant height per plot at harvest [cm] Low N | 44 |
| RGR by plant height Drought | 45 |
| Relative water content vegetative [percent] Drought | 46 |
| Relative water content vegetative stage [percent] RATIO Drought/normal | 47 |
| Tillers per plant at vegetative stage [number] Low N | 48 |
| Tillers per plant at vegetative stage [number] Normal | 49 |
| Tillers per plant at harvest [number] Drought | 50 |
| Tillers per plot at harvest [number] Normal | 51 |
| Tillers per plot at harvest [number] RATIO Drought/normal | 52 |
| Tillers per plot at harvest [number] Low N | 53 |
| Harvest index [number] Drought | 54 |
| Harvest index [number] RATIO Drought/normal | 55 |
| Spike length [cm] Drought | 56 |
| Spike length [cm] Normal | 57 |
| Spike length [cm] RATIO Drought/normal | 58 |
| Spike length [cm] Low N | 59 |
| Spike width [mm] Drought | 60 |
| Spike width [mm] Normal | 61 |
| Spike width [mm] RATIO Drought/normal | 62 |
| Spike width [mm] Low N | 63 |
| Spikes per plant [number] Drought | 64 |
| Spikes per plot [number] Normal | 65 |
| Spikes per plant [number] RATIO Drought/normal | 66 |
| Spikes per plot [number] Low N | 67 |
| Spikes yield per plant [gr.] Drought | 68 |
| Spikes yield per plot [gr.] Normal | 69 |
| Spikes yield per plant [gr.] RATIO Drought/normal | 70 |
| Spikes yield per plot [gr.] Low N | 71 |
| Grain yield per plot [gr.] Drought | 72 |
| Grain yield per plot [gr.] Normal | 73 |
| Grain yield per plant [gr.] RATIO Drought/normal | 74 |
| Grain yield per plot [gr.] Low N | 75 |
| Grains per plant [number] Drought | 76 |
| Grains per plot [number] Normal | 77 |
| Grains per plant [number] RATIO Drought/normal | 78 |
| Grains per plot [number] Low N | 79 |
| Shoot/root Normal | 80 |
| Shoot/root low N | 81 |
| Shoot DW at harvest [gr.] low N | 82 |
| Roots DW [gr.] Normal | 83 |
| Roots DW [gr.] low N | 84 |
| Spikelet per spike [number] Normal | 85 |
| Spikelet per spike [number] Low N | 86 |
| Grain area [cm2] Normal | 87 |
| Grain area [cm2] low N | 88 |
| Grain length [cm] Normal | 89 |
| Grain length [cm] low N | 90 |
| Grain perimeter [cm] Normal | 91 |
| Grain perimeter [cm] low N | 92 |
| Grain width [cm] Normal | 93 |
| Grain width [cm] low N | 94 |
| RATIO Grains DW/shoots DW Normal | 95 |
| RATIO Grains DW/shoots DW low N | 96 |
| Grain yield per plant [gr.] Normal | 97 |
| Grain yield per plant [gr.] low N | 98 |
| Heading date [days] Drought | 99 |
| Heading date [days] RATIO Drought/normal | 100 |
| Percent of reproductive tillers [percent] low N | 101 |
| Percent of reproductive tillers [percent] Normal | 102 |

Table 48.
Provided are the barley correlated parameters.
"TP" = time point;
"DW" = dry weight;
"FW" = fresh weight;
"Low N" = Low Nitrogen;
"Relative water content [percent] RATIO Drought/normal" - maintenance of phenotype under drought in comparison to normal conditions.

Experimental Results 15 different Barley accessions were grown and characterized for different parameters as described above. Table 48 describes the Barley correlated parameters. The average for each of the measured parameter was calculated using the JMP software and values are summarized in Tables 49-58 below. Subsequent correlation analysis between the various transcriptom sets and the average parameters (Table 59) was conducted. Follow, results were integrated to the database.

TABLE 49

Measured parameters of correlation IDs in Barley accessions under Drought conditions

| | Line | | | | | | | |
|---|---|---|---|---|---|---|---|---|
| Corr. ID | 2 | 4 | 6 | 8 | 9 | 10 | 11 | 13 |
| 54 | 0.686 | 0.6 | 0.286 | 0.439 | 0.78 | 0.474 | 0.66 | 0.526 |
| 25 | 0.169 | 0.249 | 0.132 | 0.187 | 0.218 | 0.215 | 0.21 | |
| 46 | 69.8 | 87.4 | 58.3 | 80.6 | 73.1 | 80.6 | 53.4 | 55.9 |
| 99 | 90 | 90 | 90 | 81.6 | 90 | 75 | 71 | 65 |
| 5 | 0.02 | 0.012 | 0.023 | 0.012 | 0.012 | 0.013 | 0.012 | 0.008 |
| 45 | 0.939 | 0.774 | 0.388 | 0.884 | −0.13 | 0.273 | 0.856 | 0.733 |
| 37 | −0.072 | −0.063 | −0.004 | −0.072 | 0.025 | 0.087 | −0.123 | 0.001 |
| 76 | 252 | 348 | 71.5 | 160 | 377 | 170 | 268 | 111 |
| 72 | 7.75 | 8.5 | 2.05 | 5.38 | 11 | 5.55 | 9.8 | 3.55 |

TABLE 49-continued

Measured parameters of correlation IDs in Barley accessions under Drought conditions

| Corr. ID | Line 2 | 4 | 6 | 8 | 9 | 10 | 11 | 13 |
|---|---|---|---|---|---|---|---|---|
| 41 | 48 | 40.8 | 47.4 | 64.8 | 52.6 | 46 | 52.8 | 35 |
| 64 | 3.43 | 8.55 | 3.05 | 4.07 | 3.72 | 4.2 | 4.36 | 7.6 |
| 56 | 15.6 | 16 | 14.2 | 14.8 | 16.5 | 16.7 | 16.8 | 13.3 |
| 60 | 7.62 | 6.06 | 7.84 | 7.81 | 8.35 | 8.64 | 9.07 | 7.82 |
| 68 | 15 | 22 | 11.7 | 18.8 | 21 | 17.7 | 24.2 | 18.2 |
| 50 | 8.78 | 13.9 | 8.45 | 9.15 | 5.12 | 11.7 | 9.04 | 10.9 |
| 27 | 3.55 | 5.67 | 5.12 | 6.86 | 3.11 | 6.15 | 5.05 | 3.2 |
| 7 | 70.7 | 66.2 | 117 | 84.1 | 37.5 | 77.5 | 60.2 | 27.1 |
| 13 | 18.3 | 21.7 | 17 | 15.2 | 27 | 21.7 | 20.3 | 22 |
| 1 | 6.67 | 6 | 6.33 | 7 | 7 | 8.33 | 8.67 | 7.33 |
| 9 | 1.68 | 1.45 | 0.583 | 0.633 | 1.07 | 2.07 | 1.48 | 1.12 |
| 33 | 39.7 | 42.1 | 42.4 | 42.3 | 36.8 | 41.3 | 33.6 | 36.6 |
| 29 | 1.22 | 1.88 | 0.9 | 0.9 | 1.43 | 1.9 | 1.52 | 1.17 |

Table 49.
Provided are the values of each of the parameters (as described above) measured in Barley accessions (line) under drought growth conditions.
Growth conditions are specified in the experimental procedure section.

TABLE 50

Measured parameters of correlation IDs in additional Barley accessions under Drought conditions

| Corr. ID | Line 15 | 31 | 38 | 50 | 53 | 93 | 13s |
|---|---|---|---|---|---|---|---|
| 54 | 0.526 | 0.687 | 0.752 | 0.809 | 0.869 | 0.406 | 0.687 |
| 46 | 43.2 | 45.5 | 76.5 | | | | |
| 99 | 66.8 | 90 | | | | | |
| 5 | 0.025 | 0.008 | 0.008 | 0.007 | 0.016 | 0.026 | 0.006 |
| 45 | 0.401 | 0.699 | 0.713 | 0.8 | 0.915 | 0.198 | 0.881 |
| 37 | 0.037 | 0.013 | 0.003 | 0.035 | 0.05 | −0.063 | 0.01 |
| 76 | 154 | 288 | 274 | 358 | 521 | 105 | 205 |
| 72 | 5.28 | 9.92 | 10.2 | 14 | 17.5 | 2.56 | 7.2 |
| 41 | 45.2 | 37.7 | 41.2 | 49.9 | 43 | 32 | 38 |
| 64 | 4.92 | 6.9 | 5.8 | 9.67 | 5.42 | 3.21 | 8.44 |
| 56 | 14.2 | 15.7 | 17.5 | 18.3 | 17.4 | 12.7 | 13.5 |
| 60 | 8.74 | 6.98 | 8.05 | 6.72 | 9.55 | 5.47 | 7.32 |
| 68 | 19.5 | 23.4 | 28.2 | 33 | 34.8 | 9.88 | 18 |
| 50 | 10.3 | 13 | 7.44 | 11 | 6.78 | 16.1 | 10.2 |
| 27 | 4.76 | 4.52 | 3.38 | 3.31 | 2.65 | 3.74 | 3.28 |
| 7 | 117 | 37.3 | 25.6 | 22.1 | 41.1 | 98.9 | 18.6 |
| 13 | 20.7 | 21 | 20.3 | 19.7 | 16.7 | 15 | 24 |
| 1 | 6.67 | 7.67 | 6.67 | 8.67 | 7.67 | 6.67 | 7.67 |
| 9 | 1.67 | 1.62 | 0.85 | 1.38 | 0.817 | 0.7 | 1.87 |
| 33 | 45.1 | 38.3 | 36.2 | 31.8 | 33.5 | 40.6 | 40.5 |
| 29 | 1.9 | 1.75 | 1.58 | 1.73 | 1 | 0.833 | 1.95 |

Table 50.
Provided are the values of each of the parameters (as described above) measured in Barley accessions (line) under drought growth conditions.
Growth conditions are specified in the experimental procedure section.

TABLE 51

Additional measured parameters of correlation IDs in Barley accessions under Drought conditions

| Corr. ID | Line 2 | 4 | 6 | 8 | 9 | 10 | 11 | 13 |
|---|---|---|---|---|---|---|---|---|
| 78 | 0.21 | 0.25 | 0.1 | 0.1 | 0.28 | 0.12 | 0.22 | 0.11 |
| 74 | 0.14 | 0.14 | 0.07 | 0.07 | 0.2 | 0.08 | 0.17 | 0.06 |
| 43 | 0.59 | 0.66 | 0.64 | 0.79 | 0.56 | 0.51 | 0.61 | 0.67 |
| 66 | 0.62 | 1.09 | 0.49 | 0.65 | 0.99 | 0.73 | 0.96 | 1.11 |

TABLE 51-continued

Additional measured parameters of correlation IDs in Barley accessions under Drought conditions

| Corr. ID | Line 2 | 4 | 6 | 8 | 9 | 10 | 11 | 13 |
|---|---|---|---|---|---|---|---|---|
| 58 | 0.94 | 0.78 | 0.77 | 0.86 | 0.97 | 0.83 | 0.82 | 0.86 |
| 62 | 0.66 | 0.74 | 0.79 | 0.72 | 0.72 | 0.75 | 0.77 | 0.68 |
| 70 | 0.18 | 0.22 | 0.18 | 0.18 | 0.27 | 0.16 | 0.23 | 0.19 |
| 28 | 0.54 | 0.77 | 0.42 | 0.65 | 0.52 | 0.61 | 0.45 | 0.59 |
| 8 | 1.06 | 0.88 | 0.77 | 0.85 | 1.06 | 0.94 | 0.44 | 0.66 |
| 16 | 0.76 | 1.12 | 0.82 | 0.43 | 0.71 | 0.66 | 0.74 | 1.16 |
| 4 | 0.65 | 0.58 | 0.95 | 0.78 | 0.66 | 1.09 | 0.74 | 0.79 |
| 12 | 0.81 | 0.85 | 1.06 | 0.3 | 0.44 | 1.1 | 1 | 1.02 |
| 52 | 1.61 | 1.75 | 1.33 | 1.4 | 1.22 | 1.87 | 1.57 | 1.72 |
| 35 | 0.95 | 0.93 | 0.96 | 1.01 | 0.93 | 0.98 | 0.72 | 1.3 |
| 31 | 0.47 | 0.74 | 0.72 | 0.37 | 0.4 | 0.6 | 0.5 | 0.47 |
| 26 | 0.65 | 1.01 | 0.94 | | 0.7 | 0.93 | 0.71 | |
| 47 | 0.56 | 0.5 | | 0.78 | 0.55 | 0.78 | 0.58 | 0.9 |
| 55 | 0.77 | 0.67 | 0.41 | 0.5 | 0.87 | 0.54 | 0.79 | 0.58 |
| 6 | 1.97 | 1.14 | 1.84 | 1.31 | 2.06 | 1.55 | 0.97 | 1.12 |

Table 51.
Provided are the values of each of the parameters (as described above) measured in Barley accessions (line) under drought growth conditions.
Growth conditions are specified in the experimental procedure section.

TABLE 52

Additional measured parameters of correlation IDs in additional Barley accessions under Drought conditions

| Corr. ID | Line 15 | 31 | 38 | 50 | 53 | 93 | 13s |
|---|---|---|---|---|---|---|---|
| 78 | 0.17 | 0.22 | 0.24 | 0.58 | 0.43 | 0.43 | 0.19 |
| 74 | 0.15 | 0.15 | 0.2 | 0.47 | 0.32 | 0.32 | 0.14 |
| 43 | 0.61 | 0.7 | 0.63 | 0.87 | 0.86 | 0.51 | 0.72 |
| 66 | 0.83 | 0.87 | 1.12 | 1.09 | 0.92 | 0.52 | 1.3 |
| 58 | 0.78 | 0.83 | 0.89 | 0.94 | 0.88 | 0.78 | 0.77 |
| 62 | 0.87 | 0.75 | 0.74 | 0.86 | 0.85 | 0.88 | 0.67 |
| 70 | 0.25 | 0.23 | 0.34 | 0.68 | 0.55 | 0.25 | 0.23 |
| 28 | 0.41 | 0.75 | 0.65 | 0.8 | 0.68 | 0.46 | 0.67 |
| 8 | 0.71 | 0.5 | 0.62 | 0.87 | 0.94 | 0.68 | 0.37 |
| 16 | 0.76 | 0.68 | 0.77 | 0.56 | 0.42 | 0.8 | 0.78 |

TABLE 52-continued

Additional measured parameters of correlation IDs in additional Barley accessions under Drought conditions

| Corr. ID | Line | | | | | | |
|---|---|---|---|---|---|---|---|
| | 15 | 31 | 38 | 50 | 53 | 93 | 13s |
| 4 | 0.71 | 0.85 | 0.77 | 0.96 | 0.88 | 0.87 | 0.88 |
| 12 | 0.8 | 1.13 | 0.34 | 0.58 | 0.07 | 0.93 | 1.67 |
| 52 | 1.6 | 1.63 | 1.59 | 1.33 | 1.62 | 1.96 | 1.8 |
| 35 | 1.03 | 0.82 | 0.93 | 0.8 | 0.94 | 1.03 | 1.06 |
| 31 | 0.46 | 0.58 | 0.62 | | 0.81 | | 0.68 |
| 26 | | | 0.92 | | | | |
| 47 | 0.65 | 0.78 | 0.83 | | | | |
| 55 | 0.7 | 0.75 | 0.83 | 0.92 | 0.93 | 0.82 | 0.75 |
| 6 | 1.72 | 0.67 | 0.96 | 1.08 | 1.38 | 1.46 | 0.56 |

Table 52.
Provided are the values of each of the parameters (as described above) measured in Barley accessions (line) under drought growth conditions.
Growth conditions are specified in the experimental procedure section.

TABLE 53

Measured parameters of correlation IDs in Barley accessions under normal conditions

| Corr. ID | Line | | | | | | | |
|---|---|---|---|---|---|---|---|---|
| | 10 | 11 | 13 | 15 | 2 | 31 | 38 | 4 |
| 85 | 6 | 6 | 6 | 6 | 6 | 2.8 | 6 | 2 |
| 80 | 1.48 | 0.64 | 0.84 | 0.82 | 1.15 | 0.69 | 1.26 | 0.72 |
| 69 | 69.8 | 39.9 | 69.4 | 59.7 | 60.8 | 79.1 | 63.5 | 62.7 |
| 65 | 38.6 | 32 | 41.5 | 38 | 34.2 | 45.6 | 30 | 49.8 |
| 39 | 89.2 | 99.7 | 45.8 | 49.4 | 74.3 | 55.1 | 47.3 | 60.3 |
| 87 | 0.25 | 0.24 | 0.24 | 0.23 | 0.24 | 0.25 | 0.24 | 0.22 |
| 89 | 0.89 | 0.87 | 0.86 | 0.80 | 0.83 | 0.78 | 0.90 | 0.72 |
| 91 | 2.24 | 2.24 | 2.18 | 2.05 | 2.08 | 2.03 | 2.25 | 1.88 |
| 93 | 0.35 | 0.35 | 0.35 | 0.37 | 0.37 | 0.41 | 0.35 | 0.39 |
| 95 | 0.40 | 0.16 | 1.01 | 0.79 | 0.41 | 0.99 | 0.67 | 0.61 |
| 77 | 683 | 510 | 1090 | 768 | 621 | 1070 | 988 | 903 |
| 97 | 6.65 | 3.96 | 9.27 | 7.65 | 6.06 | 10.8 | 7.94 | 7.4 |
| 73 | 33.2 | 19.8 | 46.4 | 38.3 | 30.3 | 54.1 | 39.7 | 37 |
| 83 | 118 | 151 | 86.3 | 85.2 | 120 | 90.7 | 40.6 | 90.5 |

Table 53.
Provided are the values of each of the parameters (as described above) measured in Barley accessions (line) under normal growth conditions.
Growth conditions are specified in the experimental procedure section.

TABLE 54

Measured parameters of correlation IDs in additional Barley accessions under normal conditions

| Corr. ID | Line | | | | | | |
|---|---|---|---|---|---|---|---|
| | 50 | 53 | 6 | 8 | 9 | 93 | s13 |
| 85 | 2 | 5.2 | 6 | 6 | 6 | 4.67 | 4 |
| 80 | 1.17 | 0.71 | 0.38 | 0.51 | 2.16 | 0.67 | 0.40 |
| 69 | 50.3 | 60 | 34.9 | 60.1 | 55.9 | 16.9 | 21.7 |
| 65 | 71.4 | 28 | 36 | 27.6 | 23.6 | 54.7 | 48 |
| 39 | 88 | 38.9 | 97.7 | 48.3 | 62.5 | 58 | 72.8 |
| 87 | 0.23 | 0.22 | 0.24 | 0.21 | 0.18 | 0.19 | 0.17 |
| 89 | 0.82 | 0.79 | 0.80 | 0.80 | 0.65 | 0.82 | 0.77 |
| 91 | 2.09 | 2.03 | 2.02 | 1.98 | 1.69 | 1.98 | 1.89 |
| 93 | 0.36 | 0.36 | 0.37 | 0.34 | 0.35 | 0.29 | 0.29 |
| 95 | 0.28 | 1.04 | 0.12 | 0.86 | 0.58 | 0.05 | 0.08 |
| 77 | 582 | 904 | 242 | 928 | 984 | 158 | 263 |
| 97 | 4.52 | 8.41 | 2 | 8.05 | 7.07 | 0.747 | 1.14 |
| 73 | 22.6 | 39.7 | 10.8 | 40.3 | 35.4 | 3.73 | 5.67 |
| 83 | 92.6 | 64 | 287 | 95.8 | 34 | 121 | 207 |

Table 54.
Provided are the values of each of the parameters (as described above) measured in Barley accessions (line) under normal growth conditions.
Growth conditions are specified in the experimental procedure section.

TABLE 55

Additional measured parameters of correlation IDs in Barley accessions under normal conditions

| Corr. ID | \ | \ | \ | \ | Line | \ | \ | \ | \ | \ |
|---|---|---|---|---|---|---|---|---|---|---|
| | 11 | 13 | 15 | 2 | 31 | 4 | 50 | 53 | 6 | 9 |
| 42 | 84 | 64.7 | 66.2 | 72 | 56.6 | 65.8 | 82 | 62.8 | 67.4 | 91.6 |
| 61 | 19.2 | 16.5 | 16.1 | 17.2 | 19.1 | 20.3 | 20.4 | 21.7 | 18.3 | 16.5 |
| 57 | 9.05 | 9.54 | 10.3 | 10.5 | 8.83 | 7.38 | 6.55 | 10.4 | 8.25 | 10.2 |
| 51 | 41.6 | 46.7 | 38.8 | 34.6 | 48.6 | 49.2 | 48.8 | 29 | 40 | 27.5 |
| 15 | 15 | 21.3 | 15.2 | 27.2 | 16 | 24 | 20.3 | 13.5 | 21.8 | 21.5 |
| 3 | 8.67 | 7 | 9.67 | 10.7 | 9.67 | 9.67 | 9.67 | 8.67 | 8.33 | 10 |
| 11 | 0.27 | 0.27 | 0.27 | 0.62 | 0.27 | 0.35 | 0.35 | 0.32 | 0.25 | 0.23 |
| 49 | 2 | 2 | 1.67 | 2.33 | 3.33 | 2.33 | 2.33 | 1.33 | 1 | 1.33 |
| 34 | 41.4 | 39.1 | 36.8 | 34.2 | 42.8 | 37 | 33.7 | 36.9 | 35.2 | 35 |
| 30 | 1.9 | 2.17 | 1.82 | 15.6 | 3.02 | 2.58 | 3 | 1.75 | 1.25 | 2.18 |
| 24 | 18.2 | 24.2 | 22 | 23.2 | 28.3 | 22.2 | 25.5 | 19 | 22.7 | 17.3 |
| 18 | 199 | 294 | 296 | 313 | 309 | 259 | 276 | 291 | 273 | 299 |
| 22 | 5.45 | 5.77 | 6.03 | 4.63 | 5.33 | 5.83 | 6.03 | 5.43 | 5.8 | 5.75 |
| 20 | 348 | 502 | 470 | 535 | 551 | 479 | 594 | 399 | 499 | 384 |

Table 55.
Provided are the values of each of the parameters (as described above) measured in Barley accessions (line) under normal growth conditions.
Growth conditions are specified in the experimental procedure section.

TABLE 56

Measured parameters of correlation IDs in additional Barley accessions under Low N conditions

| Corr. ID | \ | \ | \ | Line | \ | \ | \ | \ |
|---|---|---|---|---|---|---|---|---|
| | 10 | 11 | 13 | 15 | 2 | 31 | 38 | 4 |
| 88 | 0.25 | 0.25 | 0.26 | 0.24 | 0.25 | 0.23 | 0.23 | 0.21 |
| 90 | 0.90 | 0.92 | 0.93 | 0.82 | 0.86 | 0.76 | 0.83 | 0.74 |
| 92 | 2.28 | 2.33 | 2.28 | 2.08 | 2.13 | 1.96 | 2.09 | 1.88 |
| 94 | 0.35 | 0.35 | 0.35 | 0.36 | 0.37 | 0.38 | 0.35 | 0.36 |
| 96 | 0.39 | 0.42 | 1.25 | 0.69 | 0.43 | 0.87 | 0.77 | 0.53 |
| 79 | 153 | 165 | 230 | 125 | 100 | 223 | 159 | 219 |
| 98 | 1.34 | 1.46 | 1.95 | 1.26 | 1.13 | 1.95 | 1.28 | 1.47 |
| 75 | 6.68 | 7.31 | 9.76 | 6.29 | 5.67 | 9.74 | 6.40 | 7.35 |
| 84 | 39.9 | 26.2 | 17.3 | 32.9 | 33.9 | 83.8 | 29.6 | 37.2 |
| 86 | 6 | 6 | 6 | 6 | 6 | 2 | 6 | 2 |
| 81 | 0.69 | 1.08 | 0.77 | 0.38 | 0.83 | 0.42 | 0.29 | 0.57 |
| 71 | 11.40 | 13.40 | 13.70 | 10.60 | 11.30 | 15.10 | 11.60 | 12.20 |
| 67 | 10.8 | 9 | 12.2 | 8.4 | 7.8 | 14.5 | 8.4 | 15 |
| 53 | 16 | 14.6 | 16.2 | 14 | 12.5 | 18.8 | 11.6 | 21.2 |
| 82 | 17.40 | 17.80 | 8.25 | 7.28 | 13.20 | 11.30 | 8.95 | 14.20 |

Table 56.
Provided are the values of each of the parameters (as described above) measured in Barley accessions (line) under low nitrogen growth conditions.
Growth conditions are specified in the experimental procedure section.

TABLE 57

Measured parameters of correlation IDs in additional Barley accessions under Low N conditions

| Corr. ID | \ | \ | \ | Line | \ | \ | \ |
|---|---|---|---|---|---|---|---|
| | 50 | 53 | 6 | 8 | 9 | 93 | s13 |
| 88 | 0.24 | 0.20 | 0.22 | 0.23 | 0.19 | 0.19 | 0.17 |
| 90 | 0.86 | 0.73 | 0.81 | 0.85 | 0.68 | 0.81 | 0.79 |
| 92 | 2.19 | 1.88 | 2.03 | 2.11 | 1.77 | 2.00 | 1.90 |
| 94 | 0.35 | 0.35 | 0.35 | 0.35 | 0.36 | 0.30 | 0.28 |
| 96 | 0.34 | 0.87 | 0.15 | 0.58 | 0.76 | 0.05 | 0.07 |
| 79 | 134 | 134 | 88.2 | 174 | 202 | 86.7 | 61.6 |
| 98 | 0.98 | 1.16 | 0.92 | 1.33 | 1.57 | 0.29 | 0.22 |
| 75 | 5.06 | 5.43 | 4.62 | 6.67 | 7.83 | 1.44 | 1.12 |
| 84 | 44.4 | 14.5 | 41.5 | 23.7 | 20.9 | 49.7 | 54 |
| 86 | 2 | 5.2 | 6 | 6 | 6 | 2 | 2 |
| 81 | 0.60 | 0.55 | 2.88 | 1.36 | 0.89 | 2.49 | 0.40 |
| 71 | 11.60 | 8.76 | 9.15 | 12.40 | 12.20 | 5.68 | 5.04 |
| 67 | 25 | 7 | 11.6 | 7.6 | 5.4 | 16.4 | 12 |
| 53 | 23.5 | 11 | 16 | 10.8 | 6.75 | 35 | |
| 82 | 15.70 | 6.42 | 55.90 | 11.50 | 10.90 | 58.90 | 17.10 |

Table 57.
Provided are the values of each of the parameters (as described above) measured in Barley accessions (line) under low nitrogen growth conditions.
Growth conditions are specified in the experimental procedure section.

TABLE 58

Additional measured parameters of correlation IDs in Barley accessions under Low N conditions

| Corr. ID | Line | | | | | | | | | |
|---|---|---|---|---|---|---|---|---|---|---|
| | 11 | 13 | 15 | 2 | 31 | 4 | 50 | 53 | 6 | 9 |
| 36 | 23.3 | 24 | 26.1 | 26.6 | 23.2 | 25.4 | 23.9 | 24.2 | 26.5 | 25 |
| 10 | 0.23 | 0.38 | 0.55 | 0.88 | 0.50 | 0.43 | 0.40 | 0.32 | 0.12 | 0.30 |
| 32 | 0.43 | 0.43 | 0.62 | 0.78 | 0.53 | 0.45 | 0.58 | 0.43 | 0.33 | 0.50 |
| 63 | 8.13 | 7.95 | 9.40 | 9.60 | 7.16 | 7.06 | 4.94 | 8.51 | 9.43 | 10.00 |
| 14 | 21.7 | 24.7 | 24.5 | 22.2 | 23 | 30.5 | 21.7 | 22.8 | 22 | 23.8 |
| 44 | 82 | 41 | 44.6 | 65.8 | 47.8 | 53.8 | 59.4 | 56.4 | 61.4 | 81.8 |
| 59 | 19.6 | 15.2 | 16.6 | 90.2 | 16.4 | 20.4 | 19.3 | 18.8 | 16.3 | 18.8 |
| 40 | 18.8 | 16.3 | 19.2 | 22.5 | 18.2 | 19.7 | 26 | 19.8 | 17.3 | 19.2 |
| 23 | 8 | 8 | 10 | 10 | 11.5 | 8.6 | 8.5 | 6.33 | 7.5 | 7.5 |
| 2 | 6 | 5 | 7.33 | 6.33 | 6 | 6.67 | 6 | 4.67 | 4.33 | 5.67 |
| 21 | 5.17 | 5.25 | 5.10 | 5.20 | 5.33 | 5.32 | 5.30 | 5.10 | 5.12 | 5.15 |
| 19 | 108 | 103 | 135 | 152 | 149 | 124 | 142 | 95 | 112 | 124 |
| 17 | 46.3 | 39.4 | 57.9 | 67.8 | 64.2 | 52.4 | 57.1 | 46.2 | 51.5 | 68 |

Table 58.
Provided are the values of each of the parameters (as described above) measured in Barley accessions (line) under low nitrogen growth conditions. Growth conditions are specified in the experimental procedure section.

TABLE 59

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB390 | −0.95 | 0.001 | A | 55 | LAB390 | 0.84 | 0.009 | K | 31 |
| LAB390 | −0.95 | 0.001 | A | 74 | LAB390 | −0.84 | 0.005 | H | 28 |
| LAB390 | −0.94 | 0.001 | A | 70 | LAB390 | 0.79 | 0.010 | K | 78 |
| LAB390 | −0.92 | 0.003 | A | 78 | LAB390 | −0.78 | 0.021 | K | 47 |
| LAB390 | −0.92 | 0.004 | A | 62 | LAB390 | −0.76 | 0.048 | A | 58 |
| LAB390 | −0.88 | 0.004 | B | 28 | LAB390 | 0.74 | 0.023 | K | 70 |
| LAB390 | 0.86 | 0.012 | A | 52 | LAB390 | 0.74 | 0.023 | H | 26 |
| LAB390 | 0.85 | 0.016 | A | 16 | LAB390 | 0.72 | 0.029 | K | 28 |
| LAB390 | 0.84 | 0.034 | L | 26 | LAB390 | 0.72 | 0.030 | K | 74 |
| LAB390 | 0.71 | 0.048 | G | 8 | LAB390 | −0.95 | 0.001 | A | 68 |
| LAB390 | −0.92 | 0.004 | A | 54 | LAB390 | −0.91 | 0.005 | A | 56 |
| LAB390 | −0.90 | 0.006 | A | 72 | LAB391 | 0.93 | 0.001 | G | 68 |
| LAB390 | −0.90 | 4.52E−04 | M | 84 | LAB391 | 0.90 | 0.003 | G | 76 |
| LAB390 | −0.89 | 0.006 | A | 41 | LAB391 | 0.88 | 0.002 | H | 1 |
| LAB390 | −0.87 | 0.005 | D | 18 | LAB391 | 0.86 | 0.029 | L | 76 |
| LAB390 | 0.86 | 0.001 | R | 86 | LAB391 | 0.85 | 0.007 | B | 68 |
| LAB390 | 0.85 | 0.004 | K | 76 | LAB391 | −0.85 | 0.034 | L | 60 |
| LAB390 | −0.84 | 0.009 | D | 20 | LAB391 | 0.79 | 0.020 | B | 56 |
| LAB390 | 0.84 | 0.005 | C | 21 | LAB391 | −0.79 | 0.012 | C | 19 |
| LAB390 | 0.84 | 0.038 | G | 46 | LAB391 | 0.78 | 0.022 | G | 54 |
| LAB390 | 0.82 | 0.007 | C | 67 | LAB391 | 0.78 | 0.024 | G | 56 |
| LAB390 | 0.82 | 0.014 | B | 60 | LAB391 | 0.75 | 0.033 | B | 72 |
| LAB390 | 0.81 | 0.008 | C | 48 | LAB391 | 0.73 | 0.024 | K | 56 |
| LAB390 | −0.81 | 0.008 | C | 63 | LAB391 | 0.72 | 0.030 | H | 56 |
| LAB390 | −0.81 | 0.015 | D | 24 | LAB391 | −0.71 | 0.031 | C | 32 |
| LAB390 | 0.81 | 0.028 | A | 64 | LAB391 | −0.71 | 0.033 | C | 23 |
| LAB390 | 0.79 | 0.035 | A | 33 | LAB391 | −0.70 | 0.024 | Q | 89 |
| LAB390 | 0.78 | 0.023 | D | 42 | LAB392 | 0.93 | 0.007 | L | 58 |
| LAB390 | −0.78 | 0.014 | C | 40 | LAB392 | 0.92 | 0.003 | G | 31 |
| LAB390 | 0.77 | 0.010 | N | 77 | LAB392 | −0.91 | 0.004 | G | 47 |
| LAB390 | 0.76 | 0.017 | I | 63 | LAB392 | −0.87 | 0.023 | G | 100 |
| LAB390 | −0.76 | 0.019 | I | 21 | LAB392 | 0.84 | 0.005 | K | 8 |
| LAB390 | −0.75 | 0.019 | I | 67 | LAB392 | 0.81 | 0.048 | L | 70 |
| LAB390 | 0.75 | 0.020 | K | 72 | LAB392 | −0.81 | 0.048 | L | 52 |
| LAB390 | 0.75 | 0.013 | N | 73 | LAB392 | 0.80 | 0.031 | A | 66 |
| LAB390 | −0.74 | 0.023 | J | 49 | LAB392 | 0.72 | 0.044 | G | 26 |
| LAB390 | −0.74 | 0.015 | R | 67 | LAB392 | 0.70 | 0.037 | H | 26 |
| LAB390 | 0.73 | 0.016 | N | 97 | LAB392 | 0.94 | 0.001 | G | 76 |
| LAB390 | −0.73 | 0.016 | R | 53 | LAB392 | −0.93 | 1.14E−04 | Q | 85 |
| LAB390 | 0.72 | 0.027 | K | 68 | LAB392 | −0.91 | 0.011 | L | 33 |
| LAB390 | 0.71 | 0.022 | N | 85 | LAB392 | −0.86 | 0.013 | A | 7 |
| LAB390 | 0.70 | 0.036 | K | 54 | LAB392 | 0.84 | 0.005 | H | 7 |
| LAB391 | 0.96 | 1.83E−04 | B | 62 | LAB392 | 0.79 | 0.011 | C | 40 |
| LAB391 | 0.94 | 0.005 | L | 28 | LAB392 | −0.79 | 0.035 | A | 27 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB391 | 0.91 | 0.002 | G | 62 | LAB392 | 0.78 | 0.014 | K | 38 |
| LAB391 | 0.85 | 0.004 | K | 62 | LAB392 | 0.78 | 0.024 | G | 72 |
| LAB391 | 0.84 | 0.019 | A | 28 | LAB392 | 0.77 | 0.026 | D | 57 |
| LAB391 | 0.82 | 0.012 | G | 70 | LAB392 | 0.77 | 0.026 | D | 61 |
| LAB391 | −0.82 | 0.023 | G | 47 | LAB392 | −0.76 | 0.018 | N | 102 |
| LAB391 | 0.79 | 0.019 | G | 78 | LAB392 | −0.74 | 0.035 | B | 27 |
| LAB391 | 0.78 | 0.013 | H | 4 | LAB392 | −0.70 | 0.025 | O | 87 |
| LAB391 | 0.78 | 0.022 | G | 43 | LAB392 | −0.70 | 0.025 | E | 36 |
| LAB391 | 0.78 | 0.023 | G | 74 | LAB393 | −0.90 | 0.006 | K | 100 |
| LAB391 | 0.76 | 0.046 | G | 31 | LAB393 | 0.89 | 0.007 | G | 31 |
| LAB391 | 0.73 | 0.040 | G | 55 | LAB393 | 0.87 | 0.023 | L | 26 |
| LAB391 | 0.72 | 0.028 | K | 4 | LAB393 | 0.86 | 0.013 | A | 16 |
| LAB391 | 0.71 | 0.049 | B | 74 | LAB393 | −0.77 | 0.044 | A | 43 |
| LAB391 | 0.94 | 4.33E−04 | G | 72 | LAB393 | 0.76 | 0.047 | A | 35 |
| LAB393 | 0.74 | 0.037 | G | 78 | LAB393 | −0.78 | 0.013 | I | 19 |
| LAB393 | 0.73 | 0.038 | G | 55 | LAB393 | 0.77 | 0.010 | Q | 39 |
| LAB393 | 0.70 | 0.037 | K | 26 | LAB393 | −0.72 | 0.044 | F | 30 |
| LAB393 | 0.89 | 0.003 | G | 76 | LAB393 | −0.72 | 0.045 | D | 65 |
| LAB393 | 0.81 | 0.048 | G | 99 | LAB393 | −0.71 | 0.047 | D | 51 |
| LAB393 | 0.81 | 0.015 | G | 54 | LAB393 | 0.70 | 0.025 | M | 90 |
| LAB393 | 0.80 | 0.016 | G | 72 | LAB402 | 0.93 | 0.001 | B | 78 |
| LAB393 | −0.79 | 0.034 | A | 72 | LAB402 | 0.92 | 0.001 | B | 74 |
| LAB402 | 0.88 | 0.004 | B | 70 | LAB402 | −0.85 | 0.015 | A | 43 |
| LAB402 | −0.85 | 0.004 | H | 16 | LAB403 | −0.94 | 0.006 | L | 60 |
| LAB402 | −0.82 | 0.023 | G | 47 | LAB403 | 0.92 | 0.001 | B | 50 |
| LAB402 | 0.81 | 0.015 | B | 55 | LAB403 | 0.92 | 0.001 | B | 64 |
| LAB402 | 0.80 | 0.031 | G | 31 | LAB403 | 0.91 | 0.012 | L | 7 |
| LAB402 | 0.77 | 0.024 | G | 78 | LAB403 | 0.91 | 0.012 | L | 5 |
| LAB402 | 0.71 | 0.048 | G | 28 | LAB403 | 0.88 | 0.002 | C | 67 |
| LAB402 | 0.71 | 0.049 | G | 8 | LAB403 | −0.87 | 0.026 | L | 38 |
| LAB402 | −0.86 | 0.006 | D | 3 | LAB403 | 0.86 | 0.003 | K | 68 |
| LAB402 | 0.85 | 0.008 | B | 54 | LAB403 | −0.84 | 0.008 | F | 51 |
| LAB402 | 0.83 | 0.011 | G | 76 | LAB403 | 0.84 | 0.004 | C | 40 |
| LAB402 | 0.83 | 0.011 | B | 72 | LAB403 | 0.83 | 0.039 | L | 27 |
| LAB402 | −0.82 | 0.004 | R | 44 | LAB403 | −0.82 | 0.013 | G | 29 |
| LAB402 | 0.82 | 0.013 | F | 22 | LAB403 | −0.82 | 0.013 | B | 60 |
| LAB402 | 0.81 | 0.015 | G | 38 | LAB403 | −0.81 | 0.008 | H | 64 |
| LAB402 | −0.81 | 0.005 | M | 84 | LAB403 | −0.80 | 0.005 | R | 88 |
| LAB402 | −0.80 | 0.030 | A | 76 | LAB403 | −0.80 | 0.010 | C | 63 |
| LAB402 | −0.79 | 0.034 | A | 45 | LAB403 | 0.79 | 0.019 | D | 49 |
| LAB402 | 0.78 | 0.014 | C | 32 | LAB403 | −0.79 | 0.021 | G | 9 |
| LAB402 | 0.77 | 0.026 | B | 56 | LAB403 | 0.79 | 0.021 | D | 24 |
| LAB402 | 0.76 | 0.017 | K | 38 | LAB403 | 0.78 | 0.014 | H | 5 |
| LAB402 | −0.75 | 0.020 | K | 45 | LAB403 | −0.77 | 0.027 | G | 13 |
| LAB402 | 0.75 | 0.032 | G | 54 | LAB403 | −0.76 | 0.011 | M | 88 |
| LAB402 | 0.75 | 0.013 | M | 79 | LAB403 | 0.76 | 0.018 | K | 72 |
| LAB402 | 0.75 | 0.033 | G | 72 | LAB403 | −0.75 | 0.031 | F | 24 |
| LAB402 | −0.74 | 0.014 | R | 94 | LAB403 | −0.74 | 0.014 | E | 79 |
| LAB402 | −0.72 | 0.018 | M | 53 | LAB403 | −0.74 | 0.023 | K | 7 |
| LAB402 | 0.72 | 0.043 | B | 68 | LAB403 | 0.73 | 0.039 | B | 29 |
| LAB402 | 0.72 | 0.043 | D | 22 | LAB403 | −0.73 | 0.040 | F | 20 |
| LAB402 | 0.72 | 0.046 | B | 76 | LAB403 | −0.72 | 0.019 | P | 101 |
| LAB402 | −0.72 | 0.020 | P | 44 | LAB403 | −0.72 | 0.045 | F | 15 |
| LAB402 | −0.71 | 0.022 | N | 87 | LAB403 | −0.72 | 0.046 | G | 54 |
| LAB402 | 0.70 | 0.034 | H | 72 | LAB403 | 0.71 | 0.032 | K | 38 |
| LAB402 | 0.70 | 0.036 | C | 19 | LAB403 | −0.71 | 0.033 | J | 51 |
| LAB402 | −0.70 | 0.025 | N | 83 | LAB403 | 0.70 | 0.035 | K | 76 |
| LAB403 | −0.87 | 0.011 | A | 52 | LAB403 | 0.70 | 0.038 | K | 64 |
| LAB403 | 0.86 | 0.003 | K | 43 | LAB404 | 0.96 | 0.002 | L | 74 |
| LAB403 | 0.85 | 0.007 | B | 28 | LAB404 | 0.96 | 0.003 | L | 70 |
| LAB403 | 0.85 | 0.004 | K | 70 | LAB404 | −0.96 | 0.003 | A | 31 |
| LAB403 | −0.79 | 0.012 | H | 66 | LAB404 | 0.94 | 0.005 | L | 43 |
| LAB403 | 0.78 | 0.037 | B | 31 | LAB404 | −0.91 | 0.012 | L | 52 |
| LAB403 | −0.78 | 0.038 | G | 31 | LAB404 | 0.90 | 0.014 | L | 62 |
| LAB403 | 0.77 | 0.015 | K | 62 | LAB404 | 0.89 | 0.007 | G | 31 |
| LAB403 | −0.77 | 0.027 | G | 66 | LAB404 | 0.85 | 0.007 | G | 28 |
| LAB403 | 0.76 | 0.018 | K | 78 | LAB404 | 0.84 | 0.009 | G | 78 |
| LAB403 | 0.75 | 0.019 | K | 28 | LAB404 | −0.84 | 0.018 | A | 52 |
| LAB403 | 0.74 | 0.021 | K | 74 | LAB404 | 0.83 | 0.010 | G | 70 |
| LAB403 | −0.72 | 0.044 | G | 55 | LAB404 | 0.79 | 0.011 | K | 28 |
| LAB404 | 0.79 | 0.019 | G | 74 | LAB404 | −0.82 | 0.007 | C | 40 |
| LAB404 | 0.78 | 0.022 | G | 62 | LAB404 | −0.81 | 0.004 | P | 82 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB404 | 0.77 | 0.025 | B | 4 | LAB404 | 0.80 | 0.017 | G | 68 |
| LAB404 | 0.76 | 0.028 | G | 43 | LAB404 | −0.78 | 0.021 | B | 45 |
| LAB404 | 0.72 | 0.027 | K | 66 | LAB404 | −0.76 | 0.017 | K | 7 |
| LAB404 | −0.73 | 0.042 | D | 73 | LAB404 | 0.76 | 0.029 | G | 76 |
| LAB404 | 0.90 | 0.014 | L | 41 | LAB404 | 0.75 | 0.031 | G | 38 |
| LAB404 | 0.90 | 0.002 | B | 38 | LAB404 | 0.75 | 0.033 | G | 72 |
| LAB404 | 0.89 | 0.001 | K | 64 | LAB404 | 0.74 | 0.015 | E | 67 |
| LAB404 | 0.73 | 0.039 | D | 42 | LAB404 | −0.72 | 0.042 | D | 77 |
| LAB404 | −0.72 | 0.043 | D | 69 | LAB404 | −0.71 | 0.023 | E | 63 |
| LAB405 | 0.91 | 0.001 | G | 43 | LAB412 | 0.82 | 0.013 | G | 28 |
| LAB405 | 0.90 | 0.002 | G | 70 | LAB412 | 0.81 | 0.026 | A | 66 |
| LAB405 | 0.89 | 0.003 | G | 62 | LAB412 | 0.81 | 0.016 | B | 58 |
| LAB405 | 0.81 | 0.015 | G | 74 | LAB412 | 0.79 | 0.020 | G | 78 |
| LAB405 | 0.80 | 0.016 | G | 78 | LAB412 | 0.75 | 0.034 | G | 70 |
| LAB405 | −0.80 | 0.029 | A | 66 | LAB412 | 0.72 | 0.043 | G | 74 |
| LAB405 | 0.79 | 0.020 | B | 28 | LAB412 | 0.70 | 0.037 | H | 4 |
| LAB405 | 0.78 | 0.023 | K | 31 | LAB412 | 0.81 | 0.015 | G | 38 |
| LAB405 | 0.76 | 0.030 | G | 4 | LAB412 | −0.78 | 0.008 | M | 90 |
| LAB405 | 0.75 | 0.032 | B | 66 | LAB412 | −0.77 | 0.009 | M | 92 |
| LAB405 | −0.72 | 0.044 | G | 12 | LAB412 | 0.77 | 0.027 | G | 76 |
| LAB405 | 0.96 | 1.35E−04 | B | 64 | LAB412 | 0.73 | 0.039 | G | 72 |
| LAB405 | 0.92 | 0.001 | G | 68 | LAB412 | 0.73 | 0.041 | G | 54 |
| LAB405 | 0.89 | 0.001 | J | 65 | LAB412 | 0.72 | 0.018 | Q | 39 |
| LAB405 | −0.88 | 0.001 | N | 83 | LAB412 | −0.72 | 0.046 | F | 77 |
| LAB405 | −0.88 | 0.004 | F | 3 | LAB412 | −0.71 | 0.022 | R | 44 |
| LAB405 | 0.86 | 0.006 | G | 72 | LAB412 | 0.71 | 0.049 | G | 68 |
| LAB405 | 0.81 | 0.004 | R | 81 | LAB412 | 0.70 | 0.024 | P | 94 |
| LAB405 | −0.80 | 0.018 | B | 7 | LAB412 | −0.70 | 0.025 | Q | 85 |
| LAB405 | −0.80 | 0.018 | B | 60 | LAB413 | 0.95 | 2.29E−04 | B | 74 |
| LAB405 | 0.76 | 0.029 | G | 76 | LAB413 | 0.94 | 0.001 | B | 78 |
| LAB405 | 0.74 | 0.034 | G | 38 | LAB413 | 0.94 | 0.001 | B | 70 |
| LAB405 | −0.72 | 0.019 | N | 87 | LAB413 | −0.94 | 0.006 | L | 52 |
| LAB405 | 0.71 | 0.047 | G | 54 | LAB413 | 0.92 | 0.010 | L | 70 |
| LAB405 | 0.71 | 0.032 | I | 40 | LAB413 | 0.90 | 0.015 | L | 74 |
| LAB405 | −0.70 | 0.036 | J | 61 | LAB413 | 0.89 | 0.016 | L | 58 |
| LAB410 | 0.90 | 0.016 | L | 55 | LAB413 | 0.88 | 0.021 | L | 78 |
| LAB410 | 0.82 | 0.007 | K | 8 | LAB413 | 0.87 | 0.023 | L | 62 |
| LAB410 | −0.82 | 0.026 | H | 100 | LAB413 | −0.85 | 0.033 | L | 12 |
| LAB410 | −0.78 | 0.040 | G | 47 | LAB413 | 0.81 | 0.015 | B | 55 |
| LAB410 | 0.76 | 0.027 | B | 58 | LAB413 | −0.79 | 0.011 | H | 43 |
| LAB410 | 0.76 | 0.046 | G | 31 | LAB413 | −0.79 | 0.033 | G | 47 |
| LAB410 | 0.75 | 0.032 | B | 8 | LAB413 | 0.79 | 0.035 | G | 31 |
| LAB410 | 0.72 | 0.044 | G | 78 | LAB413 | 0.76 | 0.030 | B | 58 |
| LAB410 | 0.71 | 0.048 | G | 70 | LAB413 | 0.71 | 0.050 | G | 78 |
| LAB410 | 0.90 | 0.014 | L | 54 | LAB413 | 0.94 | 0.005 | L | 41 |
| LAB410 | 0.90 | 0.014 | G | 99 | LAB413 | 0.93 | 0.008 | L | 68 |
| LAB410 | 0.84 | 0.010 | G | 76 | LAB413 | 0.92 | 0.010 | L | 56 |
| LAB410 | 0.80 | 0.018 | G | 72 | LAB413 | −0.91 | 0.012 | L | 13 |
| LAB410 | 0.76 | 0.030 | G | 54 | LAB413 | 0.88 | 0.021 | G | 99 |
| LAB410 | 0.74 | 0.036 | G | 38 | LAB413 | −0.87 | 0.005 | D | 18 |
| LAB410 | −0.73 | 0.039 | D | 51 | LAB413 | −0.85 | 0.002 | N | 65 |
| LAB410 | 0.73 | 0.017 | O | 80 | LAB413 | −0.84 | 0.003 | N | 51 |
| LAB410 | −0.71 | 0.022 | P | 71 | LAB413 | 0.83 | 0.010 | G | 76 |
| LAB410 | 0.70 | 0.023 | E | 40 | LAB413 | −0.82 | 0.046 | L | 33 |
| LAB412 | 0.87 | 0.012 | G | 31 | LAB413 | 0.82 | 0.013 | B | 54 |
| LAB412 | −0.85 | 0.015 | K | 100 | LAB413 | −0.80 | 0.016 | D | 34 |
| LAB413 | 0.80 | 0.016 | D | 42 | LAB413 | 0.75 | 0.013 | M | 71 |
| LAB413 | −0.80 | 0.005 | E | 19 | LAB413 | 0.74 | 0.038 | B | 68 |
| LAB413 | 0.79 | 0.019 | B | 72 | LAB413 | 0.73 | 0.040 | G | 72 |
| LAB413 | −0.79 | 0.011 | K | 41 | LAB413 | −0.70 | 0.025 | E | 23 |
| LAB413 | 0.79 | 0.020 | G | 54 | LAB413 | 0.70 | 0.026 | P | 94 |
| LAB413 | 0.79 | 0.007 | N | 85 | LAB415 | 0.95 | 0.001 | G | 31 |
| LAB413 | 0.78 | 0.012 | K | 5 | LAB415 | 0.83 | 0.040 | L | 70 |
| LAB413 | −0.77 | 0.015 | K | 29 | LAB415 | −0.81 | 0.026 | K | 100 |
| LAB415 | 0.75 | 0.033 | G | 28 | LAB415 | −0.94 | 0.001 | D | 3 |
| LAB415 | 0.89 | 0.018 | L | 41 | LAB415 | 0.87 | 0.001 | R | 67 |
| LAB415 | 0.83 | 0.039 | L | 68 | LAB418 | 0.84 | 0.009 | G | 74 |
| LAB415 | 0.83 | 0.010 | G | 76 | LAB418 | 0.83 | 0.010 | G | 78 |
| LAB415 | 0.82 | 0.046 | L | 56 | LAB418 | 0.80 | 0.016 | G | 62 |
| LAB415 | −0.79 | 0.006 | Q | 85 | LAB418 | 0.79 | 0.019 | G | 70 |
| LAB415 | 0.77 | 0.024 | B | 1 | LAB418 | −0.79 | 0.034 | A | 28 |
| LAB415 | −0.77 | 0.016 | H | 5 | LAB418 | 0.75 | 0.031 | B | 28 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB415 | 0.75 | 0.019 | I | 17 | LAB418 | 0.75 | 0.032 | G | 43 |
| LAB415 | 0.75 | 0.012 | N | 69 | LAB418 | 0.73 | 0.038 | B | 66 |
| LAB415 | 0.75 | 0.012 | R | 53 | LAB418 | 0.93 | 0.001 | B | 50 |
| LAB415 | 0.74 | 0.014 | Q | 65 | LAB418 | 0.87 | 0.011 | H | 99 |
| LAB415 | 0.73 | 0.017 | M | 101 | LAB418 | 0.86 | 0.003 | K | 64 |
| LAB415 | 0.73 | 0.027 | J | 77 | LAB418 | 0.85 | 0.008 | D | 57 |
| LAB415 | 0.72 | 0.045 | G | 72 | LAB418 | 0.84 | 0.008 | G | 68 |
| LAB415 | 0.71 | 0.021 | Q | 51 | LAB418 | 0.84 | 0.009 | B | 64 |
| LAB417 | −0.90 | 0.015 | L | 12 | LAB418 | 0.84 | 0.009 | G | 38 |
| LAB417 | −0.87 | 0.025 | L | 52 | LAB418 | 0.84 | 0.002 | E | 2 |
| LAB417 | 0.85 | 0.033 | L | 58 | LAB418 | −0.83 | 0.010 | B | 41 |
| LAB417 | 0.83 | 0.041 | L | 70 | LAB418 | 0.83 | 0.003 | N | 39 |
| LAB417 | 0.82 | 0.045 | L | 62 | LAB418 | 0.82 | 0.047 | G | 99 |
| LAB417 | 0.80 | 0.017 | B | 70 | LAB418 | 0.82 | 0.007 | K | 50 |
| LAB417 | 0.75 | 0.031 | B | 58 | LAB418 | −0.81 | 0.014 | G | 7 |
| LAB417 | 0.75 | 0.033 | G | 62 | LAB418 | 0.81 | 0.014 | F | 42 |
| LAB417 | 0.73 | 0.038 | B | 74 | LAB418 | −0.80 | 0.010 | K | 60 |
| LAB417 | −0.72 | 0.042 | K | 47 | LAB418 | −0.80 | 0.006 | N | 77 |
| LAB417 | 0.71 | 0.050 | G | 55 | LAB418 | −0.77 | 0.010 | N | 95 |
| LAB417 | 0.95 | 0.003 | L | 68 | LAB418 | −0.76 | 0.049 | A | 41 |
| LAB417 | 0.93 | 0.008 | L | 56 | LAB418 | 0.74 | 0.034 | F | 57 |
| LAB417 | −0.88 | 0.019 | L | 13 | LAB418 | 0.74 | 0.022 | C | 19 |
| LAB417 | 0.88 | 0.004 | G | 76 | LAB418 | 0.74 | 0.023 | C | 32 |
| LAB417 | 0.86 | 0.006 | G | 72 | LAB418 | −0.73 | 0.024 | C | 79 |
| LAB417 | 0.83 | 0.041 | L | 41 | LAB418 | −0.73 | 0.040 | B | 60 |
| LAB417 | 0.80 | 0.006 | Q | 65 | LAB418 | 0.73 | 0.017 | R | 84 |
| LAB417 | −0.78 | 0.013 | I | 48 | LAB418 | 0.72 | 0.029 | K | 29 |
| LAB417 | 0.77 | 0.009 | N | 73 | LAB418 | −0.72 | 0.030 | H | 41 |
| LAB417 | 0.75 | 0.031 | G | 56 | LAB418 | 0.71 | 0.022 | P | 53 |
| LAB417 | 0.75 | 0.033 | G | 68 | LAB418 | 0.71 | 0.033 | C | 21 |
| LAB417 | −0.74 | 0.034 | B | 27 | LAB419 | 0.90 | 0.003 | G | 78 |
| LAB417 | 0.74 | 0.036 | G | 54 | LAB419 | 0.83 | 0.010 | G | 74 |
| LAB417 | 0.73 | 0.016 | N | 97 | LAB419 | 0.83 | 0.041 | L | 66 |
| LAB417 | −0.72 | 0.043 | B | 7 | LAB419 | 0.81 | 0.015 | G | 70 |
| LAB417 | −0.72 | 0.020 | Q | 85 | LAB419 | 0.79 | 0.019 | G | 62 |
| LAB417 | 0.71 | 0.031 | C | 71 | LAB419 | −0.77 | 0.015 | H | 35 |
| LAB417 | −0.71 | 0.050 | B | 33 | LAB419 | 0.77 | 0.016 | K | 8 |
| LAB417 | −0.70 | 0.024 | M | 94 | LAB419 | 0.76 | 0.029 | G | 55 |
| LAB418 | 0.89 | 0.007 | A | 35 | LAB419 | −0.72 | 0.044 | B | 28 |
| LAB418 | 0.87 | 0.002 | K | 28 | LAB419 | 0.71 | 0.047 | G | 28 |
| LAB418 | 0.85 | 0.007 | G | 4 | LAB419 | −0.90 | 0.001 | J | 34 |
| LAB419 | 0.85 | 0.007 | G | 76 | LAB419 | 0.71 | 0.023 | P | 88 |
| LAB419 | 0.84 | 0.005 | H | 56 | LAB419 | 0.70 | 0.023 | R | 82 |
| LAB419 | 0.82 | 0.012 | G | 72 | LAB420 | −0.95 | 0.003 | L | 43 |
| LAB419 | 0.81 | 0.015 | G | 68 | LAB420 | 0.90 | 0.001 | K | 28 |
| LAB419 | 0.80 | 0.018 | B | 60 | LAB420 | −0.86 | 0.026 | L | 26 |
| LAB419 | 0.79 | 0.020 | G | 54 | LAB420 | −0.86 | 0.029 | L | 78 |
| LAB419 | 0.78 | 0.023 | G | 56 | LAB420 | −0.85 | 0.014 | A | 66 |
| LAB419 | 0.75 | 0.019 | I | 36 | LAB420 | −0.82 | 0.045 | L | 74 |
| LAB420 | 0.75 | 0.032 | G | 55 | LAB420 | −0.87 | 0.004 | B | 41 |
| LAB420 | −0.84 | 0.009 | B | 7 | LAB420 | 0.84 | 0.009 | D | 57 |
| LAB420 | 0.82 | 0.003 | P | 84 | LAB421 | 0.70 | 0.034 | K | 64 |
| LAB420 | 0.80 | 0.016 | G | 54 | LAB423 | 0.95 | 0.003 | L | 70 |
| LAB420 | 0.78 | 0.013 | C | 32 | LAB423 | −0.95 | 0.004 | L | 12 |
| LAB420 | −0.76 | 0.011 | M | 81 | LAB423 | −0.94 | 0.002 | G | 47 |
| LAB420 | 0.74 | 0.022 | C | 59 | LAB423 | 0.92 | 0.009 | L | 74 |
| LAB420 | −0.73 | 0.025 | C | 79 | LAB423 | 0.89 | 0.019 | L | 78 |
| LAB420 | −0.73 | 0.040 | G | 7 | LAB423 | 0.87 | 0.026 | L | 6 |
| LAB421 | 0.92 | 0.004 | G | 31 | LAB423 | −0.84 | 0.036 | L | 52 |
| LAB421 | 0.91 | 0.011 | L | 70 | LAB423 | 0.83 | 0.020 | G | 31 |
| LAB421 | 0.87 | 0.023 | L | 74 | LAB423 | 0.73 | 0.025 | K | 6 |
| LAB421 | 0.86 | 0.006 | B | 58 | LAB423 | −0.72 | 0.027 | K | 66 |
| LAB421 | −0.85 | 0.033 | L | 52 | LAB423 | 0.72 | 0.042 | G | 55 |
| LAB421 | 0.84 | 0.037 | L | 78 | LAB423 | −0.72 | 0.028 | K | 28 |
| LAB421 | 0.83 | 0.041 | L | 58 | LAB423 | 0.70 | 0.035 | H | 26 |
| LAB421 | 0.83 | 0.022 | A | 66 | LAB423 | 0.75 | 0.020 | J | 73 |
| LAB421 | 0.82 | 0.007 | K | 28 | LAB423 | −0.72 | 0.043 | F | 73 |
| LAB421 | −0.80 | 0.031 | G | 47 | LAB423 | 0.95 | 0.004 | G | 99 |
| LAB421 | 0.76 | 0.028 | B | 70 | LAB423 | 0.93 | 0.001 | G | 76 |
| LAB421 | −0.74 | 0.022 | H | 8 | LAB423 | 0.93 | 0.008 | L | 41 |
| LAB421 | 0.74 | 0.036 | G | 55 | LAB423 | −0.90 | 0.001 | K | 64 |
| LAB421 | −0.74 | 0.036 | B | 6 | LAB423 | −0.90 | 0.002 | B | 27 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB421 | 0.72 | 0.045 | B | 74 | LAB423 | −0.89 | 0.018 | L | 13 |
| LAB421 | 0.94 | 0.001 | G | 76 | LAB423 | 0.89 | 0.003 | G | 72 |
| LAB421 | −0.94 | 0.001 | B | 7 | LAB423 | −0.88 | 0.010 | A | 5 |
| LAB421 | −0.92 | 1.75E−04 | O | 85 | LAB423 | −0.86 | 0.002 | E | 19 |
| LAB421 | −0.92 | 0.001 | B | 5 | LAB423 | 0.86 | 0.003 | I | 14 |
| LAB421 | 0.90 | 0.014 | L | 41 | LAB423 | 0.85 | 0.034 | L | 68 |
| LAB421 | 0.89 | 0.016 | L | 68 | LAB423 | 0.84 | 0.004 | K | 7 |
| LAB421 | 0.87 | 0.004 | G | 72 | LAB423 | −0.84 | 0.035 | L | 9 |
| LAB421 | 0.82 | 0.043 | L | 56 | LAB423 | −0.84 | 0.009 | B | 7 |
| LAB421 | 0.82 | 0.012 | G | 54 | LAB423 | 0.84 | 0.005 | H | 29 |
| LAB421 | 0.79 | 0.011 | K | 50 | LAB423 | 0.84 | 0.003 | Q | 65 |
| LAB421 | 0.79 | 0.020 | B | 64 | LAB423 | 0.83 | 0.005 | J | 77 |
| LAB421 | 0.79 | 0.035 | A | 50 | LAB423 | −0.83 | 0.003 | E | 23 |
| LAB421 | 0.78 | 0.013 | C | 44 | LAB423 | −0.82 | 0.013 | D | 61 |
| LAB421 | −0.78 | 0.014 | K | 60 | LAB423 | 0.82 | 0.047 | L | 56 |
| LAB421 | −0.77 | 0.041 | A | 60 | LAB423 | −0.81 | 0.004 | R | 86 |
| LAB421 | 0.77 | 0.025 | G | 68 | LAB423 | −0.81 | 0.004 | Q | 85 |
| LAB421 | −0.75 | 0.013 | R | 86 | LAB423 | 0.81 | 0.009 | I | 79 |
| LAB421 | 0.75 | 0.013 | M | 101 | LAB423 | 0.81 | 0.009 | K | 60 |
| LAB421 | 0.74 | 0.014 | R | 53 | LAB423 | −0.79 | 0.019 | F | 77 |
| LAB421 | 0.74 | 0.014 | P | 84 | LAB423 | 0.79 | 0.007 | M | 101 |
| LAB421 | 0.72 | 0.018 | O | 93 | LAB423 | 0.79 | 0.021 | G | 54 |
| LAB421 | 0.72 | 0.028 | H | 29 | LAB423 | 0.78 | 0.013 | K | 5 |
| LAB421 | −0.71 | 0.021 | E | 23 | LAB423 | 0.77 | 0.014 | J | 69 |
| LAB421 | 0.71 | 0.049 | B | 68 | LAB423 | −0.77 | 0.042 | A | 45 |
| LAB421 | −0.71 | 0.049 | B | 27 | LAB423 | 0.75 | 0.012 | N | 42 |
| LAB423 | −0.74 | 0.034 | D | 11 | LAB424 | 0.94 | 0.006 | L | 66 |
| LAB423 | 0.74 | 0.022 | I | 21 | LAB424 | 0.86 | 0.006 | G | 62 |
| LAB423 | −0.74 | 0.014 | P | 86 | LAB424 | 0.86 | 0.006 | G | 55 |
| LAB423 | 0.73 | 0.038 | B | 64 | LAB424 | 0.85 | 0.008 | B | 55 |
| LAB423 | 0.73 | 0.039 | F | 49 | LAB424 | 0.84 | 0.009 | G | 74 |
| LAB423 | 0.72 | 0.044 | G | 68 | LAB424 | 0.84 | 0.009 | G | 70 |
| LAB423 | 0.71 | 0.023 | P | 53 | LAB424 | 0.83 | 0.005 | H | 58 |
| LAB423 | 0.71 | 0.034 | H | 13 | LAB424 | 0.83 | 0.006 | K | 28 |
| LAB423 | 0.70 | 0.025 | Q | 51 | LAB424 | 0.81 | 0.014 | G | 78 |
| LAB423 | 0.70 | 0.037 | H | 27 | LAB424 | 0.81 | 0.008 | H | 55 |
| LAB424 | −0.81 | 0.028 | G | 47 | LAB425 | −0.74 | 0.022 | H | 35 |
| LAB424 | 0.76 | 0.049 | B | 100 | LAB425 | 0.73 | 0.039 | G | 74 |
| LAB424 | −0.75 | 0.031 | G | 16 | LAB425 | 0.73 | 0.040 | B | 70 |
| LAB424 | 0.73 | 0.041 | B | 74 | LAB425 | 0.94 | 0.005 | L | 41 |
| LAB424 | 0.72 | 0.028 | H | 74 | LAB425 | −0.93 | 7.57E−05 | Q | 85 |
| LAB424 | 0.72 | 0.030 | H | 78 | LAB425 | −0.91 | 2.22E−04 | O | 85 |
| LAB424 | 0.94 | 0.001 | G | 72 | LAB425 | 0.91 | 0.012 | L | 68 |
| LAB424 | −0.91 | 0.002 | B | 33 | LAB425 | −0.90 | 0.003 | D | 15 |
| LAB424 | −0.90 | 0.002 | D | 22 | LAB425 | 0.88 | 0.022 | L | 56 |
| LAB424 | −0.87 | 0.002 | H | 27 | LAB425 | 0.85 | 0.002 | N | 73 |
| LAB424 | 0.87 | 0.005 | G | 68 | LAB425 | 0.85 | 0.030 | G | 99 |
| LAB424 | −0.87 | 0.012 | B | 46 | LAB425 | −0.84 | 0.003 | R | 86 |
| LAB424 | 0.86 | 0.006 | G | 54 | LAB425 | 0.83 | 0.003 | N | 97 |
| LAB424 | 0.85 | 0.008 | G | 56 | LAB425 | 0.83 | 0.003 | R | 67 |
| LAB424 | −0.85 | 0.016 | A | 13 | LAB425 | 0.82 | 0.007 | K | 29 |
| LAB424 | 0.83 | 0.006 | H | 54 | LAB425 | 0.81 | 0.015 | G | 56 |
| LAB424 | 0.82 | 0.025 | A | 5 | LAB425 | 0.80 | 0.016 | B | 54 |
| LAB424 | 0.81 | 0.014 | B | 54 | LAB425 | −0.80 | 0.009 | C | 14 |
| LAB424 | 0.80 | 0.031 | A | 76 | LAB425 | 0.80 | 0.005 | R | 53 |
| LAB424 | 0.80 | 0.010 | K | 64 | LAB425 | 0.80 | 0.017 | G | 54 |
| LAB424 | 0.79 | 0.035 | A | 72 | LAB425 | −0.78 | 0.021 | B | 27 |
| LAB424 | 0.78 | 0.022 | G | 76 | LAB425 | 0.78 | 0.037 | A | 13 |
| LAB424 | 0.78 | 0.039 | A | 60 | LAB425 | 0.78 | 0.038 | K | 46 |
| LAB424 | 0.77 | 0.025 | F | 22 | LAB425 | 0.77 | 0.009 | N | 77 |
| LAB424 | 0.76 | 0.030 | D | 30 | LAB425 | 0.76 | 0.029 | G | 72 |
| LAB424 | 0.75 | 0.032 | B | 72 | LAB425 | 0.75 | 0.032 | G | 9 |
| LAB424 | −0.74 | 0.037 | G | 33 | LAB425 | 0.74 | 0.013 | Q | 65 |
| LAB424 | −0.73 | 0.016 | O | 73 | LAB425 | −0.74 | 0.014 | P | 86 |
| LAB424 | −0.73 | 0.025 | J | 15 | LAB425 | 0.74 | 0.037 | G | 29 |
| LAB424 | 0.71 | 0.031 | K | 38 | LAB427 | 0.83 | 0.006 | K | 78 |
| LAB424 | −0.71 | 0.022 | O | 97 | LAB427 | 0.82 | 0.007 | K | 74 |
| LAB425 | −0.95 | 0.001 | K | 100 | LAB427 | 0.81 | 0.027 | A | 66 |
| LAB425 | 0.92 | 0.004 | A | 66 | LAB427 | 0.80 | 0.009 | K | 70 |
| LAB425 | 0.91 | 0.013 | L | 70 | LAB427 | −0.78 | 0.021 | H | 47 |
| LAB425 | 0.90 | 0.015 | L | 78 | LAB427 | 0.77 | 0.026 | G | 78 |
| LAB425 | 0.89 | 0.017 | L | 62 | LAB427 | 0.72 | 0.042 | G | 74 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB425 | 0.89 | 0.018 | L | 74 | LAB427 | 0.71 | 0.047 | G | 70 |
| LAB425 | −0.86 | 0.027 | L | 52 | LAB427 | 0.71 | 0.049 | G | 28 |
| LAB425 | 0.85 | 0.008 | B | 58 | LAB427 | −0.93 | 0.007 | L | 50 |
| LAB425 | −0.84 | 0.010 | G | 35 | LAB427 | −0.81 | 0.009 | C | 71 |
| LAB425 | 0.81 | 0.016 | G | 55 | LAB427 | 0.80 | 0.009 | J | 65 |
| LAB425 | 0.78 | 0.023 | B | 55 | LAB427 | 0.80 | 0.018 | G | 76 |
| LAB425 | 0.78 | 0.023 | B | 74 | LAB427 | −0.78 | 0.012 | C | 75 |
| LAB425 | 0.77 | 0.024 | B | 78 | LAB427 | −0.78 | 0.023 | F | 34 |
| LAB425 | 0.76 | 0.018 | H | 26 | LAB427 | 0.77 | 0.014 | H | 56 |
| LAB425 | 0.75 | 0.033 | G | 78 | LAB427 | 0.77 | 0.025 | G | 72 |
| LAB425 | 0.74 | 0.021 | K | 26 | LAB427 | 0.76 | 0.030 | B | 60 |
| LAB427 | −0.75 | 0.019 | K | 7 | LAB428 | 0.85 | 0.032 | L | 74 |
| LAB427 | 0.74 | 0.022 | H | 76 | LAB428 | 0.85 | 0.016 | G | 31 |
| LAB427 | 0.74 | 0.023 | K | 64 | LAB428 | −0.82 | 0.007 | H | 70 |
| LAB427 | 0.72 | 0.046 | F | 22 | LAB428 | −0.81 | 0.008 | H | 78 |
| LAB427 | 0.71 | 0.048 | G | 54 | LAB428 | −0.81 | 0.009 | H | 43 |
| LAB428 | 0.94 | 0.005 | L | 58 | LAB428 | −0.80 | 0.029 | A | 8 |
| LAB428 | −0.92 | 0.010 | L | 52 | LAB428 | −0.77 | 0.024 | H | 31 |
| LAB428 | 0.91 | 0.011 | L | 70 | LAB428 | 0.77 | 0.042 | A | 12 |
| LAB428 | −0.88 | 0.009 | A | 62 | LAB428 | 0.77 | 0.027 | G | 55 |
| LAB428 | 0.86 | 0.012 | A | 66 | LAB428 | −0.76 | 0.018 | H | 74 |
| LAB428 | −0.75 | 0.019 | H | 55 | LAB429 | −0.76 | 0.017 | H | 4 |
| LAB428 | 0.74 | 0.036 | H | 47 | LAB429 | 0.74 | 0.034 | G | 4 |
| LAB428 | −0.71 | 0.033 | H | 62 | LAB429 | −0.92 | 4.16E−04 | I | 63 |
| LAB428 | −0.95 | 0.003 | L | 33 | LAB429 | 0.84 | 0.009 | G | 68 |
| LAB428 | 0.89 | 0.003 | G | 76 | LAB429 | −0.84 | 0.005 | I | 36 |
| LAB428 | 0.87 | 0.023 | L | 68 | LAB429 | 0.83 | 0.003 | O | 65 |
| LAB428 | 0.85 | 0.014 | A | 13 | LAB429 | 0.83 | 0.040 | L | 13 |
| LAB428 | −0.85 | 0.004 | H | 72 | LAB429 | −0.81 | 0.008 | K | 45 |
| LAB428 | −0.85 | 0.004 | H | 76 | LAB429 | 0.81 | 0.018 | K | 38 |
| LAB428 | −0.85 | 0.004 | H | 68 | LAB429 | 0.80 | 0.018 | G | 38 |
| LAB428 | 0.84 | 0.038 | L | 41 | LAB429 | −0.80 | 0.018 | B | 45 |
| LAB428 | −0.83 | 0.003 | R | 86 | LAB429 | 0.79 | 0.006 | R | 101 |
| LAB428 | −0.83 | 0.005 | H | 54 | LAB429 | 0.78 | 0.013 | I | 67 |
| LAB428 | 0.83 | 0.005 | J | 77 | LAB429 | 0.77 | 0.015 | I | 21 |
| LAB428 | 0.83 | 0.011 | G | 72 | LAB429 | 0.77 | 0.026 | G | 72 |
| LAB428 | 0.82 | 0.004 | P | 84 | LAB429 | 0.76 | 0.011 | O | 69 |
| LAB428 | 0.81 | 0.014 | G | 54 | LAB429 | −0.74 | 0.035 | F | 77 |
| LAB428 | −0.81 | 0.027 | A | 76 | LAB429 | −0.72 | 0.029 | Q | 102 |
| LAB428 | 0.80 | 0.010 | H | 9 | LAB429 | 0.71 | 0.047 | G | 76 |
| LAB428 | 0.80 | 0.010 | J | 69 | LAB430 | 0.96 | 0.002 | L | 70 |
| LAB428 | −0.79 | 0.036 | A | 5 | LAB430 | 0.91 | 0.002 | B | 78 |
| LAB428 | −0.77 | 0.044 | A | 68 | LAB430 | −0.91 | 0.005 | A | 52 |
| LAB428 | −0.76 | 0.046 | A | 72 | LAB430 | 0.90 | 0.014 | L | 62 |
| LAB428 | 0.76 | 0.017 | I | 59 | LAB430 | 0.89 | 0.003 | B | 74 |
| LAB428 | 0.76 | 0.011 | P | 94 | LAB430 | 0.88 | 0.004 | B | 70 |
| LAB428 | −0.76 | 0.029 | B | 27 | LAB430 | 0.87 | 0.026 | L | 43 |
| LAB428 | −0.76 | 0.030 | B | 7 | LAB430 | −0.87 | 0.026 | L | 52 |
| LAB428 | 0.75 | 0.012 | R | 67 | LAB430 | 0.87 | 0.026 | L | 55 |
| LAB428 | 0.74 | 0.023 | I | 10 | LAB430 | 0.84 | 0.017 | A | 74 |
| LAB428 | 0.74 | 0.024 | K | 38 | LAB430 | −0.84 | 0.009 | G | 12 |
| LAB428 | 0.73 | 0.040 | F | 49 | LAB430 | 0.82 | 0.006 | K | 70 |
| LAB428 | 0.73 | 0.026 | Q | 102 | LAB430 | 0.82 | 0.025 | A | 78 |
| LAB428 | −0.70 | 0.035 | K | 41 | LAB430 | −0.81 | 0.026 | G | 47 |
| LAB428 | 0.70 | 0.025 | R | 84 | LAB430 | 0.81 | 0.008 | K | 43 |
| LAB428 | 0.70 | 0.026 | M | 84 | LAB430 | 0.79 | 0.011 | K | 74 |
| LAB428 | 0.79 | 0.012 | J | 73 | LAB430 | 0.79 | 0.012 | K | 78 |
| LAB429 | 0.88 | 0.004 | G | 70 | LAB430 | 0.77 | 0.025 | G | 70 |
| LAB429 | 0.88 | 0.004 | G | 43 | LAB430 | 0.77 | 0.025 | B | 62 |
| LAB429 | 0.87 | 0.026 | L | 16 | LAB430 | 0.77 | 0.044 | A | 70 |
| LAB429 | −0.86 | 0.013 | A | 52 | LAB430 | 0.76 | 0.018 | K | 62 |
| LAB429 | 0.85 | 0.007 | G | 78 | LAB430 | 0.73 | 0.041 | G | 74 |
| LAB429 | 0.84 | 0.009 | G | 74 | LAB430 | 0.73 | 0.041 | G | 43 |
| LAB429 | 0.83 | 0.010 | G | 62 | LAB430 | 0.72 | 0.042 | B | 28 |
| LAB429 | 0.83 | 0.012 | G | 28 | LAB430 | 0.72 | 0.042 | G | 78 |
| LAB429 | 0.82 | 0.046 | L | 35 | LAB430 | −0.71 | 0.030 | K | 16 |
| LAB429 | 0.78 | 0.013 | H | 16 | LAB430 | −0.71 | 0.048 | G | 16 |
| LAB429 | 0.77 | 0.025 | B | 4 | LAB430 | 0.89 | 0.018 | L | 72 |
| LAB430 | −0.87 | 0.001 | O | 83 | LAB430 | 0.78 | 0.013 | K | 68 |
| LAB430 | 0.85 | 0.031 | L | 68 | LAB430 | −0.77 | 0.009 | N | 83 |
| LAB430 | 0.85 | 0.016 | A | 41 | LAB430 | −0.77 | 0.010 | Q | 87 |
| LAB430 | −0.83 | 0.003 | O | 87 | LAB430 | 0.76 | 0.027 | B | 56 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB430 | 0.82 | 0.023 | B | 99 | LAB430 | −0.76 | 0.010 | Q | 51 |
| LAB430 | 0.82 | 0.047 | L | 54 | LAB430 | 0.76 | 0.048 | K | 99 |
| LAB430 | −0.82 | 0.004 | O | 91 | LAB430 | 0.76 | 0.030 | G | 72 |
| LAB430 | 0.81 | 0.008 | K | 72 | LAB430 | 0.75 | 0.031 | B | 68 |
| LAB430 | −0.81 | 0.005 | O | 89 | LAB430 | 0.72 | 0.042 | B | 76 |
| LAB430 | 0.80 | 0.018 | B | 72 | LAB430 | 0.72 | 0.028 | K | 76 |
| LAB430 | −0.72 | 0.044 | D | 49 | LAB431 | 0.84 | 0.002 | R | 94 |
| LAB430 | −0.72 | 0.019 | N | 39 | LAB431 | 0.82 | 0.007 | H | 76 |
| LAB430 | −0.70 | 0.024 | R | 88 | LAB431 | 0.79 | 0.019 | G | 41 |
| LAB430 | −0.70 | 0.037 | H | 13 | LAB431 | −0.79 | 0.033 | K | 99 |
| LAB431 | 0.92 | 0.009 | L | 35 | LAB431 | 0.79 | 0.019 | B | 41 |
| LAB431 | −0.90 | 0.001 | H | 28 | LAB431 | 0.79 | 0.012 | C | 23 |
| LAB431 | 0.89 | 0.017 | L | 28 | LAB431 | −0.78 | 0.022 | B | 50 |
| LAB431 | −0.89 | 0.002 | H | 12 | LAB431 | 0.78 | 0.008 | N | 80 |
| LAB431 | −0.88 | 0.004 | H | 47 | LAB431 | −0.78 | 0.014 | H | 9 |
| LAB431 | 0.87 | 0.002 | H | 70 | LAB431 | 0.77 | 0.014 | K | 41 |
| LAB431 | −0.86 | 0.028 | L | 66 | LAB431 | 0.77 | 0.009 | M | 67 |
| LAB431 | −0.85 | 0.031 | L | 4 | LAB431 | 0.77 | 0.015 | J | 11 |
| LAB431 | 0.84 | 0.009 | B | 58 | LAB431 | 0.77 | 0.016 | J | 30 |
| LAB431 | 0.84 | 0.019 | A | 35 | LAB431 | 0.76 | 0.019 | J | 15 |
| LAB431 | −0.82 | 0.025 | B | 31 | LAB431 | 0.75 | 0.019 | H | 54 |
| LAB431 | 0.80 | 0.010 | H | 62 | LAB431 | 0.74 | 0.037 | F | 61 |
| LAB431 | 0.79 | 0.012 | H | 78 | LAB431 | 0.73 | 0.017 | M | 101 |
| LAB431 | 0.79 | 0.012 | H | 43 | LAB431 | −0.73 | 0.042 | G | 13 |
| LAB431 | −0.78 | 0.024 | B | 66 | LAB431 | 0.72 | 0.028 | C | 21 |
| LAB431 | 0.78 | 0.024 | B | 6 | LAB431 | 0.72 | 0.028 | C | 19 |
| LAB431 | 0.77 | 0.014 | H | 74 | LAB431 | −0.72 | 0.044 | D | 34 |
| LAB431 | −0.77 | 0.043 | A | 58 | LAB431 | 0.72 | 0.020 | N | 42 |
| LAB431 | −0.76 | 0.049 | A | 28 | LAB431 | 0.71 | 0.032 | I | 14 |
| LAB431 | −0.74 | 0.022 | K | 66 | LAB431 | −0.71 | 0.022 | P | 88 |
| LAB431 | 0.73 | 0.042 | B | 8 | LAB431 | 0.71 | 0.022 | R | 84 |
| LAB431 | −0.72 | 0.045 | B | 12 | LAB431 | 0.71 | 0.049 | G | 27 |
| LAB431 | 0.70 | 0.037 | H | 55 | LAB431 | 0.70 | 0.025 | M | 96 |
| LAB431 | 0.95 | 2.95E−04 | D | 30 | LAB432 | −0.96 | 0.002 | L | 26 |
| LAB431 | −0.95 | 3.43E−04 | B | 13 | LAB432 | −0.96 | 0.001 | A | 52 |
| LAB431 | 0.93 | 0.007 | L | 7 | LAB432 | 0.93 | 0.003 | A | 74 |
| LAB431 | 0.93 | 2.44E−04 | C | 59 | LAB432 | 0.92 | 0.004 | A | 70 |
| LAB431 | −0.93 | 0.007 | L | 38 | LAB432 | 0.89 | 0.007 | A | 78 |
| LAB431 | 0.93 | 2.86E−04 | C | 10 | LAB432 | 0.89 | 0.007 | A | 62 |
| LAB431 | 0.92 | 0.009 | L | 5 | LAB432 | 0.86 | 0.014 | A | 58 |
| LAB431 | −0.91 | 0.011 | L | 60 | LAB432 | 0.84 | 0.036 | L | 4 |
| LAB431 | 0.91 | 0.001 | C | 32 | LAB432 | 0.84 | 0.019 | A | 55 |
| LAB431 | −0.90 | 0.015 | L | 76 | LAB432 | 0.83 | 0.021 | A | 43 |
| LAB431 | 0.90 | 0.003 | D | 11 | LAB432 | −0.81 | 0.007 | H | 28 |
| LAB431 | −0.88 | 0.003 | D | 57 | LAB432 | −0.80 | 0.017 | G | 43 |
| LAB431 | 0.88 | 0.002 | H | 68 | LAB432 | −0.80 | 0.031 | A | 16 |
| LAB431 | −0.88 | 0.004 | B | 29 | LAB432 | −0.79 | 0.020 | H | 47 |
| LAB431 | 0.87 | 0.025 | L | 27 | LAB432 | −0.78 | 0.040 | B | 100 |
| LAB431 | 0.87 | 0.002 | H | 72 | LAB432 | −0.76 | 0.028 | G | 62 |
| LAB431 | 0.86 | 0.006 | B | 5 | LAB432 | 0.75 | 0.033 | B | 55 |
| LAB431 | 0.86 | 0.007 | D | 15 | LAB432 | −0.70 | 0.037 | H | 16 |
| LAB431 | −0.84 | 0.005 | J | 51 | LAB432 | 0.90 | 0.006 | B | 46 |
| LAB431 | −0.84 | 0.037 | L | 29 | LAB432 | −0.89 | 0.001 | I | 14 |
| LAB432 | 0.88 | 0.004 | B | 27 | LAB432 | 0.82 | 0.025 | A | 72 |
| LAB432 | 0.88 | 0.009 | A | 68 | LAB432 | −0.82 | 0.026 | A | 13 |
| LAB432 | −0.87 | 0.011 | A | 33 | LAB432 | −0.81 | 0.049 | L | 76 |
| LAB432 | 0.87 | 0.005 | B | 7 | LAB432 | 0.81 | 0.050 | L | 1 |
| LAB432 | −0.85 | 0.030 | L | 5 | LAB432 | −0.80 | 0.010 | J | 51 |
| LAB432 | −0.85 | 0.016 | K | 99 | LAB432 | 0.80 | 0.018 | B | 54 |
| LAB432 | 0.84 | 0.017 | A | 41 | LAB432 | 0.79 | 0.036 | A | 54 |
| LAB432 | −0.84 | 0.005 | C | 21 | LAB432 | 0.78 | 0.012 | H | 72 |
| LAB432 | 0.83 | 0.010 | B | 33 | LAB432 | 0.78 | 0.013 | H | 76 |
| LAB432 | 0.82 | 0.022 | A | 56 | LAB432 | 0.78 | 0.023 | B | 72 |
| LAB432 | −0.77 | 0.026 | G | 38 | LAB434 | 0.85 | 0.031 | G | 99 |
| LAB432 | 0.76 | 0.027 | D | 77 | LAB434 | −0.80 | 0.018 | F | 49 |
| LAB432 | 0.76 | 0.011 | P | 44 | LAB434 | −0.77 | 0.009 | R | 44 |
| LAB432 | −0.75 | 0.012 | N | 73 | LAB434 | −0.71 | 0.047 | F | 30 |
| LAB432 | −0.74 | 0.014 | N | 97 | LAB435 | −0.95 | 0.003 | A | 47 |
| LAB432 | 0.74 | 0.023 | J | 61 | LAB435 | 0.94 | 0.001 | B | 70 |
| LAB432 | −0.74 | 0.015 | N | 69 | LAB435 | 0.91 | 0.002 | B | 78 |
| LAB432 | −0.74 | 0.024 | I | 2 | LAB435 | 0.90 | 0.002 | B | 74 |
| LAB432 | −0.73 | 0.038 | G | 68 | LAB435 | 0.85 | 0.032 | L | 28 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB432 | 0.72 | 0.044 | G | 27 | LAB435 | 0.85 | 0.033 | A | 31 |
| LAB432 | 0.71 | 0.031 | J | 30 | LAB435 | 0.82 | 0.006 | H | 58 |
| LAB432 | 0.71 | 0.021 | R | 44 | LAB435 | 0.82 | 0.045 | L | 8 |
| LAB432 | 0.71 | 0.049 | D | 69 | LAB435 | 0.82 | 0.046 | L | 78 |
| LAB433 | 0.83 | 0.043 | L | 66 | LAB435 | 0.81 | 0.008 | K | 35 |
| LAB433 | 0.81 | 0.027 | G | 31 | LAB435 | 0.80 | 0.016 | G | 35 |
| LAB433 | 0.80 | 0.018 | H | 47 | LAB435 | 0.79 | 0.019 | B | 62 |
| LAB433 | −0.76 | 0.027 | H | 31 | LAB435 | 0.79 | 0.020 | B | 28 |
| LAB433 | −0.72 | 0.045 | B | 28 | LAB435 | −0.78 | 0.021 | H | 47 |
| LAB433 | −0.90 | 0.006 | A | 60 | LAB435 | 0.78 | 0.014 | H | 70 |
| LAB433 | −0.89 | 0.007 | H | 99 | LAB435 | 0.76 | 0.029 | B | 43 |
| LAB433 | 0.84 | 0.009 | D | 11 | LAB435 | 0.75 | 0.021 | H | 43 |
| LAB433 | −0.83 | 0.006 | H | 76 | LAB435 | 0.72 | 0.027 | H | 78 |
| LAB433 | 0.83 | 0.022 | A | 50 | LAB435 | 0.72 | 0.030 | H | 55 |
| LAB433 | 0.83 | 0.011 | D | 15 | LAB435 | 0.70 | 0.035 | H | 62 |
| LAB433 | −0.78 | 0.014 | C | 21 | LAB435 | 0.70 | 0.037 | H | 74 |
| LAB433 | 0.76 | 0.027 | B | 60 | LAB435 | 0.94 | 1.61E−04 | J | 11 |
| LAB433 | 0.75 | 0.020 | I | 63 | LAB435 | 0.94 | 2.05E−04 | C | 17 |
| LAB433 | 0.75 | 0.033 | D | 30 | LAB435 | 0.91 | 2.77E−04 | E | 14 |
| LAB433 | 0.72 | 0.043 | F | 3 | LAB435 | 0.88 | 0.021 | L | 7 |
| LAB433 | 0.71 | 0.047 | G | 76 | LAB435 | 0.87 | 0.011 | A | 45 |
| LAB433 | −0.71 | 0.032 | H | 72 | LAB435 | 0.87 | 0.002 | H | 72 |
| LAB433 | 0.71 | 0.022 | P | 90 | LAB435 | 0.87 | 0.005 | B | 68 |
| LAB433 | −0.70 | 0.036 | I | 48 | LAB435 | −0.86 | 0.027 | L | 60 |
| LAB434 | 0.85 | 0.015 | A | 62 | LAB435 | 0.85 | 0.030 | L | 5 |
| LAB434 | 0.84 | 0.034 | L | 55 | LAB435 | 0.85 | 0.016 | A | 5 |
| LAB434 | −0.83 | 0.021 | A | 16 | LAB435 | 0.84 | 0.004 | H | 76 |
| LAB434 | 0.82 | 0.023 | A | 55 | LAB435 | 0.84 | 0.038 | L | 27 |
| LAB434 | 0.81 | 0.015 | G | 28 | LAB435 | 0.83 | 0.003 | M | 84 |
| LAB434 | 0.78 | 0.013 | K | 28 | LAB435 | 0.83 | 0.006 | C | 19 |
| LAB434 | −0.74 | 0.024 | H | 35 | LAB435 | 0.83 | 0.003 | E | 67 |
| LAB434 | 0.96 | 4.75E−04 | A | 72 | LAB435 | −0.83 | 0.006 | J | 22 |
| LAB434 | 0.95 | 0.001 | A | 76 | LAB435 | 0.82 | 0.006 | H | 68 |
| LAB434 | −0.90 | 3.21E−04 | P | 86 | LAB435 | 0.82 | 0.007 | C | 32 |
| LAB434 | −0.90 | 0.006 | A | 13 | LAB435 | −0.82 | 0.024 | A | 13 |
| LAB434 | 0.87 | 0.011 | A | 68 | LAB435 | 0.82 | 0.013 | B | 64 |
| LAB434 | 0.86 | 0.027 | L | 54 | LAB435 | −0.81 | 0.050 | G | 99 |
| LAB434 | 0.86 | 0.012 | A | 54 | LAB435 | 0.80 | 0.005 | E | 40 |
| LAB435 | 0.80 | 0.030 | A | 60 | LAB435 | 0.76 | 0.018 | I | 32 |
| LAB435 | 0.80 | 0.009 | H | 54 | LAB435 | −0.75 | 0.013 | E | 63 |
| LAB435 | 0.80 | 0.017 | F | 11 | LAB435 | −0.74 | 0.022 | H | 27 |
| LAB435 | 0.80 | 0.017 | D | 57 | LAB435 | 0.74 | 0.038 | F | 22 |
| LAB435 | 0.78 | 0.039 | A | 76 | LAB435 | 0.73 | 0.027 | I | 10 |
| LAB435 | −0.78 | 0.008 | N | 89 | LAB435 | −0.73 | 0.018 | N | 91 |
| LAB435 | 0.78 | 0.013 | J | 30 | LAB435 | −0.72 | 0.043 | B | 45 |
| LAB435 | 0.78 | 0.024 | B | 72 | LAB435 | −0.72 | 0.030 | I | 79 |
| LAB435 | −0.77 | 0.009 | Q | 83 | LAB435 | 0.71 | 0.047 | F | 65 |
| LAB435 | 0.76 | 0.048 | A | 72 | LAB435 | −0.71 | 0.047 | B | 76 |
| LAB435 | −0.71 | 0.047 | F | 34 | LAB437 | −0.74 | 0.023 | C | 14 |
| LAB435 | 0.71 | 0.021 | R | 84 | LAB437 | 0.73 | 0.024 | H | 54 |
| LAB435 | 0.70 | 0.034 | C | 59 | LAB437 | −0.73 | 0.016 | P | 86 |
| LAB436 | −0.88 | 0.009 | A | 62 | LAB437 | 0.73 | 0.026 | K | 29 |
| LAB436 | 0.88 | 0.022 | L | 4 | LAB437 | 0.72 | 0.030 | K | 50 |
| LAB436 | 0.87 | 0.005 | G | 55 | LAB437 | −0.71 | 0.031 | J | 34 |
| LAB436 | 0.86 | 0.026 | L | 43 | LAB438 | 0.86 | 0.029 | L | 62 |
| LAB436 | −0.86 | 0.014 | G | 47 | LAB438 | −0.86 | 0.003 | H | 4 |
| LAB436 | −0.84 | 0.034 | L | 26 | LAB438 | −0.74 | 0.022 | K | 4 |
| LAB436 | −0.80 | 0.031 | A | 78 | LAB438 | −0.78 | 0.024 | D | 73 |
| LAB436 | 0.78 | 0.022 | G | 78 | LAB438 | 0.95 | 0.001 | A | 5 |
| LAB436 | 0.78 | 0.041 | G | 31 | LAB438 | 0.89 | 0.003 | D | 34 |
| LAB436 | 0.76 | 0.050 | A | 35 | LAB438 | −0.89 | 0.001 | H | 38 |
| LAB436 | 0.74 | 0.035 | G | 70 | LAB438 | −0.87 | 0.005 | B | 45 |
| LAB436 | 0.74 | 0.037 | G | 74 | LAB438 | −0.87 | 0.005 | B | 60 |
| LAB436 | 0.94 | 0.005 | L | 1 | LAB438 | −0.84 | 0.035 | L | 13 |
| LAB436 | 0.93 | 0.001 | G | 54 | LAB438 | −0.84 | 0.009 | D | 69 |
| LAB436 | 0.89 | 0.003 | G | 72 | LAB438 | 0.82 | 0.007 | I | 14 |
| LAB436 | 0.89 | 0.003 | G | 76 | LAB438 | 0.82 | 0.004 | O | 39 |
| LAB436 | −0.87 | 0.005 | B | 7 | LAB438 | 0.81 | 0.004 | Q | 39 |
| LAB436 | −0.78 | 0.039 | A | 72 | LAB438 | 0.81 | 0.029 | A | 29 |
| LAB436 | −0.76 | 0.018 | K | 45 | LAB438 | 0.81 | 0.005 | N | 39 |
| LAB436 | −0.75 | 0.030 | D | 34 | LAB438 | 0.80 | 0.009 | I | 40 |
| LAB436 | −0.74 | 0.037 | B | 5 | LAB438 | −0.79 | 0.012 | K | 45 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB436 | 0.72 | 0.043 | G | 68 | LAB438 | −0.77 | 0.024 | D | 18 |
| LAB436 | −0.72 | 0.045 | G | 27 | LAB438 | −0.76 | 0.046 | A | 13 |
| LAB436 | 0.71 | 0.032 | J | 34 | LAB438 | −0.75 | 0.019 | K | 1 |
| LAB436 | −0.70 | 0.025 | R | 44 | LAB438 | −0.75 | 0.013 | N | 89 |
| LAB437 | 0.89 | 0.003 | G | 78 | LAB438 | −0.75 | 0.013 | N | 91 |
| LAB437 | 0.89 | 0.003 | G | 74 | LAB438 | 0.74 | 0.014 | P | 84 |
| LAB437 | 0.88 | 0.004 | G | 70 | LAB438 | 0.74 | 0.038 | B | 64 |
| LAB437 | 0.83 | 0.005 | K | 28 | LAB438 | −0.73 | 0.041 | D | 77 |
| LAB437 | −0.82 | 0.023 | A | 66 | LAB438 | 0.72 | 0.019 | E | 67 |
| LAB437 | 0.77 | 0.042 | G | 31 | LAB438 | −0.71 | 0.049 | F | 77 |
| LAB437 | 0.72 | 0.042 | B | 66 | LAB438 | 0.70 | 0.023 | R | 82 |
| LAB437 | 0.71 | 0.048 | G | 43 | LAB439 | 0.91 | 0.005 | A | 55 |
| LAB437 | −0.87 | 0.005 | B | 7 | LAB439 | −0.90 | 0.005 | A | 16 |
| LAB437 | 0.85 | 0.030 | G | 99 | LAB439 | 0.88 | 0.004 | B | 58 |
| LAB437 | −0.85 | 0.002 | N | 69 | LAB439 | −0.86 | 0.027 | L | 8 |
| LAB437 | −0.84 | 0.004 | C | 79 | LAB439 | 0.84 | 0.037 | L | 43 |
| LAB437 | 0.83 | 0.010 | B | 64 | LAB439 | 0.82 | 0.045 | L | 4 |
| LAB437 | 0.80 | 0.009 | K | 64 | LAB439 | 0.75 | 0.021 | K | 6 |
| LAB437 | −0.80 | 0.018 | B | 41 | LAB439 | 0.71 | 0.050 | G | 35 |
| LAB437 | 0.79 | 0.006 | P | 84 | LAB439 | 0.70 | 0.037 | K | 8 |
| LAB437 | 0.77 | 0.009 | E | 2 | LAB439 | 0.91 | 0.005 | A | 54 |
| LAB437 | 0.75 | 0.020 | H | 72 | LAB439 | 0.90 | 0.014 | L | 1 |
| LAB437 | 0.75 | 0.021 | H | 76 | LAB439 | −0.88 | 0.002 | H | 38 |
| LAB439 | 0.84 | 0.003 | N | 93 | LAB440 | 0.93 | 0.007 | L | 70 |
| LAB439 | 0.80 | 0.029 | A | 38 | LAB440 | −0.90 | 0.013 | L | 52 |
| LAB439 | −0.80 | 0.017 | B | 27 | LAB440 | 0.89 | 0.016 | L | 74 |
| LAB439 | −0.80 | 0.030 | K | 99 | LAB440 | 0.89 | 0.018 | L | 78 |
| LAB439 | 0.78 | 0.040 | A | 68 | LAB440 | 0.88 | 0.022 | L | 62 |
| LAB439 | 0.77 | 0.026 | D | 42 | LAB440 | 0.87 | 0.002 | K | 8 |
| LAB439 | −0.75 | 0.031 | G | 56 | LAB440 | 0.84 | 0.038 | L | 58 |
| LAB439 | −0.75 | 0.034 | D | 20 | LAB440 | 0.81 | 0.027 | G | 31 |
| LAB439 | 0.73 | 0.017 | O | 42 | LAB440 | 0.81 | 0.009 | K | 6 |
| LAB439 | −0.71 | 0.049 | G | 5 | LAB440 | 0.78 | 0.023 | G | 55 |
| LAB440 | 0.72 | 0.043 | G | 78 | LAB443 | 0.79 | 0.034 | B | 99 |
| LAB440 | 0.92 | 0.010 | L | 41 | LAB443 | −0.79 | 0.012 | H | 1 |
| LAB440 | 0.90 | 0.016 | L | 68 | LAB443 | 0.77 | 0.014 | K | 76 |
| LAB440 | −0.87 | 0.001 | R | 44 | LAB443 | −0.77 | 0.009 | M | 88 |
| LAB440 | −0.86 | 0.006 | B | 27 | LAB443 | −0.76 | 0.017 | I | 44 |
| LAB440 | 0.82 | 0.012 | G | 76 | LAB443 | 0.76 | 0.048 | A | 5 |
| LAB440 | 0.82 | 0.012 | G | 54 | LAB443 | 0.76 | 0.029 | D | 20 |
| LAB440 | 0.82 | 0.047 | L | 56 | LAB443 | 0.76 | 0.030 | D | 15 |
| LAB440 | 0.81 | 0.014 | G | 72 | LAB443 | 0.73 | 0.025 | K | 72 |
| LAB440 | −0.81 | 0.016 | B | 7 | LAB443 | −0.73 | 0.016 | M | 90 |
| LAB440 | −0.80 | 0.031 | A | 45 | LAB443 | 0.73 | 0.026 | K | 68 |
| LAB440 | −0.77 | 0.015 | I | 44 | LAB443 | 0.73 | 0.041 | B | 76 |
| LAB440 | 0.74 | 0.015 | M | 53 | LAB443 | −0.72 | 0.020 | M | 92 |
| LAB440 | −0.73 | 0.040 | D | 49 | LAB443 | −0.71 | 0.022 | P | 71 |
| LAB440 | 0.72 | 0.043 | G | 68 | LAB443 | 0.71 | 0.022 | O | 85 |
| LAB442 | 0.92 | 0.003 | A | 66 | LAB444 | 0.95 | 3.32E−04 | G | 74 |
| LAB442 | 0.89 | 0.018 | L | 66 | LAB444 | 0.94 | 0.001 | G | 78 |
| LAB442 | 0.84 | 0.010 | G | 43 | LAB444 | 0.92 | 0.009 | L | 55 |
| LAB442 | 0.81 | 0.016 | G | 62 | LAB444 | 0.91 | 0.002 | G | 55 |
| LAB442 | −0.78 | 0.040 | A | 62 | LAB444 | 0.90 | 0.013 | L | 70 |
| LAB442 | −0.78 | 0.024 | B | 28 | LAB444 | 0.89 | 0.019 | L | 74 |
| LAB442 | 0.77 | 0.027 | G | 4 | LAB444 | 0.88 | 0.004 | G | 70 |
| LAB442 | 0.75 | 0.033 | G | 70 | LAB444 | −0.84 | 0.017 | G | 47 |
| LAB442 | 0.89 | 4.82E−04 | P | 92 | LAB444 | 0.80 | 0.009 | H | 55 |
| LAB442 | 0.89 | 0.001 | P | 90 | LAB444 | 0.80 | 0.010 | K | 58 |
| LAB442 | 0.86 | 0.001 | P | 88 | LAB444 | 0.73 | 0.038 | G | 62 |
| LAB442 | 0.85 | 0.007 | G | 68 | LAB444 | 0.73 | 0.041 | B | 70 |
| LAB442 | −0.79 | 0.036 | A | 76 | LAB444 | 0.72 | 0.029 | K | 78 |
| LAB442 | 0.78 | 0.038 | A | 13 | LAB444 | 0.71 | 0.031 | H | 78 |
| LAB442 | −0.77 | 0.044 | A | 72 | LAB444 | −0.71 | 0.049 | K | 47 |
| LAB442 | −0.76 | 0.017 | O | 102 | LAB444 | 0.70 | 0.035 | K | 74 |
| LAB442 | 0.75 | 0.012 | R | 92 | LAB444 | 0.70 | 0.038 | H | 74 |
| LAB442 | 0.73 | 0.041 | F | 22 | LAB444 | 0.70 | 0.038 | K | 70 |
| LAB442 | 0.73 | 0.017 | R | 90 | LAB444 | 0.90 | 0.015 | L | 54 |
| LAB442 | −0.73 | 0.027 | C | 71 | LAB444 | 0.89 | 0.003 | G | 54 |
| LAB442 | 0.72 | 0.045 | B | 60 | LAB444 | 0.87 | 0.005 | G | 56 |
| LAB443 | 0.84 | 0.009 | K | 31 | LAB444 | −0.87 | 0.011 | A | 7 |
| LAB443 | −0.83 | 0.040 | L | 78 | LAB444 | 0.84 | 0.009 | G | 72 |
| LAB443 | −0.81 | 0.049 | L | 55 | LAB444 | 0.84 | 0.037 | L | 41 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB443 | −0.80 | 0.032 | B | 47 | LAB444 | −0.84 | 0.010 | B | 7 |
| LAB443 | 0.75 | 0.021 | K | 28 | LAB444 | 0.83 | 0.043 | L | 68 |
| LAB443 | 0.72 | 0.043 | G | 8 | LAB444 | −0.81 | 0.015 | B | 27 |
| LAB443 | −0.88 | 0.020 | L | 41 | LAB444 | 0.81 | 0.005 | M | 67 |
| LAB443 | −0.87 | 0.023 | L | 76 | LAB444 | 0.80 | 0.005 | M | 101 |
| LAB443 | −0.87 | 0.024 | L | 72 | LAB444 | 0.76 | 0.018 | H | 54 |
| LAB443 | −0.82 | 0.004 | N | 83 | LAB444 | 0.75 | 0.033 | B | 64 |
| LAB443 | 0.81 | 0.016 | F | 15 | LAB444 | 0.74 | 0.022 | C | 40 |
| LAB444 | 0.74 | 0.037 | G | 68 | LAB445 | 0.92 | 0.003 | A | 70 |
| LAB444 | 0.73 | 0.027 | H | 45 | LAB445 | 0.91 | 0.002 | B | 8 |
| LAB444 | 0.72 | 0.029 | K | 54 | LAB445 | 0.90 | 0.002 | B | 74 |
| LAB444 | 0.71 | 0.049 | G | 76 | LAB445 | 0.89 | 0.007 | A | 62 |
| LAB444 | −0.70 | 0.024 | N | 91 | LAB445 | 0.89 | 0.003 | B | 6 |
| LAB444 | 0.70 | 0.024 | P | 53 | LAB445 | 0.87 | 0.006 | B | 78 |
| LAB445 | 0.94 | 0.005 | L | 28 | LAB445 | −0.86 | 0.027 | L | 66 |
| LAB445 | 0.94 | 0.001 | A | 43 | LAB445 | −0.84 | 0.008 | H | 47 |
| LAB445 | 0.94 | 0.001 | A | 78 | LAB445 | −0.84 | 0.004 | H | 12 |
| LAB445 | 0.93 | 0.002 | A | 74 | LAB445 | −0.84 | 0.019 | A | 66 |
| LAB445 | 0.82 | 0.013 | B | 62 | LAB446 | 0.72 | 0.042 | G | 70 |
| LAB445 | −0.82 | 0.025 | A | 52 | LAB446 | −0.72 | 0.043 | H | 47 |
| LAB445 | 0.81 | 0.048 | L | 62 | LAB446 | 0.71 | 0.049 | G | 58 |
| LAB445 | −0.79 | 0.036 | K | 100 | LAB446 | −0.88 | 0.002 | I | 32 |
| LAB445 | 0.77 | 0.042 | A | 55 | LAB446 | 0.86 | 0.003 | C | 59 |
| LAB445 | −0.77 | 0.026 | G | 66 | LAB446 | −0.86 | 0.003 | I | 2 |
| LAB445 | 0.76 | 0.046 | B | 47 | LAB446 | −0.81 | 0.008 | I | 10 |
| LAB445 | 0.74 | 0.022 | H | 43 | LAB446 | −0.80 | 0.029 | A | 13 |
| LAB445 | 0.92 | 3.73E−04 | C | 67 | LAB446 | −0.79 | 0.007 | P | 81 |
| LAB445 | 0.86 | 0.001 | Q | 95 | LAB446 | −0.79 | 0.012 | I | 19 |
| LAB445 | −0.86 | 0.001 | R | 92 | LAB446 | 0.78 | 0.013 | H | 72 |
| LAB445 | −0.85 | 0.002 | R | 90 | LAB446 | 0.75 | 0.033 | B | 64 |
| LAB445 | −0.85 | 0.004 | C | 63 | LAB446 | 0.74 | 0.022 | H | 56 |
| LAB445 | −0.85 | 0.032 | L | 60 | LAB446 | 0.73 | 0.039 | B | 68 |
| LAB445 | 0.85 | 0.004 | K | 41 | LAB446 | 0.72 | 0.029 | H | 76 |
| LAB445 | −0.84 | 0.009 | D | 18 | LAB446 | 0.72 | 0.045 | B | 72 |
| LAB445 | 0.84 | 0.009 | B | 68 | LAB446 | −0.72 | 0.046 | B | 7 |
| LAB445 | 0.84 | 0.019 | A | 41 | LAB446 | −0.72 | 0.020 | N | 85 |
| LAB445 | 0.83 | 0.011 | D | 22 | LAB446 | 0.70 | 0.034 | H | 54 |
| LAB445 | 0.83 | 0.043 | L | 76 | LAB446 | −0.70 | 0.024 | R | 44 |
| LAB445 | −0.82 | 0.007 | H | 13 | LAB446 | −0.70 | 0.036 | J | 77 |
| LAB445 | −0.82 | 0.004 | R | 88 | LAB447 | 0.86 | 0.006 | B | 58 |
| LAB445 | −0.81 | 0.004 | Q | 39 | LAB447 | −0.85 | 0.033 | L | 12 |
| LAB445 | −0.80 | 0.017 | F | 49 | LAB447 | 0.83 | 0.021 | G | 31 |
| LAB445 | −0.79 | 0.012 | I | 2 | LAB447 | 0.77 | 0.014 | K | 26 |
| LAB445 | 0.78 | 0.022 | G | 41 | LAB447 | 0.77 | 0.044 | A | 66 |
| LAB445 | 0.78 | 0.038 | A | 68 | LAB447 | 0.80 | 0.018 | G | 76 |
| LAB445 | 0.78 | 0.038 | A | 72 | LAB447 | −0.78 | 0.022 | F | 11 |
| LAB445 | 0.77 | 0.042 | A | 1 | LAB447 | 0.76 | 0.010 | Q | 39 |
| LAB445 | −0.76 | 0.046 | A | 33 | LAB447 | −0.76 | 0.011 | Q | 95 |
| LAB445 | 0.76 | 0.029 | D | 42 | LAB447 | −0.76 | 0.011 | Q | 77 |
| LAB445 | 0.72 | 0.042 | G | 7 | LAB447 | −0.75 | 0.032 | D | 65 |
| LAB445 | 0.72 | 0.027 | C | 21 | LAB447 | 0.74 | 0.037 | D | 61 |
| LAB445 | −0.72 | 0.030 | I | 10 | LAB447 | 0.74 | 0.037 | G | 72 |
| LAB445 | 0.71 | 0.050 | F | 61 | LAB447 | −0.71 | 0.021 | Q | 97 |
| LAB445 | −0.70 | 0.034 | J | 77 | LAB447 | 0.71 | 0.033 | K | 7 |
| LAB446 | 0.87 | 0.024 | L | 35 | LAB447 | −0.71 | 0.033 | I | 48 |
| LAB446 | −0.85 | 0.016 | A | 66 | LAB447 | −0.70 | 0.024 | Q | 73 |
| LAB446 | 0.81 | 0.049 | L | 66 | LAB448 | 0.89 | 0.018 | L | 28 |
| LAB446 | 0.79 | 0.019 | B | 28 | LAB448 | 0.85 | 0.032 | L | 62 |
| LAB446 | 0.78 | 0.022 | B | 78 | LAB448 | 0.81 | 0.050 | L | 8 |
| LAB446 | 0.78 | 0.022 | G | 74 | LAB448 | 0.78 | 0.024 | G | 55 |
| LAB446 | 0.77 | 0.026 | B | 70 | LAB448 | 0.71 | 0.049 | G | 78 |
| LAB446 | −0.76 | 0.018 | H | 35 | LAB448 | 0.91 | 0.011 | G | 99 |
| LAB446 | 0.76 | 0.030 | G | 78 | LAB448 | 0.85 | 0.032 | L | 76 |
| LAB446 | 0.75 | 0.031 | B | 74 | LAB448 | 0.84 | 0.018 | K | 99 |
| LAB446 | 0.74 | 0.023 | H | 55 | LAB448 | 0.83 | 0.010 | G | 76 |
| LAB448 | 0.83 | 0.011 | G | 54 | LAB449 | 0.76 | 0.045 | A | 43 |
| LAB448 | 0.80 | 0.018 | G | 72 | LAB449 | 0.76 | 0.018 | K | 28 |
| LAB448 | 0.77 | 0.042 | B | 99 | LAB449 | −0.75 | 0.021 | H | 62 |
| LAB448 | −0.73 | 0.017 | R | 86 | LAB449 | 0.73 | 0.038 | B | 66 |
| LAB449 | 0.86 | 0.013 | H | 100 | LAB449 | 0.73 | 0.041 | G | 55 |
| LAB449 | −0.86 | 0.013 | A | 16 | LAB449 | 0.91 | 0.002 | G | 38 |
| LAB449 | 0.83 | 0.041 | L | 55 | LAB449 | −0.91 | 0.002 | B | 7 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB449 | 0.81 | 0.027 | A | 62 | LAB449 | 0.90 | 0.006 | A | 72 |
| LAB449 | 0.77 | 0.042 | A | 55 | LAB449 | −0.89 | 0.007 | A | 13 |
| LAB449 | −0.77 | 0.045 | A | 35 | LAB449 | 0.88 | 0.004 | B | 64 |
| LAB449 | −0.87 | 0.001 | P | 88 | LAB450 | 0.79 | 0.011 | I | 40 |
| LAB449 | 0.87 | 0.023 | L | 41 | LAB450 | 0.78 | 0.023 | G | 54 |
| LAB449 | 0.85 | 0.034 | L | 72 | LAB450 | −0.77 | 0.027 | F | 51 |
| LAB449 | 0.83 | 0.005 | J | 11 | LAB450 | 0.76 | 0.029 | B | 72 |
| LAB449 | −0.83 | 0.006 | I | 48 | LAB450 | 0.75 | 0.032 | G | 76 |
| LAB449 | 0.83 | 0.042 | L | 1 | LAB450 | −0.75 | 0.033 | B | 7 |
| LAB449 | 0.83 | 0.011 | B | 38 | LAB450 | 0.74 | 0.015 | M | 84 |
| LAB449 | 0.83 | 0.022 | A | 76 | LAB450 | 0.72 | 0.045 | B | 64 |
| LAB449 | 0.82 | 0.044 | L | 76 | LAB450 | 0.71 | 0.047 | G | 56 |
| LAB449 | −0.82 | 0.006 | K | 7 | LAB450 | 0.71 | 0.047 | B | 54 |
| LAB449 | 0.82 | 0.023 | A | 68 | LAB451 | 0.95 | 0.003 | L | 78 |
| LAB449 | 0.82 | 0.024 | A | 54 | LAB451 | 0.95 | 0.004 | L | 74 |
| LAB449 | 0.82 | 0.046 | L | 56 | LAB451 | −0.90 | 0.013 | L | 52 |
| LAB449 | 0.81 | 0.014 | G | 54 | LAB451 | 0.90 | 0.015 | L | 62 |
| LAB449 | −0.81 | 0.014 | D | 22 | LAB451 | 0.83 | 0.022 | G | 31 |
| LAB449 | 0.81 | 0.009 | J | 15 | LAB451 | 0.82 | 0.013 | B | 78 |
| LAB449 | −0.79 | 0.006 | O | 89 | LAB451 | 0.79 | 0.020 | B | 70 |
| LAB449 | 0.79 | 0.011 | J | 30 | LAB451 | 0.77 | 0.025 | B | 74 |
| LAB449 | 0.78 | 0.008 | P | 79 | LAB451 | 0.76 | 0.027 | G | 28 |
| LAB449 | −0.78 | 0.041 | H | 46 | LAB451 | 0.75 | 0.031 | G | 78 |
| LAB449 | −0.77 | 0.010 | P | 90 | LAB451 | 0.72 | 0.042 | K | 31 |
| LAB449 | −0.76 | 0.010 | O | 91 | LAB451 | 0.71 | 0.032 | K | 28 |
| LAB449 | 0.76 | 0.010 | P | 71 | LAB451 | 0.95 | 0.003 | L | 41 |
| LAB449 | −0.76 | 0.011 | P | 92 | LAB451 | 0.87 | 0.001 | M | 67 |
| LAB449 | −0.76 | 0.030 | G | 7 | LAB451 | 0.86 | 0.027 | L | 68 |
| LAB449 | 0.74 | 0.014 | P | 98 | LAB451 | 0.85 | 0.002 | M | 101 |
| LAB449 | 0.74 | 0.036 | G | 76 | LAB451 | −0.80 | 0.005 | P | 86 |
| LAB449 | −0.73 | 0.041 | B | 5 | LAB451 | 0.79 | 0.007 | R | 53 |
| LAB449 | −0.72 | 0.018 | Q | 91 | LAB451 | 0.78 | 0.021 | B | 64 |
| LAB449 | −0.72 | 0.019 | Q | 89 | LAB451 | −0.78 | 0.007 | R | 86 |
| LAB449 | −0.72 | 0.045 | G | 41 | LAB451 | 0.75 | 0.012 | R | 67 |
| LAB449 | 0.71 | 0.021 | M | 101 | LAB451 | −0.74 | 0.014 | Q | 85 |
| LAB449 | 0.71 | 0.047 | G | 72 | LAB451 | 0.74 | 0.035 | G | 54 |
| LAB449 | 0.71 | 0.021 | R | 101 | LAB451 | 0.73 | 0.017 | Q | 65 |
| LAB449 | −0.70 | 0.024 | R | 88 | LAB451 | 0.73 | 0.041 | G | 76 |
| LAB450 | 0.88 | 0.004 | B | 70 | LAB451 | −0.72 | 0.019 | M | 86 |
| LAB450 | 0.85 | 0.007 | B | 74 | LAB451 | 0.72 | 0.019 | M | 53 |
| LAB450 | 0.85 | 0.008 | B | 78 | LAB451 | 0.71 | 0.020 | Q | 39 |
| LAB450 | −0.77 | 0.025 | G | 16 | LAB452 | 0.90 | 0.006 | G | 31 |
| LAB450 | 0.75 | 0.033 | B | 62 | LAB452 | 0.88 | 0.022 | L | 70 |
| LAB450 | 0.74 | 0.037 | G | 74 | LAB452 | 0.87 | 0.026 | L | 78 |
| LAB450 | 0.74 | 0.038 | G | 78 | LAB452 | 0.85 | 0.007 | B | 70 |
| LAB450 | 0.73 | 0.040 | G | 70 | LAB452 | −0.85 | 0.014 | G | 47 |
| LAB450 | 0.73 | 0.041 | G | 55 | LAB452 | 0.84 | 0.035 | L | 74 |
| LAB450 | 0.84 | 0.009 | G | 72 | LAB452 | 0.84 | 0.009 | B | 74 |
| LAB450 | 0.83 | 0.011 | B | 68 | LAB452 | 0.83 | 0.040 | L | 62 |
| LAB450 | 0.79 | 0.011 | K | 38 | LAB452 | 0.83 | 0.040 | L | 8 |
| LAB452 | 0.82 | 0.044 | L | 26 | LAB452 | 0.81 | 0.027 | H | 46 |
| LAB452 | 0.81 | 0.014 | B | 78 | LAB452 | −0.79 | 0.019 | D | 20 |
| LAB452 | 0.81 | 0.015 | B | 58 | LAB452 | 0.78 | 0.008 | N | 42 |
| LAB452 | −0.77 | 0.042 | K | 100 | LAB452 | 0.77 | 0.008 | R | 67 |
| LAB452 | 0.76 | 0.018 | K | 26 | LAB452 | −0.77 | 0.009 | Q | 85 |
| LAB452 | 0.72 | 0.029 | H | 78 | LAB452 | −0.76 | 0.010 | R | 86 |
| LAB452 | 0.91 | 0.002 | G | 76 | LAB452 | 0.76 | 0.018 | I | 14 |
| LAB452 | 0.90 | 0.013 | L | 41 | LAB452 | 0.74 | 0.035 | D | 57 |
| LAB452 | −0.84 | 0.002 | N | 87 | LAB452 | 0.74 | 0.035 | G | 72 |
| LAB452 | 0.83 | 0.043 | G | 99 | LAB452 | −0.73 | 0.026 | C | 2 |
| LAB452 | −0.72 | 0.044 | D | 65 | LAB453 | −0.77 | 0.042 | A | 68 |
| LAB452 | 0.72 | 0.044 | G | 29 | LAB453 | −0.77 | 0.026 | B | 27 |
| LAB452 | −0.72 | 0.030 | C | 23 | LAB453 | 0.76 | 0.018 | J | 24 |
| LAB452 | −0.71 | 0.046 | B | 33 | LAB453 | −0.76 | 0.018 | H | 33 |
| LAB452 | 0.71 | 0.021 | R | 53 | LAB453 | 0.75 | 0.020 | H | 76 |
| LAB452 | 0.71 | 0.050 | G | 54 | LAB453 | −0.75 | 0.033 | D | 18 |
| LAB452 | 0.70 | 0.024 | Q | 65 | LAB453 | 0.73 | 0.040 | D | 61 |
| LAB453 | 0.95 | 0.004 | L | 26 | LAB453 | −0.72 | 0.042 | D | 24 |
| LAB453 | 0.94 | 4.05E−04 | B | 55 | LAB453 | 0.72 | 0.028 | H | 68 |
| LAB453 | −0.94 | 0.002 | A | 74 | LAB453 | 0.72 | 0.030 | H | 54 |
| LAB453 | −0.93 | 0.003 | A | 55 | LAB453 | 0.71 | 0.031 | J | 65 |
| LAB453 | −0.92 | 0.004 | A | 70 | LAB453 | 0.71 | 0.031 | I | 2 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB453 | −0.90 | 0.006 | A | 78 | LAB453 | 0.71 | 0.021 | P | 84 |
| LAB453 | −0.89 | 0.008 | A | 43 | LAB453 | 0.71 | 0.031 | H | 72 |
| LAB453 | −0.88 | 0.004 | G | 35 | LAB453 | 0.70 | 0.026 | R | 67 |
| LAB453 | 0.82 | 0.012 | G | 55 | LAB454 | 0.86 | 0.013 | G | 31 |
| LAB453 | 0.81 | 0.026 | A | 16 | LAB454 | −0.84 | 0.035 | L | 12 |
| LAB453 | −0.80 | 0.033 | A | 4 | LAB454 | 0.83 | 0.011 | B | 70 |
| LAB453 | 0.79 | 0.036 | A | 52 | LAB454 | 0.80 | 0.017 | B | 74 |
| LAB453 | 0.78 | 0.013 | H | 55 | LAB454 | −0.79 | 0.011 | H | 58 |
| LAB453 | 0.77 | 0.026 | G | 74 | LAB454 | 0.78 | 0.022 | B | 78 |
| LAB453 | −0.76 | 0.045 | A | 62 | LAB454 | −0.78 | 0.039 | G | 47 |
| LAB453 | 0.76 | 0.029 | B | 74 | LAB454 | −0.77 | 0.025 | K | 47 |
| LAB453 | 0.75 | 0.032 | B | 78 | LAB454 | 0.76 | 0.030 | B | 58 |
| LAB453 | 0.74 | 0.034 | G | 78 | LAB454 | 0.76 | 0.019 | K | 43 |
| LAB453 | −0.73 | 0.025 | H | 35 | LAB454 | 0.74 | 0.024 | H | 52 |
| LAB453 | 0.71 | 0.034 | K | 55 | LAB454 | 0.88 | 0.004 | G | 76 |
| LAB453 | 0.93 | 0.001 | B | 54 | LAB454 | 0.83 | 0.010 | G | 72 |
| LAB453 | −0.91 | 0.002 | D | 20 | LAB454 | 0.83 | 0.006 | K | 68 |
| LAB453 | −0.90 | 0.006 | A | 54 | LAB454 | 0.81 | 0.008 | K | 72 |
| LAB453 | 0.88 | 0.004 | F | 3 | LAB454 | 0.80 | 0.009 | K | 76 |
| LAB453 | −0.86 | 0.001 | R | 86 | LAB454 | 0.75 | 0.031 | G | 54 |
| LAB453 | 0.85 | 0.008 | D | 65 | LAB454 | 0.75 | 0.033 | G | 68 |
| LAB453 | −0.84 | 0.017 | A | 41 | LAB454 | 0.74 | 0.015 | N | 95 |
| LAB453 | 0.84 | 0.009 | D | 51 | LAB454 | −0.73 | 0.026 | I | 21 |
| LAB453 | 0.82 | 0.006 | J | 20 | LAB454 | −0.73 | 0.027 | J | 3 |
| LAB453 | 0.82 | 0.012 | G | 72 | LAB454 | −0.71 | 0.022 | E | 2 |
| LAB453 | 0.82 | 0.012 | F | 42 | LAB454 | −0.70 | 0.034 | C | 23 |
| LAB453 | 0.82 | 0.013 | G | 54 | LAB455 | −0.96 | 0.003 | L | 28 |
| LAB453 | −0.81 | 0.026 | A | 1 | LAB455 | 0.95 | 0.001 | A | 62 |
| LAB453 | 0.81 | 0.016 | G | 76 | LAB455 | 0.94 | 0.002 | A | 43 |
| LAB453 | −0.80 | 0.018 | B | 33 | LAB455 | 0.92 | 0.003 | A | 78 |
| LAB453 | 0.78 | 0.008 | R | 84 | LAB455 | 0.91 | 0.011 | L | 8 |
| LAB453 | 0.78 | 0.022 | B | 72 | LAB455 | 0.90 | 0.006 | H | 100 |
| LAB453 | −0.78 | 0.038 | A | 72 | LAB455 | 0.89 | 0.007 | A | 70 |
| LAB453 | −0.78 | 0.008 | P | 86 | LAB455 | −0.89 | 0.019 | L | 62 |
| LAB453 | 0.77 | 0.025 | G | 56 | LAB455 | 0.88 | 0.004 | B | 6 |
| LAB455 | 0.88 | 0.009 | A | 74 | LAB455 | −0.83 | 0.022 | A | 16 |
| LAB455 | −0.87 | 0.005 | G | 8 | LAB455 | 0.83 | 0.022 | A | 8 |
| LAB455 | 0.87 | 0.024 | L | 35 | LAB455 | 0.82 | 0.007 | H | 58 |
| LAB455 | −0.87 | 0.011 | A | 66 | LAB455 | 0.82 | 0.025 | A | 58 |
| LAB455 | −0.86 | 0.026 | L | 4 | LAB455 | −0.81 | 0.049 | L | 78 |
| LAB455 | −0.86 | 0.014 | A | 52 | LAB455 | 0.80 | 0.009 | K | 28 |
| LAB455 | 0.84 | 0.008 | B | 66 | LAB455 | 0.80 | 0.018 | G | 62 |
| LAB455 | 0.84 | 0.009 | G | 4 | LAB455 | −0.79 | 0.011 | K | 16 |
| LAB455 | −0.83 | 0.006 | H | 26 | LAB455 | 0.78 | 0.038 | A | 55 |
| LAB455 | 0.83 | 0.043 | A | 31 | LAB455 | 0.77 | 0.025 | G | 43 |
| LAB455 | 0.75 | 0.030 | B | 8 | LAB455 | 0.77 | 0.009 | P | 96 |
| LAB455 | −0.75 | 0.020 | H | 35 | LAB455 | 0.77 | 0.044 | A | 54 |
| LAB455 | −0.75 | 0.020 | H | 62 | LAB455 | −0.77 | 0.016 | C | 23 |
| LAB455 | 0.74 | 0.037 | B | 16 | LAB455 | −0.76 | 0.010 | P | 88 |
| LAB455 | 0.96 | 5.71E−05 | C | 14 | LAB455 | −0.76 | 0.017 | H | 7 |
| LAB455 | 0.94 | 0.005 | L | 7 | LAB455 | 0.76 | 0.030 | B | 64 |
| LAB455 | 0.94 | 0.006 | L | 5 | LAB455 | 0.76 | 0.011 | M | 94 |
| LAB455 | −0.94 | 0.006 | L | 38 | LAB455 | 0.76 | 0.011 | O | 89 |
| LAB455 | −0.92 | 0.009 | G | 99 | LAB455 | 0.76 | 0.030 | B | 50 |
| LAB455 | −0.92 | 4.19E−04 | K | 45 | LAB455 | 0.75 | 0.031 | F | 77 |
| LAB455 | −0.91 | 0.011 | L | 76 | LAB455 | −0.75 | 0.019 | I | 67 |
| LAB455 | 0.90 | 0.005 | A | 76 | LAB455 | 0.75 | 0.021 | J | 61 |
| LAB455 | 0.89 | 0.007 | A | 72 | LAB455 | −0.75 | 0.021 | J | 34 |
| LAB455 | 0.89 | 0.001 | C | 2 | LAB455 | −0.74 | 0.034 | D | 51 |
| LAB455 | −0.88 | 0.004 | B | 41 | LAB455 | −0.74 | 0.022 | K | 7 |
| LAB455 | 0.87 | 0.010 | A | 5 | LAB455 | 0.74 | 0.015 | O | 69 |
| LAB455 | −0.86 | 0.002 | P | 92 | LAB455 | −0.73 | 0.017 | M | 96 |
| LAB455 | 0.85 | 0.030 | L | 27 | LAB455 | −0.73 | 0.026 | K | 50 |
| LAB455 | −0.85 | 0.002 | R | 92 | LAB455 | 0.73 | 0.027 | C | 19 |
| LAB455 | 0.85 | 0.015 | A | 68 | LAB455 | 0.72 | 0.018 | N | 89 |
| LAB455 | 0.85 | 0.032 | L | 50 | LAB455 | 0.72 | 0.028 | K | 64 |
| LAB455 | −0.85 | 0.002 | R | 90 | LAB455 | −0.71 | 0.031 | J | 57 |
| LAB455 | 0.85 | 0.002 | P | 84 | LAB455 | −0.71 | 0.047 | D | 42 |
| LAB455 | −0.85 | 0.002 | R | 88 | LAB455 | 0.71 | 0.048 | G | 72 |
| LAB455 | 0.84 | 0.004 | K | 38 | LAB455 | 0.71 | 0.049 | B | 5 |
| LAB455 | −0.83 | 0.003 | P | 82 | LAB455 | 0.71 | 0.023 | O | 91 |
| LAB455 | −0.83 | 0.003 | N | 85 | LAB455 | 0.70 | 0.035 | I | 59 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB455 | −0.83 | 0.040 | L | 72 | LAB455 | −0.70 | 0.035 | J | 20 |
| LAB455 | −0.83 | 0.011 | B | 7 | LAB455 | 0.70 | 0.024 | N | 91 |
| LAB455 | 0.83 | 0.006 | C | 21 | LAB456 | 0.95 | 0.001 | A | 26 |
| LAB455 | −0.82 | 0.024 | H | 46 | LAB456 | 0.90 | 0.002 | G | 55 |
| LAB455 | −0.81 | 0.008 | J | 65 | LAB456 | −0.85 | 0.015 | G | 47 |
| LAB455 | −0.81 | 0.004 | P | 90 | LAB456 | 0.80 | 0.032 | G | 31 |
| LAB455 | −0.81 | 0.005 | M | 92 | LAB456 | 0.79 | 0.019 | G | 78 |
| LAB455 | −0.81 | 0.016 | F | 51 | LAB456 | −0.78 | 0.037 | A | 43 |
| LAB455 | 0.80 | 0.018 | B | 13 | LAB456 | −0.76 | 0.049 | A | 4 |
| LAB455 | 0.80 | 0.010 | C | 59 | LAB456 | 0.73 | 0.039 | G | 74 |
| LAB455 | −0.79 | 0.006 | M | 90 | LAB456 | −0.73 | 0.027 | H | 28 |
| LAB455 | −0.79 | 0.035 | A | 13 | LAB456 | 0.92 | 0.001 | G | 54 |
| LAB455 | 0.79 | 0.035 | A | 1 | LAB456 | −0.92 | 1.73E−04 | N | 51 |
| LAB455 | 0.79 | 0.036 | A | 41 | LAB456 | 0.87 | 0.001 | N | 85 |
| LAB455 | −0.78 | 0.037 | A | 33 | LAB456 | 0.86 | 0.006 | G | 76 |
| LAB455 | 0.78 | 0.022 | G | 68 | LAB456 | −0.84 | 0.002 | N | 93 |
| LAB455 | −0.78 | 0.022 | D | 65 | LAB456 | −0.82 | 0.022 | A | 1 |
| LAB455 | −0.78 | 0.007 | P | 86 | LAB456 | −0.82 | 0.003 | P | 86 |
| LAB455 | 0.78 | 0.038 | H | 99 | LAB456 | 0.82 | 0.013 | G | 72 |
| LAB455 | −0.77 | 0.025 | D | 49 | LAB456 | 0.82 | 0.007 | K | 9 |
| LAB456 | −0.80 | 0.005 | Q | 85 | LAB456 | −0.72 | 0.029 | K | 45 |
| LAB456 | −0.78 | 0.021 | B | 60 | LAB456 | −0.71 | 0.022 | E | 19 |
| LAB456 | 0.78 | 0.024 | D | 65 | LAB456 | −0.70 | 0.024 | N | 65 |
| LAB456 | 0.76 | 0.011 | R | 53 | LAB456 | 0.70 | 0.024 | P | 84 |
| LAB456 | 0.75 | 0.020 | J | 77 | LAB456 | −0.70 | 0.037 | N | 102 |
| LAB456 | 0.75 | 0.021 | K | 38 | LAB457 | 0.91 | 0.001 | K | 28 |
| LAB456 | 0.75 | 0.034 | G | 56 | LAB457 | 0.90 | 0.006 | A | 43 |
| LAB456 | −0.73 | 0.039 | D | 61 | LAB457 | −0.89 | 0.001 | H | 12 |
| LAB456 | 0.73 | 0.017 | R | 67 | LAB457 | 0.85 | 0.007 | B | 28 |
| LAB456 | −0.72 | 0.018 | R | 86 | LAB457 | 0.81 | 0.026 | A | 62 |
| LAB457 | 0.80 | 0.030 | A | 78 | LAB459 | 0.78 | 0.024 | B | 64 |
| LAB457 | 0.80 | 0.018 | G | 43 | LAB459 | 0.77 | 0.015 | C | 17 |
| LAB457 | −0.72 | 0.043 | G | 12 | LAB459 | 0.77 | 0.026 | D | 30 |
| LAB457 | 0.89 | 0.003 | B | 64 | LAB459 | 0.76 | 0.010 | Q | 77 |
| LAB457 | −0.88 | 0.002 | I | 79 | LAB459 | 0.76 | 0.018 | K | 76 |
| LAB457 | 0.86 | 0.002 | O | 39 | LAB459 | 0.75 | 0.020 | K | 64 |
| LAB457 | 0.85 | 0.004 | J | 30 | LAB459 | 0.74 | 0.024 | K | 72 |
| LAB457 | 0.85 | 0.004 | J | 11 | LAB459 | 0.73 | 0.017 | Q | 95 |
| LAB457 | 0.84 | 0.037 | L | 50 | LAB459 | −0.72 | 0.019 | Q | 39 |
| LAB457 | −0.82 | 0.007 | H | 13 | LAB459 | −0.72 | 0.030 | K | 7 |
| LAB457 | 0.80 | 0.017 | B | 50 | LAB459 | 0.72 | 0.046 | B | 76 |
| LAB457 | −0.78 | 0.012 | H | 9 | LAB459 | 0.71 | 0.030 | K | 54 |
| LAB457 | 0.78 | 0.008 | E | 2 | LAB459 | −0.71 | 0.021 | P | 86 |
| LAB457 | 0.78 | 0.038 | A | 72 | LAB459 | 0.71 | 0.032 | J | 15 |
| LAB457 | 0.78 | 0.008 | P | 53 | LAB459 | 0.71 | 0.049 | D | 3 |
| LAB457 | 0.75 | 0.013 | P | 67 | LAB460 | 0.94 | 0.005 | L | 43 |
| LAB457 | −0.75 | 0.021 | I | 75 | LAB460 | 0.89 | 0.016 | L | 4 |
| LAB457 | −0.75 | 0.034 | D | 61 | LAB460 | −0.84 | 0.005 | H | 35 |
| LAB457 | −0.74 | 0.037 | B | 60 | LAB460 | 0.82 | 0.007 | K | 55 |
| LAB457 | 0.71 | 0.031 | K | 38 | LAB460 | 0.81 | 0.015 | B | 78 |
| LAB457 | −0.71 | 0.048 | B | 7 | LAB460 | 0.80 | 0.017 | B | 70 |
| LAB457 | −0.71 | 0.049 | G | 9 | LAB460 | 0.77 | 0.025 | B | 74 |
| LAB457 | 0.71 | 0.022 | O | 83 | LAB460 | 0.77 | 0.016 | K | 78 |
| LAB457 | −0.71 | 0.033 | I | 14 | LAB460 | 0.76 | 0.028 | G | 8 |
| LAB459 | 0.90 | 0.002 | B | 28 | LAB460 | 0.74 | 0.035 | K | 31 |
| LAB459 | −0.84 | 0.036 | L | 66 | LAB460 | −0.74 | 0.037 | K | 47 |
| LAB459 | 0.82 | 0.006 | K | 28 | LAB460 | 0.70 | 0.036 | K | 74 |
| LAB459 | 0.82 | 0.013 | G | 28 | LAB460 | 0.70 | 0.038 | K | 70 |
| LAB459 | −0.82 | 0.025 | A | 66 | LAB460 | 0.96 | 0.002 | L | 1 |
| LAB459 | 0.78 | 0.024 | K | 31 | LAB460 | 0.89 | 0.001 | K | 54 |
| LAB459 | 0.77 | 0.027 | G | 78 | LAB460 | 0.86 | 0.014 | A | 60 |
| LAB459 | 0.75 | 0.019 | K | 70 | LAB460 | 0.83 | 0.006 | K | 76 |
| LAB459 | 0.74 | 0.035 | G | 74 | LAB460 | 0.83 | 0.042 | L | 38 |
| LAB459 | 0.74 | 0.023 | K | 78 | LAB460 | −0.82 | 0.025 | A | 13 |
| LAB459 | 0.72 | 0.043 | G | 70 | LAB460 | −0.81 | 0.027 | A | 50 |
| LAB459 | 0.72 | 0.029 | K | 43 | LAB460 | 0.81 | 0.008 | I | 44 |
| LAB459 | 0.90 | 0.001 | J | 11 | LAB460 | 0.79 | 0.034 | A | 72 |
| LAB459 | 0.89 | 0.001 | J | 30 | LAB460 | 0.79 | 0.012 | K | 72 |
| LAB459 | −0.88 | 0.004 | B | 60 | LAB460 | −0.79 | 0.012 | J | 15 |
| LAB459 | 0.87 | 0.005 | F | 65 | LAB460 | −0.78 | 0.013 | K | 27 |
| LAB459 | 0.85 | 0.034 | G | 99 | LAB460 | 0.78 | 0.037 | A | 54 |
| LAB459 | 0.84 | 0.009 | F | 22 | LAB460 | 0.76 | 0.017 | C | 21 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB459 | 0.82 | 0.014 | B | 50 | LAB460 | 0.75 | 0.050 | A | 76 |
| LAB459 | 0.81 | 0.008 | I | 14 | LAB460 | 0.73 | 0.018 | E | 32 |
| LAB459 | −0.80 | 0.005 | O | 85 | LAB460 | −0.71 | 0.050 | F | 15 |
| LAB459 | 0.80 | 0.010 | I | 79 | LAB461 | 0.91 | 0.002 | B | 58 |
| LAB459 | 0.79 | 0.010 | K | 68 | LAB461 | 0.82 | 0.045 | L | 55 |
| LAB461 | 0.81 | 0.014 | G | 78 | LAB461 | 0.86 | 0.014 | H | 46 |
| LAB461 | 0.78 | 0.022 | G | 74 | LAB461 | 0.81 | 0.014 | G | 54 |
| LAB461 | −0.77 | 0.043 | H | 100 | LAB461 | −0.80 | 0.029 | K | 99 |
| LAB461 | 0.76 | 0.028 | G | 70 | LAB461 | 0.80 | 0.017 | G | 72 |
| LAB461 | 0.75 | 0.031 | G | 55 | LAB461 | 0.78 | 0.024 | G | 38 |
| LAB461 | 0.72 | 0.046 | G | 28 | LAB461 | −0.76 | 0.011 | E | 23 |
| LAB461 | 0.72 | 0.046 | G | 62 | LAB461 | −0.76 | 0.012 | E | 10 |
| LAB461 | 0.90 | 0.014 | L | 68 | LAB461 | 0.75 | 0.012 | N | 85 |
| LAB461 | −0.88 | 0.001 | E | 2 | LAB461 | 0.75 | 0.033 | G | 68 |
| LAB461 | 0.86 | 0.028 | L | 56 | LAB461 | 0.74 | 0.034 | G | 76 |
| LAB461 | −0.72 | 0.029 | C | 23 | LAB463 | 0.84 | 0.004 | K | 64 |
| LAB462 | 0.94 | 0.005 | L | 66 | LAB463 | −0.84 | 0.002 | P | 92 |
| LAB462 | 0.88 | 0.002 | H | 43 | LAB463 | 0.83 | 0.040 | L | 41 |
| LAB462 | 0.82 | 0.023 | A | 16 | LAB463 | 0.82 | 0.025 | A | 68 |
| LAB462 | −0.81 | 0.007 | H | 12 | LAB463 | 0.80 | 0.030 | A | 76 |
| LAB462 | 0.81 | 0.015 | G | 78 | LAB463 | 0.80 | 0.017 | G | 38 |
| LAB462 | 0.81 | 0.029 | G | 31 | LAB463 | 0.80 | 0.010 | C | 71 |
| LAB462 | 0.75 | 0.031 | G | 74 | LAB463 | 0.78 | 0.013 | J | 30 |
| LAB462 | 0.75 | 0.032 | G | 55 | LAB463 | 0.78 | 0.039 | A | 54 |
| LAB462 | −0.73 | 0.026 | H | 26 | LAB463 | 0.77 | 0.016 | C | 75 |
| LAB462 | 0.89 | 0.018 | G | 99 | LAB463 | −0.76 | 0.019 | K | 7 |
| LAB462 | 0.86 | 0.006 | G | 76 | LAB463 | 0.75 | 0.032 | F | 65 |
| LAB462 | −0.84 | 0.018 | A | 72 | LAB463 | −0.74 | 0.036 | B | 5 |
| LAB462 | 0.84 | 0.018 | A | 13 | LAB463 | 0.73 | 0.016 | E | 67 |
| LAB462 | 0.83 | 0.011 | G | 72 | LAB463 | −0.73 | 0.040 | B | 41 |
| LAB462 | −0.81 | 0.008 | I | 75 | LAB463 | −0.72 | 0.029 | K | 5 |
| LAB462 | −0.81 | 0.008 | H | 9 | LAB463 | −0.72 | 0.030 | I | 23 |
| LAB462 | 0.80 | 0.018 | G | 54 | LAB463 | 0.71 | 0.022 | R | 84 |
| LAB462 | −0.79 | 0.034 | A | 54 | LAB463 | −0.71 | 0.050 | G | 27 |
| LAB462 | −0.79 | 0.034 | A | 76 | LAB464 | −0.85 | 0.016 | A | 66 |
| LAB462 | −0.79 | 0.012 | I | 79 | LAB464 | −0.77 | 0.015 | H | 35 |
| LAB462 | 0.78 | 0.007 | R | 44 | LAB464 | 0.75 | 0.020 | K | 28 |
| LAB462 | −0.77 | 0.014 | J | 34 | LAB464 | −0.93 | 0.001 | D | 61 |
| LAB462 | 0.77 | 0.027 | G | 56 | LAB464 | −0.85 | 0.007 | B | 7 |
| LAB462 | 0.74 | 0.022 | H | 68 | LAB464 | −0.84 | 0.008 | G | 7 |
| LAB462 | −0.71 | 0.031 | I | 71 | LAB464 | 0.84 | 0.005 | K | 64 |
| LAB463 | 0.96 | 0.003 | L | 43 | LAB464 | 0.83 | 0.040 | L | 29 |
| LAB463 | 0.92 | 0.010 | L | 78 | LAB464 | 0.80 | 0.017 | G | 64 |
| LAB463 | 0.89 | 0.019 | L | 74 | LAB464 | −0.78 | 0.013 | K | 7 |
| LAB463 | 0.88 | 0.009 | A | 43 | LAB464 | 0.78 | 0.023 | G | 38 |
| LAB463 | 0.87 | 0.010 | A | 62 | LAB464 | −0.76 | 0.017 | J | 57 |
| LAB463 | 0.87 | 0.023 | L | 70 | LAB464 | −0.76 | 0.028 | G | 45 |
| LAB463 | 0.85 | 0.032 | L | 62 | LAB464 | −0.73 | 0.041 | G | 5 |
| LAB463 | −0.83 | 0.021 | A | 16 | LAB465 | 0.93 | 0.007 | L | 62 |
| LAB463 | 0.78 | 0.041 | A | 70 | LAB465 | 0.93 | 0.008 | L | 74 |
| LAB463 | 0.76 | 0.048 | A | 78 | LAB465 | 0.90 | 0.016 | L | 70 |
| LAB463 | 0.75 | 0.033 | B | 66 | LAB465 | 0.83 | 0.040 | L | 43 |
| LAB463 | 0.70 | 0.036 | K | 28 | LAB465 | −0.82 | 0.047 | L | 52 |
| LAB463 | 0.95 | 3.43E−04 | F | 11 | LAB465 | 0.79 | 0.019 | G | 74 |
| LAB463 | 0.88 | 0.008 | A | 72 | LAB465 | 0.77 | 0.027 | B | 78 |
| LAB463 | 0.87 | 0.002 | J | 11 | LAB465 | 0.76 | 0.028 | B | 70 |
| LAB463 | 0.87 | 0.005 | B | 64 | LAB465 | 0.76 | 0.028 | B | 74 |
| LAB463 | −0.85 | 0.002 | P | 90 | LAB465 | 0.76 | 0.029 | G | 78 |
| LAB463 | −0.85 | 0.015 | A | 13 | LAB465 | 0.75 | 0.033 | G | 70 |
| LAB463 | −0.85 | 0.002 | P | 88 | LAB465 | 0.74 | 0.023 | K | 28 |
| LAB463 | −0.85 | 0.008 | B | 7 | LAB465 | 0.73 | 0.039 | B | 28 |
| LAB463 | −0.85 | 0.008 | D | 3 | LAB465 | 0.72 | 0.030 | K | 74 |
| LAB465 | 0.72 | 0.030 | K | 78 | LAB465 | −0.78 | 0.024 | D | 18 |
| LAB465 | 0.95 | 0.004 | L | 41 | LAB465 | 0.78 | 0.014 | C | 17 |
| LAB465 | 0.93 | 1.07E−04 | M | 84 | LAB465 | 0.77 | 0.024 | B | 68 |
| LAB465 | 0.90 | 0.001 | I | 14 | LAB465 | 0.77 | 0.015 | K | 64 |
| LAB465 | 0.86 | 0.003 | C | 19 | LAB465 | 0.77 | 0.026 | B | 72 |
| LAB465 | 0.85 | 0.007 | F | 65 | LAB465 | −0.76 | 0.011 | P | 86 |
| LAB465 | 0.84 | 0.002 | P | 67 | LAB465 | 0.76 | 0.011 | E | 67 |
| LAB465 | 0.82 | 0.047 | L | 72 | LAB465 | 0.75 | 0.012 | E | 40 |
| LAB465 | −0.80 | 0.017 | D | 61 | LAB465 | 0.74 | 0.014 | M | 94 |
| LAB465 | −0.74 | 0.014 | E | 63 | LAB465 | 0.74 | 0.015 | P | 53 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB465 | 0.72 | 0.028 | C | 32 | LAB467 | 0.71 | 0.050 | B | 55 |
| LAB465 | 0.71 | 0.021 | N | 93 | LAB467 | 0.86 | 0.001 | N | 85 |
| LAB465 | 0.71 | 0.050 | B | 54 | LAB467 | −0.82 | 0.007 | C | 63 |
| LAB465 | 0.70 | 0.037 | C | 40 | LAB467 | −0.80 | 0.006 | Q | 85 |
| LAB466 | 0.95 | 0.004 | L | 78 | LAB467 | 0.79 | 0.021 | G | 54 |
| LAB466 | 0.95 | 0.004 | L | 74 | LAB467 | 0.77 | 0.016 | C | 21 |
| LAB466 | 0.94 | 0.006 | L | 62 | LAB467 | 0.76 | 0.011 | Q | 65 |
| LAB466 | −0.94 | 0.006 | L | 52 | LAB467 | 0.75 | 0.033 | G | 38 |
| LAB466 | 0.93 | 0.006 | L | 70 | LAB467 | 0.75 | 0.033 | G | 76 |
| LAB466 | 0.93 | 0.001 | B | 74 | LAB467 | 0.74 | 0.023 | C | 48 |
| LAB466 | −0.91 | 0.002 | K | 47 | LAB467 | 0.74 | 0.037 | G | 72 |
| LAB466 | −0.91 | 0.013 | G | 100 | LAB467 | 0.73 | 0.040 | B | 54 |
| LAB466 | 0.90 | 0.013 | L | 43 | LAB467 | 0.72 | 0.027 | J | 77 |
| LAB466 | 0.90 | 0.002 | B | 78 | LAB467 | 0.72 | 0.028 | C | 67 |
| LAB466 | 0.89 | 0.003 | K | 31 | LAB467 | 0.72 | 0.030 | J | 69 |
| LAB466 | −0.85 | 0.016 | H | 100 | LAB467 | 0.71 | 0.047 | B | 68 |
| LAB466 | 0.84 | 0.035 | A | 31 | LAB467 | −0.71 | 0.032 | J | 42 |
| LAB466 | 0.80 | 0.018 | B | 62 | LAB467 | 0.71 | 0.034 | J | 34 |
| LAB466 | 0.79 | 0.011 | K | 78 | LAB467 | 0.74 | 0.022 | J | 73 |
| LAB466 | 0.79 | 0.012 | K | 70 | LAB468 | 0.83 | 0.022 | A | 62 |
| LAB466 | 0.76 | 0.017 | K | 62 | LAB468 | 0.81 | 0.015 | B | 28 |
| LAB466 | 0.76 | 0.018 | K | 55 | LAB468 | −0.80 | 0.030 | G | 47 |
| LAB466 | 0.74 | 0.024 | K | 74 | LAB468 | −0.80 | 0.030 | A | 52 |
| LAB466 | 0.94 | 1.61E−04 | K | 76 | LAB468 | 0.76 | 0.046 | A | 43 |
| LAB466 | 0.92 | 0.003 | A | 5 | LAB468 | 0.75 | 0.033 | K | 31 |
| LAB466 | 0.90 | 0.005 | A | 76 | LAB468 | 0.74 | 0.035 | G | 70 |
| LAB466 | 0.89 | 0.001 | K | 72 | LAB468 | 0.74 | 0.038 | G | 43 |
| LAB466 | 0.88 | 0.022 | L | 41 | LAB468 | −0.72 | 0.044 | G | 12 |
| LAB466 | 0.87 | 0.003 | K | 68 | LAB468 | 0.72 | 0.044 | G | 78 |
| LAB466 | 0.83 | 0.042 | L | 68 | LAB468 | 0.94 | 0.006 | G | 99 |
| LAB466 | 0.82 | 0.048 | L | 72 | LAB468 | 0.85 | 0.007 | G | 72 |
| LAB466 | 0.81 | 0.008 | K | 54 | LAB468 | 0.85 | 0.004 | C | 40 |
| LAB466 | 0.81 | 0.015 | B | 68 | LAB468 | 0.85 | 0.008 | F | 65 |
| LAB466 | −0.80 | 0.033 | A | 13 | LAB468 | 0.84 | 0.010 | G | 76 |
| LAB466 | 0.79 | 0.020 | F | 34 | LAB468 | 0.83 | 0.011 | B | 50 |
| LAB466 | 0.79 | 0.036 | A | 72 | LAB468 | 0.82 | 0.012 | F | 30 |
| LAB466 | 0.77 | 0.042 | H | 46 | LAB468 | −0.79 | 0.035 | A | 33 |
| LAB466 | 0.76 | 0.029 | D | 42 | LAB468 | 0.79 | 0.020 | B | 64 |
| LAB466 | 0.74 | 0.023 | J | 24 | LAB468 | 0.79 | 0.012 | J | 65 |
| LAB466 | −0.72 | 0.043 | F | 22 | LAB468 | 0.77 | 0.014 | K | 38 |
| LAB466 | −0.71 | 0.048 | D | 18 | LAB468 | 0.76 | 0.030 | G | 54 |
| LAB466 | −0.70 | 0.037 | H | 45 | LAB468 | −0.74 | 0.035 | D | 65 |
| LAB467 | 0.93 | 0.001 | B | 70 | LAB468 | −0.74 | 0.036 | F | 61 |
| LAB467 | 0.91 | 0.002 | B | 74 | LAB468 | 0.73 | 0.040 | G | 68 |
| LAB467 | 0.89 | 0.003 | B | 78 | LAB468 | 0.72 | 0.043 | F | 20 |
| LAB467 | 0.88 | 0.008 | G | 31 | LAB468 | −0.72 | 0.045 | B | 60 |
| LAB467 | 0.86 | 0.006 | G | 78 | LAB468 | 0.71 | 0.032 | I | 67 |
| LAB467 | 0.84 | 0.004 | K | 28 | LAB468 | 0.70 | 0.024 | M | 96 |
| LAB467 | −0.81 | 0.049 | L | 12 | LAB468 | 0.70 | 0.036 | C | 67 |
| LAB467 | 0.80 | 0.016 | G | 74 | LAB469 | −0.94 | 0.001 | G | 47 |
| LAB467 | 0.79 | 0.020 | G | 70 | LAB469 | 0.93 | 0.006 | L | 74 |
| LAB467 | 0.75 | 0.032 | G | 28 | LAB469 | 0.92 | 0.009 | L | 70 |
| LAB467 | 0.73 | 0.040 | G | 55 | LAB469 | 0.92 | 0.001 | B | 6 |
| LAB467 | 0.73 | 0.027 | H | 12 | LAB469 | −0.90 | 0.013 | L | 52 |
| LAB469 | 0.89 | 0.018 | L | 62 | LAB469 | 0.83 | 0.040 | L | 58 |
| LAB469 | 0.87 | 0.024 | L | 78 | LAB469 | 0.81 | 0.027 | A | 70 |
| LAB469 | 0.85 | 0.030 | L | 43 | LAB469 | 0.80 | 0.030 | A | 74 |
| LAB469 | 0.84 | 0.018 | A | 4 | LAB469 | 0.79 | 0.021 | G | 55 |
| LAB469 | −0.76 | 0.047 | A | 52 | LAB470 | 0.86 | 0.006 | G | 54 |
| LAB469 | −0.75 | 0.019 | H | 16 | LAB470 | 0.83 | 0.043 | L | 41 |
| LAB469 | −0.74 | 0.022 | H | 35 | LAB470 | 0.83 | 0.012 | G | 72 |
| LAB469 | 0.74 | 0.022 | K | 28 | LAB470 | −0.81 | 0.015 | D | 65 |
| LAB469 | 0.72 | 0.043 | K | 31 | LAB470 | 0.79 | 0.020 | B | 64 |
| LAB469 | −0.72 | 0.043 | B | 43 | LAB470 | 0.77 | 0.025 | G | 56 |
| LAB469 | 0.70 | 0.037 | K | 78 | LAB470 | −0.76 | 0.010 | R | 44 |
| LAB469 | 0.95 | 0.003 | L | 41 | LAB470 | −0.75 | 0.020 | I | 44 |
| LAB469 | 0.89 | 0.003 | B | 5 | LAB470 | 0.75 | 0.033 | G | 76 |
| LAB469 | −0.87 | 0.025 | L | 33 | LAB470 | 0.73 | 0.024 | H | 41 |
| LAB469 | 0.86 | 0.003 | J | 30 | LAB470 | 0.71 | 0.032 | I | 75 |
| LAB469 | 0.85 | 0.004 | I | 36 | LAB470 | −0.71 | 0.050 | B | 5 |
| LAB469 | 0.85 | 0.008 | G | 54 | LAB471 | −0.77 | 0.042 | G | 47 |
| LAB469 | 0.84 | 0.004 | J | 15 | LAB471 | −0.72 | 0.028 | H | 66 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB469 | −0.82 | 0.012 | B | 64 | LAB471 | 0.94 | 0.006 | G | 99 |
| LAB469 | 0.82 | 0.007 | I | 63 | LAB471 | 0.83 | 0.006 | J | 34 |
| LAB469 | 0.80 | 0.031 | A | 1 | LAB471 | 0.83 | 0.003 | P | 94 |
| LAB469 | −0.80 | 0.006 | E | 75 | LAB471 | 0.82 | 0.013 | G | 76 |
| LAB469 | 0.79 | 0.011 | H | 56 | LAB471 | 0.80 | 0.009 | I | 40 |
| LAB469 | −0.79 | 0.034 | A | 33 | LAB471 | 0.80 | 0.005 | P | 84 |
| LAB469 | 0.79 | 0.012 | J | 11 | LAB471 | 0.78 | 0.022 | G | 72 |
| LAB469 | 0.78 | 0.021 | B | 7 | LAB471 | 0.77 | 0.016 | I | 32 |
| LAB469 | 0.77 | 0.043 | A | 64 | LAB471 | 0.76 | 0.030 | D | 69 |
| LAB469 | 0.76 | 0.046 | A | 38 | LAB471 | 0.76 | 0.011 | Q | 93 |
| LAB469 | −0.76 | 0.017 | K | 7 | LAB471 | 0.75 | 0.012 | O | 93 |
| LAB469 | −0.75 | 0.012 | M | 53 | LAB471 | 0.75 | 0.033 | G | 54 |
| LAB469 | 0.75 | 0.019 | K | 64 | LAB471 | −0.72 | 0.027 | H | 68 |
| LAB469 | 0.75 | 0.032 | F | 18 | LAB471 | 0.72 | 0.029 | H | 7 |
| LAB469 | −0.75 | 0.013 | E | 71 | LAB471 | 0.71 | 0.050 | D | 24 |
| LAB469 | 0.75 | 0.034 | G | 72 | LAB471 | 0.79 | 0.019 | D | 73 |
| LAB469 | −0.74 | 0.036 | F | 57 | LAB472 | 0.91 | 0.004 | G | 31 |
| LAB469 | 0.74 | 0.036 | G | 76 | LAB472 | 0.88 | 0.010 | A | 35 |
| LAB469 | −0.74 | 0.015 | E | 79 | LAB472 | 0.83 | 0.039 | L | 26 |
| LAB469 | −0.73 | 0.016 | O | 69 | LAB472 | −0.82 | 0.024 | G | 47 |
| LAB469 | 0.73 | 0.016 | O | 80 | LAB472 | −0.81 | 0.026 | A | 28 |
| LAB469 | −0.72 | 0.019 | O | 87 | LAB472 | −0.81 | 0.015 | G | 35 |
| LAB469 | −0.72 | 0.045 | D | 18 | LAB472 | −0.76 | 0.018 | H | 35 |
| LAB469 | −0.72 | 0.046 | D | 61 | LAB472 | −0.94 | 0.002 | H | 99 |
| LAB469 | −0.71 | 0.033 | C | 21 | LAB472 | 0.87 | 0.001 | P | 84 |
| LAB470 | −0.92 | 0.010 | L | 12 | LAB472 | 0.85 | 0.004 | K | 50 |
| LAB470 | −0.86 | 0.026 | L | 52 | LAB472 | 0.84 | 0.009 | G | 76 |
| LAB470 | 0.86 | 0.006 | G | 55 | LAB472 | −0.81 | 0.026 | B | 99 |
| LAB470 | 0.84 | 0.037 | L | 58 | LAB472 | −0.81 | 0.015 | B | 33 |
| LAB470 | −0.84 | 0.019 | A | 52 | LAB472 | −0.80 | 0.018 | F | 57 |
| LAB470 | 0.83 | 0.039 | L | 62 | LAB472 | 0.80 | 0.006 | E | 79 |
| LAB470 | 0.82 | 0.047 | L | 70 | LAB472 | −0.80 | 0.010 | K | 60 |
| LAB470 | 0.79 | 0.011 | K | 74 | LAB472 | 0.79 | 0.019 | F | 3 |
| LAB470 | 0.78 | 0.013 | K | 78 | LAB472 | 0.79 | 0.007 | P | 94 |
| LAB470 | −0.77 | 0.026 | G | 35 | LAB472 | −0.78 | 0.037 | A | 76 |
| LAB470 | 0.74 | 0.035 | B | 70 | LAB472 | −0.78 | 0.013 | K | 1 |
| LAB470 | 0.74 | 0.022 | K | 70 | LAB472 | −0.77 | 0.041 | A | 72 |
| LAB470 | 0.95 | 0.004 | L | 68 | LAB472 | 0.73 | 0.026 | I | 59 |
| LAB470 | −0.94 | 0.001 | B | 7 | LAB472 | −0.73 | 0.018 | R | 44 |
| LAB470 | 0.93 | 0.008 | L | 56 | LAB472 | 0.72 | 0.044 | G | 9 |
| LAB470 | −0.90 | 0.014 | L | 13 | LAB472 | 0.71 | 0.031 | I | 63 |
| LAB472 | 0.71 | 0.021 | N | 69 | LAB472 | −0.70 | 0.034 | I | 67 |
| LAB472 | −0.70 | 0.023 | R | 86 | LAB474 | 0.80 | 0.006 | Q | 51 |
| LAB472 | 0.70 | 0.023 | R | 67 | LAB474 | 0.76 | 0.018 | C | 67 |
| LAB472 | 0.70 | 0.023 | N | 73 | LAB474 | −0.75 | 0.021 | C | 63 |
| LAB472 | 0.70 | 0.024 | R | 53 | LAB474 | 0.74 | 0.036 | B | 64 |
| LAB472 | 0.70 | 0.025 | M | 101 | LAB474 | 0.74 | 0.015 | R | 67 |
| LAB473 | 0.95 | 0.003 | L | 74 | LAB474 | −0.73 | 0.016 | E | 2 |
| LAB473 | 0.95 | 0.004 | L | 78 | LAB474 | 0.71 | 0.022 | O | 65 |
| LAB473 | −0.90 | 0.016 | L | 52 | LAB474 | 0.70 | 0.024 | M | 71 |
| LAB473 | 0.87 | 0.010 | G | 31 | LAB475 | 0.84 | 0.037 | L | 8 |
| LAB473 | 0.87 | 0.024 | L | 62 | LAB475 | 0.83 | 0.039 | L | 78 |
| LAB473 | 0.82 | 0.047 | L | 43 | LAB475 | 0.82 | 0.025 | G | 31 |
| LAB473 | 0.79 | 0.021 | G | 28 | LAB475 | −0.77 | 0.043 | A | 8 |
| LAB473 | 0.75 | 0.031 | G | 78 | LAB475 | 0.91 | 0.013 | L | 41 |
| LAB473 | 0.73 | 0.025 | H | 28 | LAB475 | −0.89 | 0.007 | A | 5 |
| LAB473 | 0.72 | 0.044 | B | 55 | LAB475 | −0.85 | 0.008 | B | 7 |
| LAB473 | 0.72 | 0.045 | G | 70 | LAB475 | 0.85 | 0.008 | G | 76 |
| LAB473 | 0.95 | 0.004 | L | 41 | LAB475 | −0.83 | 0.011 | B | 27 |
| LAB473 | 0.84 | 0.035 | L | 68 | LAB475 | −0.83 | 0.021 | A | 76 |
| LAB473 | 0.84 | 0.009 | G | 38 | LAB475 | −0.81 | 0.008 | C | 17 |
| LAB473 | −0.82 | 0.004 | O | 85 | LAB475 | 0.81 | 0.008 | H | 1 |
| LAB473 | −0.79 | 0.007 | Q | 85 | LAB475 | 0.76 | 0.027 | G | 72 |
| LAB473 | 0.78 | 0.022 | B | 29 | LAB475 | 0.76 | 0.011 | N | 65 |
| LAB473 | −0.78 | 0.008 | P | 88 | LAB475 | −0.75 | 0.012 | P | 44 |
| LAB473 | 0.77 | 0.016 | H | 50 | LAB475 | −0.75 | 0.013 | R | 44 |
| LAB473 | 0.76 | 0.011 | N | 73 | LAB475 | −0.73 | 0.025 | I | 79 |
| LAB473 | 0.76 | 0.030 | B | 54 | LAB475 | −0.70 | 0.036 | I | 75 |
| LAB473 | 0.75 | 0.020 | H | 64 | LAB476 | 0.96 | 0.003 | L | 43 |
| LAB473 | −0.75 | 0.021 | H | 41 | LAB476 | 0.95 | 0.003 | L | 74 |
| LAB473 | 0.75 | 0.013 | N | 69 | LAB476 | 0.95 | 0.004 | L | 70 |
| LAB473 | 0.74 | 0.034 | G | 76 | LAB476 | 0.95 | 0.004 | L | 78 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB473 | −0.72 | 0.028 | K | 41 | LAB476 | 0.91 | 0.001 | K | 28 |
| LAB473 | 0.72 | 0.043 | G | 54 | LAB476 | −0.89 | 0.016 | L | 52 |
| LAB473 | 0.72 | 0.019 | N | 97 | LAB476 | 0.87 | 0.023 | L | 62 |
| LAB473 | 0.72 | 0.019 | R | 67 | LAB476 | 0.80 | 0.030 | A | 62 |
| LAB473 | 0.72 | 0.044 | B | 72 | LAB476 | −0.80 | 0.031 | A | 16 |
| LAB473 | 0.71 | 0.033 | C | 14 | LAB476 | −0.80 | 0.031 | A | 66 |
| LAB473 | −0.70 | 0.035 | H | 60 | LAB476 | 0.78 | 0.022 | G | 70 |
| LAB474 | 0.90 | 0.014 | L | 8 | LAB476 | 0.76 | 0.048 | A | 43 |
| LAB474 | 0.84 | 0.009 | G | 55 | LAB476 | −0.90 | 0.002 | F | 34 |
| LAB474 | 0.84 | 0.009 | B | 70 | LAB476 | 0.90 | 0.001 | K | 64 |
| LAB474 | 0.81 | 0.016 | B | 78 | LAB476 | 0.88 | 0.002 | C | 59 |
| LAB474 | 0.80 | 0.018 | G | 78 | LAB476 | 0.88 | 0.022 | L | 41 |
| LAB474 | 0.78 | 0.022 | B | 74 | LAB476 | 0.88 | 0.009 | H | 99 |
| LAB474 | 0.77 | 0.043 | G | 31 | LAB476 | −0.86 | 0.007 | D | 69 |
| LAB474 | 0.74 | 0.034 | G | 74 | LAB476 | −0.84 | 0.009 | D | 77 |
| LAB474 | −0.72 | 0.045 | G | 35 | LAB476 | −0.82 | 0.023 | A | 13 |
| LAB474 | 0.71 | 0.032 | K | 6 | LAB476 | 0.82 | 0.024 | A | 72 |
| LAB474 | 0.88 | 0.004 | G | 76 | LAB476 | 0.80 | 0.016 | D | 42 |
| LAB474 | 0.86 | 0.002 | M | 101 | LAB476 | −0.80 | 0.018 | B | 41 |
| LAB474 | 0.86 | 0.007 | G | 56 | LAB476 | 0.80 | 0.018 | G | 38 |
| LAB474 | 0.85 | 0.003 | C | 21 | LAB476 | 0.78 | 0.013 | C | 32 |
| LAB474 | 0.85 | 0.002 | Q | 65 | LAB476 | 0.76 | 0.029 | F | 22 |
| LAB474 | 0.85 | 0.008 | G | 54 | LAB476 | −0.72 | 0.045 | G | 7 |
| LAB474 | 0.85 | 0.008 | G | 72 | LAB476 | 0.72 | 0.030 | H | 76 |
| LAB474 | −0.84 | 0.002 | R | 86 | LAB476 | −0.71 | 0.030 | J | 34 |
| LAB474 | 0.80 | 0.005 | R | 53 | LAB476 | −0.71 | 0.049 | G | 27 |
| LAB476 | −0.71 | 0.033 | K | 60 | LAB476 | 0.71 | 0.033 | C | 10 |
| LAB476 | −0.70 | 0.036 | I | 2 | LAB478 | −0.80 | 0.009 | K | 38 |
| LAB476 | −0.88 | 0.004 | D | 73 | LAB478 | −0.80 | 0.031 | A | 54 |
| LAB477 | 0.96 | 0.002 | L | 74 | LAB478 | 0.79 | 0.020 | G | 68 |
| LAB477 | 0.95 | 0.003 | L | 78 | LAB478 | 0.75 | 0.019 | I | 17 |
| LAB477 | 0.93 | 0.001 | B | 58 | LAB478 | −0.75 | 0.012 | O | 85 |
| LAB477 | −0.91 | 0.013 | L | 52 | LAB478 | 0.75 | 0.020 | J | 77 |
| LAB477 | 0.89 | 0.007 | A | 66 | LAB478 | 0.74 | 0.015 | N | 69 |
| LAB477 | 0.87 | 0.023 | L | 62 | LAB478 | 0.74 | 0.024 | H | 29 |
| LAB477 | −0.87 | 0.010 | K | 100 | LAB478 | 0.73 | 0.016 | O | 51 |
| LAB477 | 0.84 | 0.018 | G | 31 | LAB478 | 0.72 | 0.029 | J | 69 |
| LAB477 | 0.84 | 0.038 | L | 43 | LAB478 | 0.71 | 0.046 | B | 64 |
| LAB477 | −0.84 | 0.005 | H | 35 | LAB478 | 0.72 | 0.029 | J | 73 |
| LAB477 | 0.80 | 0.018 | G | 78 | LAB605 | 0.90 | 0.002 | B | 70 |
| LAB477 | 0.75 | 0.032 | G | 28 | LAB605 | 0.87 | 0.005 | B | 62 |
| LAB477 | 0.74 | 0.037 | G | 74 | LAB605 | 0.86 | 0.007 | B | 74 |
| LAB477 | 0.73 | 0.042 | G | 55 | LAB605 | −0.85 | 0.008 | K | 47 |
| LAB477 | 0.94 | 0.005 | L | 41 | LAB605 | 0.84 | 0.037 | A | 31 |
| LAB477 | −0.86 | 0.007 | D | 15 | LAB605 | 0.83 | 0.011 | B | 78 |
| LAB477 | 0.84 | 0.034 | L | 68 | LAB605 | 0.83 | 0.006 | H | 70 |
| LAB477 | −0.82 | 0.003 | Q | 85 | LAB605 | 0.79 | 0.035 | A | 43 |
| LAB477 | 0.80 | 0.017 | G | 76 | LAB605 | 0.79 | 0.036 | A | 55 |
| LAB477 | −0.78 | 0.021 | D | 11 | LAB605 | 0.78 | 0.014 | H | 74 |
| LAB477 | 0.77 | 0.024 | G | 72 | LAB605 | 0.78 | 0.014 | H | 62 |
| LAB477 | 0.76 | 0.028 | D | 34 | LAB605 | −0.78 | 0.040 | A | 16 |
| LAB477 | 0.76 | 0.028 | G | 54 | LAB605 | −0.77 | 0.041 | B | 100 |
| LAB477 | 0.74 | 0.015 | Q | 65 | LAB605 | 0.77 | 0.016 | H | 78 |
| LAB477 | 0.73 | 0.016 | N | 77 | LAB605 | 0.76 | 0.048 | A | 62 |
| LAB477 | 0.73 | 0.040 | Q | 56 | LAB605 | 0.72 | 0.044 | G | 6 |
| LAB477 | 0.73 | 0.027 | I | 2 | LAB605 | 0.71 | 0.031 | H | 28 |
| LAB478 | 0.93 | 0.002 | G | 31 | LAB605 | 0.89 | 0.007 | A | 72 |
| LAB478 | 0.89 | 0.007 | A | 16 | LAB605 | −0.88 | 0.020 | L | 50 |
| LAB478 | 0.88 | 0.004 | G | 78 | LAB605 | 0.87 | 0.010 | A | 76 |
| LAB478 | −0.83 | 0.020 | G | 47 | LAB605 | 0.87 | 0.001 | E | 21 |
| LAB478 | 0.82 | 0.012 | G | 74 | LAB605 | −0.84 | 0.002 | Q | 83 |
| LAB478 | 0.81 | 0.015 | G | 55 | LAB605 | 0.84 | 0.034 | L | 60 |
| LAB478 | 0.80 | 0.016 | H | 47 | LAB605 | 0.84 | 0.009 | B | 56 |
| LAB478 | 0.79 | 0.020 | G | 70 | LAB605 | 0.83 | 0.003 | R | 81 |
| LAB478 | 0.79 | 0.036 | A | 35 | LAB605 | 0.83 | 0.020 | A | 54 |
| LAB478 | −0.77 | 0.041 | A | 55 | LAB605 | −0.83 | 0.022 | A | 13 |
| LAB478 | 0.77 | 0.027 | G | 62 | LAB605 | −0.82 | 0.003 | Q | 89 |
| LAB478 | 0.76 | 0.047 | A | 66 | LAB605 | 0.82 | 0.007 | H | 38 |
| LAB478 | 0.73 | 0.040 | G | 28 | LAB605 | −0.81 | 0.005 | Q | 91 |
| LAB478 | 0.72 | 0.028 | H | 12 | LAB605 | 0.80 | 0.031 | A | 45 |
| LAB478 | 0.71 | 0.047 | B | 78 | LAB605 | 0.80 | 0.033 | A | 68 |
| LAB478 | 0.71 | 0.049 | B | 28 | LAB605 | 0.79 | 0.006 | P | 44 |

TABLE 59-continued

Correlation between the expression level of selected LAB genes of some embodiments of the invention in various tissues and the phenotypic performance under low nitrogen, normal or drought stress conditions across Barley accessions

| Gene Name | R | P | Exp. Set | Corr. ID | Gene Name | R | P | Exp. set | Corr. ID |
|---|---|---|---|---|---|---|---|---|---|
| LAB478 | 0.92 | 0.001 | G | 76 | LAB605 | 0.78 | 0.022 | B | 68 |
| LAB478 | 0.90 | 4.42E−04 | N | 73 | LAB605 | −0.77 | 0.025 | D | 42 |
| LAB478 | 0.88 | 0.004 | G | 72 | LAB605 | −0.77 | 0.010 | Q | 87 |
| LAB478 | 0.87 | 0.001 | N | 97 | LAB605 | 0.75 | 0.019 | K | 76 |
| LAB478 | 0.86 | 0.001 | N | 77 | LAB605 | 0.75 | 0.033 | B | 29 |
| LAB478 | 0.85 | 0.008 | G | 54 | LAB605 | 0.74 | 0.023 | J | 77 |
| LAB478 | −0.84 | 0.008 | B | 60 | LAB605 | 0.73 | 0.026 | H | 68 |
| LAB478 | −0.83 | 0.003 | R | 44 | LAB605 | 0.73 | 0.018 | O | 80 |
| LAB478 | −0.83 | 0.021 | A | 72 | LAB605 | −0.72 | 0.019 | O | 89 |
| LAB478 | 0.81 | 0.015 | G | 56 | LAB605 | −0.71 | 0.022 | O | 83 |
| LAB478 | 0.80 | 0.009 | I | 19 | LAB605 | 0.70 | 0.035 | I | 79 |

Table 59.
"Corr. ID"—correlation set ID according to the correlated parameters Table above.
"Exp. Set"—Expression set.
"R" = Pearson correlation coefficient;
"P" = p value.

Example 9

Production of *Arabidopsis* Transcriptom and High Throughput Correlation Analysis Using 44K *Arabidopsis* Oligonucleotide Micro-Array In order to produce a high throughput correlation analysis comparing between plant phenotype and gene expression level, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1 Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Two tissues of plants [leaves and stems] growing at two different nitrogen fertilization levels (1.5 mM Nitrogen or 6 mM Nitrogen) were sampled and RNA was extracted as described above. Each micro-array expression information tissue type has received a Set ID as summarized Table 60 below.

TABLE 60

*Arabidopsis* transcriptom experimental sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 60.

*Arabidopsis* yield components and vigor related parameters under different nitrogen fertilization levels assessment—10 Arabidopsis accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]). Next, analyzed data was saved to text files and processed using the JMP statistical analysis software (SAS institute).

Data parameters collected are summarized in Table 61, hereinbelow.

TABLE 61

*Arabidopsis* correlated parameters (vectors)

| Correlated parameter with | Correlation Id |
|---|---|
| N 1.5 mM; Rosette Area at day 8 [$cm^2$] | 1 |
| N 1.5 mM; Rosette Area at day 10 [$cm^2$] | 2 |
| N 1.5 mM; Plot Coverage at day 8 [%] | 3 |
| N 1.5 mM; Plot Coverage at day 10 [%] | 4 |

TABLE 61-continued

*Arabidopsis* correlated parameters (vectors)

| Correlated parameter with | Correlation Id |
|---|---|
| N 1.5 mM; Leaf Number at day 10 | 5 |
| N 1.5 mM; Leaf Blade Area at day 10 [$cm^2$] | 6 |
| N 1.5 mM; RGR of Rosette Area at day 3 [$cm^2$/day] | 7 |
| N 1.5 mM; t50 Flowering [day] | 8 |
| N 1.5 mM; Dry Weight [gr./plant] | 9 |
| N 1.5 mM; Seed Yield [gr./plant] | 10 |
| N 1.5 mM; Harvest Index | 11 |
| N 1.5 mM; 1000 Seeds weight [gr.] | 12 |
| N 1.5 mM; seed yield/rosette area at day 10 [gr/$cm^2$] | 13 |
| N 1.5 mM; seed yield/leaf blade [gr/$cm^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr.] | 17 |
| N 1.5 mM; DW/N level [gr./SPAD unit] | 18 |
| N 1.5 mM; seed yield/N level [gr./SPAD unit] | 19 |
| N 6 mM; Rosette Area at day 8 [$cm^2$] | 20 |
| N 6 mM; Rosette Area at day 10 [$cm^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [$cm^2$/gr.] | 26 |
| N 6 mM; t50 Flowering [day] | 27 |
| N 6 mM; Dry Weight [gr./plant] | 28 |
| N 6 mM; Seed Yield [gr./plant] | 29 |
| N 6 mM; Harvest Index | 30 |
| N 6 mM; 1000 Seeds weight [gr.] | 31 |
| N 6 mM; seed yield/rosette area day at day 10 [gr./$cm^2$] | 32 |
| N 6 mM; seed yield/leaf blade [gr/$cm^2$] | 33 |
| N 6 mM; N level/FW | 34 |
| N 6 mM; DW/N level [gr./SPAD unit] | 35 |
| N 6 mM; N level/DW (SPAD unit/gr. plant) | 36 |
| N 6 mM; Seed yield/N unit [gr./SPAD unit] | 37 |

Table 61.
"N" = Nitrogen at the noted concentrations;
"gr." = grams;
"SPAD" = chlorophyll levels;
"t50" = time where 50% of plants flowered;
"gr./SPAD unit" = plant biomass expressed in grams per unit of nitrogen in plant measured by SPAD.
"DW" = plant dry weight;
"N level/DW" = plant Nitrogen level measured in SPAD unit per plant biomass [gr.];
"DW/N level" = plant biomass per plant [gr.]/SPAD unit;

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process to is repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, Rosette diameter and area.

Vegetative growth rate: the relative growth rate (RGR) of leaf blade area (Formula XIV), leaf number (Formula VI above), rosette area (Formula XV), rosette diameter (Formula XVI), plot coverage (Formula XVII) and Petiole Relative Area (XVIII) are calculated as follows:

Relative growth rate of leaf blade area=Regression coefficient of leaf area along time course.   Formula XIV Relative growth rate of rosette area=Regression coefficient of rosette area along time course.   Formula XV Relative growth rate of rosette diameter=Regression coefficient of rosette diameter along time course.   Formula XVI Relative growth rate of plot coverage=Regression coefficient of plot.   Formula XVII Petiole Relative Area=[(Leaf blade*Leaf number)/ Rosette.   Formula XVIII Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—The harvest index was calculated using Formula IV as described above.

$T_{50}$ days to flowering—Each of the repeats was monitored for flowering date.

Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software and values are summarized in Table 62 below. Subsequent correlation analysis between the various transcriptom sets (Table 60) and the measured parameters was conducted. Following are the results integrated to the database.

TABLE 62

Measured parameters in *Arabidopsis* accessions

| Ecotype\Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 1.5 mM; Rosette Area at day 8 | 0.760 | 0.709 | 1.061 | 1.157 | 0.996 | 1.000 | 0.910 | 0.942 | 1.118 | 0.638 |
| N 1.5 mM; Rosette Area at day 10 | 1.430 | 1.325 | 1.766 | 1.971 | 1.754 | 1.832 | 1.818 | 1.636 | 1.996 | 1.150 |
| N 1.5 mM; Plot Coverage % at day 8 | 3.221 | 3.003 | 4.497 | 4.902 | 4.220 | 4.238 | 3.858 | 3.990 | 4.738 | 2.705 |
| N 1.5 mM; Plot Coverage % at day 10 | 6.058 | 5.614 | 7.484 | 8.351 | 7.432 | 7.764 | 7.702 | 6.933 | 8.458 | 4.871 |
| N 1.5 mM; Leaf Number at day 10 | 6.875 | 7.313 | 7.313 | 7.875 | 7.938 | 7.750 | 7.625 | 7.188 | 8.625 | 5.929 |
| N 1.5 mM; Leaf Blade Area at day 10 | 0.335 | 0.266 | 0.374 | 0.387 | 0.373 | 0.370 | 0.386 | 0.350 | 0.379 | 0.307 |
| N 1.5 mM; RGR of Rosette Area at day 3 | 0.631 | 0.793 | 0.502 | 0.491 | 0.605 | 0.720 | 0.825 | 0.646 | 0.668 | 0.636 |
| N 1.5 mM; t50 Flowering [day] | 15.967 | 20.968 | 14.836 | 24.708 | 23.566 | 23.698 | 18.059 | 19.488 | 23.568 | 21.888 |
| N 1.5 mM; Dry Weight [gr/plant] | 0.164 | 0.124 | 0.082 | 0.113 | 0.184 | 0.124 | 0.134 | 0.106 | 0.148 | 0.171 |
| N 1.5 mM; Seed Yield [gr/plant] | 0.032 | 0.025 | 0.023 | 0.010 | 0.006 | 0.009 | 0.032 | 0.019 | 0.012 | 0.014 |
| N 1.5 mM; Harvest Index | 0.192 | 0.203 | 0.295 | 0.085 | 0.031 | 0.071 | 0.241 | 0.179 | 0.081 | 0.079 |
| N 1.5 mM; 1000 Seeds weight[gr] | 0.016 | 0.016 | 0.018 | 0.014 | 0.018 | 0.022 | 0.015 | 0.014 | 0.022 | 0.019 |
| N 1.5 mM; seed yield/rosette area day at day 10 | 0.022 | 0.019 | 0.014 | 0.005 | 0.003 | 0.005 | 0.018 | 0.013 | 0.007 | 0.012 |
| N 1.5 mM; seed yield/leaf blade | 0.095 | 0.095 | 0.063 | 0.026 | 0.015 | 0.024 | 0.084 | 0.059 | 0.034 | 0.044 |
| N 1.5 mM; % Seed yield reduction compared to 6 mM | 72.559 | 84.701 | 78.784 | 87.996 | 91.820 | 92.622 | 76.710 | 81.938 | 91.301 | 85.757 |
| N 1.5 mM; % Biomass reduction compared to 6 mM | 60.746 | 76.706 | 78.560 | 78.140 | 62.972 | 78.641 | 73.192 | 83.068 | 77.190 | 70.120 |
| N 1.5 mM; Spad/FW | 45.590 | | | 42.108 | 28.151 | | 53.111 | | | 67.000 |
| N 1.5 mM; SPAD/DW | 167.300 | | | 241.061 | 157.823 | | 194.977 | | | 169.343 |
| N 1.5 mM; DW/SPAD | 0.006 | | | 0.004 | 0.006 | | 0.005 | | | 0.006 |
| N 1.5 mM; seed yield/spad | 0.001 | | | 0.000 | 0.000 | | 0.001 | | | 0.000 |
| N 6 mM; Rosette Area at day 8 | 0.759 | 0.857 | 1.477 | 1.278 | 1.224 | 1.095 | 1.236 | 1.094 | 1.410 | 0.891 |
| N 6 mM; Rosette Area at day 10 | 1.406 | 1.570 | 2.673 | 2.418 | 2.207 | 2.142 | 2.474 | 1.965 | 2.721 | 1.642 |
| N 6 mM; Plot Coverage % at day 8 | 3.216 | 3.631 | 6.259 | 5.413 | 5.187 | 4.641 | 5.236 | 4.634 | 5.974 | 3.774 |
| N 6 mM; Plot Coverage % at day 10 | 5.957 | 6.654 | 11.324 | 10.244 | 9.352 | 9.076 | 10.485 | 8.327 | 11.528 | 6.958 |
| N 6 mM; Leaf Number at day 10 | 6.250 | 7.313 | 8.063 | 8.750 | 8.063 | 8.750 | 8.375 | 7.125 | 9.438 | 6.313 |
| N 6 mM; Leaf Blade Area at day 10 | 0.342 | 0.315 | 0.523 | 0.449 | 0.430 | 0.430 | 0.497 | 0.428 | 0.509 | 0.405 |
| N 6 mM; RGR of Rosette Area at day 3 | 0.689 | 1.024 | 0.614 | 0.601 | 0.477 | 0.651 | 0.676 | 0.584 | 0.613 | 0.515 |
| N 6 mM; t50 Flowering [day] | 16.371 | 20.500 | 14.635 | 24.000 | 23.378 | 23.595 | 15.033 | 19.750 | 22.887 | 18.804 |
| N 6 mM; Dry Weight [gr/plant] | 0.419 | 0.531 | 0.382 | 0.518 | 0.496 | 0.579 | 0.501 | 0.628 | 0.649 | 0.573 |
| N 6 mM; Seed Yield [gr/plant] | 0.116 | 0.165 | 0.108 | 0.082 | 0.068 | 0.119 | 0.139 | 0.107 | 0.138 | 0.095 |
| N 6 mM; Harvest Index | 0.280 | 0.309 | 0.284 | 0.158 | 0.136 | 0.206 | 0.276 | 0.171 | 0.212 | 0.166 |
| N 6 mM; 1000 Seeds weight[gr] | 0.015 | 0.017 | 0.018 | 0.012 | 0.016 | 0.016 | 0.015 | 0.014 | 0.017 | 0.016 |
| N 6 mM; seed yield/rosette area day at day 10 | 0.082 | 0.106 | 0.041 | 0.034 | 0.031 | 0.056 | 0.057 | 0.055 | 0.051 | 0.058 |
| N 6 mM; seed yield/leaf blade | 0.339 | 0.526 | 0.207 | 0.183 | 0.158 | 0.277 | 0.281 | 0.252 | 0.271 | 0.235 |
| N 6 mM; Spad/FW | 22.489 | | | 28.268 | 17.641 | | 33.323 | | | 39.003 |

TABLE 62-continued

Measured parameters in *Arabidopsis* accessions

| Ecotype\Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 6 mM; DW/SPAD (biomass/N unit) | 0.019 | | | 0.018 | 0.028 | | 0.015 | | | 0.015 |
| N 6 mM; spad/DW (gN/g plant) | 53.705 | | | 54.625 | 35.548 | | 66.479 | | | 68.054 |
| N 6 mM; Seed yield/N unit | 0.004 | | | 0.003 | 0.002 | | 0.005 | | | 0.003 |

Table 62. Provided are the measured parameters under various treatments in various ecotypes (*Arabidopsis* accessions).

Example 10

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis comparing between plant phenotype and gene expression level, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental procedures

Analyzed *Arabidopsis* Tissues—Five tissues at different developmental stages including root, leaf, flower at anthesis, seed at 5 days after flowering (DAF) and seed at 12 DAF, representing different plant characteristics, were sampled and RNA was extracted as described above. Each microarray expression information tissue type has received a Set ID as summarized in Table 63 below.

TABLE 63

Tissues used for *Arabidopsis* transcriptom expression sets

| Expression Set | Set ID |
|---|---|
| Root | A |
| Leaf | B |
| Flower | C |
| Seed 5 DAF | D |
| Seed 12 DAF | E |

Table 63:
Provided are the identification (ID) letters of each of the *Arabidopsis* expression sets (A-E).
DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at to controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S. National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula XIX.

Relative growth rate of root coverage=Regression coefficient of root coverage along time course.   Formula XIX Vegetative growth rate analysis—was calculated according to Formulas XIV, VI, XV, XVI, XVII, and XVIII above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula XX.

Seed Oil yield=Seed yield per plant (gr.)*Oil % in seed.   Formula XX

Harvest Index (Seed)—The harvest index was calculated using Formula IV (described above).

Experimental Results

Nine different *Arabidopsis* ecotypes were grown and characterized for 18 parameters (named as vectors). Table 64 describes the *Arabidopsis* correlated parameters. The average for each of the measured parameter was calculated using the JMP software (Tables 65-66) and a subsequent correlation analysis was performed. Results were then integrated to the database.

TABLE 64

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr.) at bolting stage | 4 |
| Dry matter per plant (gr.) | 5 |
| Vegetative growth rate (cm$^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr.) | 11 |
| Oil % per seed | 12 |
| Seeds per silique | 13 |
| Silique length (cm) | 14 |
| Seed yield per plant (gr.) | 15 |
| Oil yield per plant (mg) | 16 |
| Harvest Index | 17 |
| Leaf width/length | 18 |

Table 64.
Provided are the *Arabidopsis* correlated parameters (correlation ID Nos. 1-18).
Abbreviations:
Cm = centimeter(s);
gr. = gram(s);
mg = milligram(s).

The characterized values are summarized in Tables 65 and 66 below.

TABLE 65

Measured parameters in *Arabidopsis* ecotypes

| | Ecotype | | | | | | | | |
|---|---|---|---|---|---|---|---|---|---|
| | 15 | 16 | 12 | 11 | 5 | 17 | 10 | 13 | 14 |
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |

TABLE 65-continued

Measured parameters in *Arabidopsis* ecotypes

| | Ecotype | | | | | | | | |
|---|---|---|---|---|---|---|---|---|---|
| | 15 | 16 | 12 | 11 | 5 | 17 | 10 | 13 | 14 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

*Arabidopsis* ecotypes:
15 = Seed yield per plant (gram); 16 = oil yield per plant (mg);

12 = oil % per seed; 11 = 1000 seed weight (gr.); 5 = dry matter per plant (gr.); 17 = harvest index; 10 = total leaf area per plant (cm); 13 = seeds per silique; 14 = Silique length (cm).

Table 65.
Provided are the values of each of the parameters measured in?

TABLE 66

Additional measured parameters in *Arabidopsis* ecotypes

| | Ecotype | | | | | | | | |
|---|---|---|---|---|---|---|---|---|---|
| | 6 | 3 | 2 | 1 | 4 | 9 | 8 | 18 | 7 |
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 66.
Provided are the values of each of the parameters measured in *Arabidopsis* ecotypes: 6 = Vegetative growth rate ($cm^2$/day) until 8 true leaves;
3 = relative root growth (cm/day) (day 13);
2 = Root length day 7 (cm);
1 = Root length day 13 (cm);
4 = fresh weight per plant (gr.) at bolting stage;
9. = Lamima length (cm);
8 = Lamina width (cm);
18 = Leaf width/length;
7 = Blade circularity.

Example 11

Plant Fiber Development in Cotton Production of Cotton Transcriptom and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol wwwdotcottonevolution (dot) info/). This Cotton Oligonucleotide Microarray is composed of 12,006 Integrated DNA Technologies (IDT) oligonucleotides derived from an assembly of more than 180,000 Gossypium ESTs sequenced from 30 cDNA libraries. For additional details see PCT/IL2005/000627 and PCT/IL2007/001590 which are fully incorporated herein by reference.

TABLE 67

Cotton transcriptom experimental sets

| Expression Set | Set ID |
|---|---|
| cotton fiber 5 d | A |
| cotton fiber 10 d | B |
| cotton fiber 15 d | C |

Table 67.
Provided are the cotton transcriptom expression sets.
"5d" = 5 days post anthesis;
"10 d" = 10 days post anthesis;
"15 d" = 15 days post anthesis.
"DPA" = days-past-anthesis.

In order to define correlations between the levels of RNA expression and fiber length, fibers from 8 different cotton lines were analyzed. These fibers were selected to showing very good fiber quality and high lint index (Pima types, originating from other cotton species, namely G. barbadense), different levels of quality and lint indexes from various G. hirsutum lines: good quality and high lint index (Acala type), and poor quality and short lint index (Tamcot type, and old varieties). A summary of the fiber length of the different lines is provided in Table 68.

Experimental procedures

RNA extraction—Fiber development stages, representing different fiber characteristics, at 5, 10 and 15 DPA were sampled and RNA was extracted as described above.

Fiber length assessment—Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot) cottoninc (dot) com/Classification-ofCotton/?Pg=4#Length].

Experimental Results

Eight different cotton lines were grown, and their fiber length was measured. The fibers UHM values are summarized in Table 68 herein below. The R square was calculated for each of the genes.

TABLE 68

Summary of the fiber length of the 8 different cotton lines

| | Length (UHM) | |
|---|---|---|
| Cotton variety | Mean | STD |
| SA 217 SD | 0.89 | 0.04 |
| SA 68 SD | 1.01 | 0.03 |
| Tamcot | 1.06 | 0.01 |
| DP 90 | 1.1 | 0.08 |
| ZG 236 | 1.15 | 0.00 |
| Coker 310 | 1.21 | 0.02 |
| S7 | 1.26 | 0.02 |
| Pima | 1.36 | 0.00 |

Table 68:
Presented are the means and standard deviations (STD) of 8 different cotton lines.

TABLE 69

Correlation between the expression level of selected genes of some embodiments of the invention in various tissues and the phenotypic performance under normal conditions in cotton

| Gene Name | R | P value | Exp. set | Gene Name | R | P value | Exp. set |
|---|---|---|---|---|---|---|---|
| LAB406 | 0.72 | 0.043 | C | LAB482 | 0.71 | 0.049 | B |
| LAB482 | 0.93 | 0.0006 | A | LAB485 | 0.83 | 0.011 | C |
| LAB485 | 0.74 | 0.034 | A | LAB486 | 0.76 | 0.046 | B |
| LAB486 | 0.77 | 0.026 | C | LAB493 | 0.82 | 0.023 | B |
| LAB502 | 0.78 | 0.023 | A | | | | |

Table 69.
Provided are the correlations between the expression level of the genes and the effect on fiber length.
"Exp. Set"—Expression set.
"R" = Pearson correlation coefficient;
"P" = p value.

Example 12

Identification of Genes which Increase ABST, Growth Rate, Vigor, Yield, Biomass, Oil Content, WUE, NUE, Fiber Yield, Fiber Quality and/or FUE in Plants Based on the above described bioinformatics and experimental tools, the present inventors have identified 275 genes which exhibit a major impact on abiotic stress tolerance, plant yield, oil content, growth rate, vigor, biomass, growth rate, fiber yield, fiber quality, nitrogen use efficiency, water use efficiency and fertilizer use efficiency when expression thereof is increased in plants. The identified genes, their curated polynucleotide and polypeptide sequences, as well as their updated sequences according to GenBank database are summarized in Table 70, hereinbelow.

TABLE 70

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB390 | barley|10v1|AJ478516 | barley | 1 | 474 |
| LAB392 | barley|10v1|BG415583 | barley | 2 | 475 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB393 | barley\|10v1\|CX625772 | barley | 3 | 476 |
| LAB394 | sorghum\|09v1\|CF756383 | sorghum | 4 | 477 |
| LAB395 | sunflower\|10v1\|DY926858 | sunflower | 5 | 478 |
| LAB396 | tomato\|09v1\|AJ001310 | tomato | 6 | 479 |
| LAB397 | tomato\|09v1\|AW934380 | tomato | 7 | 480 |
| LAB398 | tomato\|09v1\|BG123943 | tomato | 8 | 481 |
| LAB399 | tomato\|09v1\|BG134139 | tomato | 9 | 482 |
| LAB400 | tomato\|09v1\|BG134340 | tomato | 10 | 483 |
| LAB401 | tomato\|09v1\|BI406598 | tomato | 11 | 484 |
| LAB402 | barley\|10v1\|AV836487 | barley | 12 | 485 |
| LAB404 | barley\|10v1\|BJ458433 | barley | 13 | 486 |
| LAB405 | barley\|10v1\|BM444893 | barley | 14 | 487 |
| LAB406 | cotton\|10v2barbadense\|BF275651 | cotton | 15 | 488 |
| LAB407 | sunflower\|10v1\|DY918707 | sunflower | 16 | 489 |
| LAB408 | sunflower\|gb162\|BU01881 | sunflower | 17 | 490 |
| LAB409 | tomato\|09v1\|BG129458 | tomato | 18 | 491 |
| LAB410 | barley\|10v1\|AJ475971 | barley | 19 | 492 |
| LAB412 | barley\|10v1\|AV833158 | barley | 20 | 493 |
| LAB413 | barley\|10v1\|AV833237 | barley | 21 | 494 |
| LAB415 | barley\|10v1\|AV833483 | barley | 22 | 495 |
| LAB417 | barley\|10v1\|AV834378 | barley | 23 | 496 |
| LAB418 | barley\|10v1\|AV835376 | barley | 24 | 497 |
| LAB419 | barley\|10v1\|AV835772 | barley | 25 | 498 |
| LAB420 | barley\|10v1\|AV836330 | barley | 26 | 499 |
| LAB421 | barley\|10v1\|AV913297 | barley | 27 | 500 |
| LAB422 | barley\|10v1\|AV913803 | barley | 28 | 501 |
| LAB423 | barley\|10v1\|AV915375 | barley | 29 | 502 |
| LAB424 | barley\|10v1\|AV942850 | barley | 30 | 503 |
| LAB425 | barley\|10v1\|AW982618 | barley | 31 | 504 |
| LAB426 | barley\|10v1\|BE196464 | barley | 32 | 505 |
| LAB427 | barley\|10v1\|BE411674 | barley | 33 | 506 |
| LAB428 | barley\|10v1\|BE413539 | barley | 34 | 507 |
| LAB429 | barley\|10v1\|BE420678XX1 | barley | 35 | 508 |
| LAB430 | barley\|10v1\|BE420906 | barley | 36 | 509 |
| LAB431 | barley\|10v1\|BE421190 | barley | 37 | 510 |
| LAB432 | barley\|10v1\|BE421295 | barley | 38 | 511 |
| LAB433 | barley\|10v1\|BE421516 | barley | 39 | 512 |
| LAB434 | barley\|10v1\|BE437890 | barley | 40 | 513 |
| LAB435 | barley\|10v1\|BF064545 | barley | 41 | 514 |
| LAB436 | barley\|10v1\|BF266728 | barley | 42 | 515 |
| LAB437 | barley\|10v1\|BF616473 | barley | 43 | 516 |
| LAB438 | barley\|10v1\|BF620715 | barley | 44 | 517 |
| LAB439 | barley\|10v1\|BF622214 | barley | 45 | 518 |
| LAB440 | barley\|10v1\|BF622859 | barley | 46 | 519 |
| LAB442 | barley\|10v1\|BF624446 | barley | 47 | 520 |
| LAB443 | barley\|10v1\|BF625135 | barley | 48 | 521 |
| LAB444 | barley\|10v1\|BF625350 | barley | 49 | 522 |
| LAB445 | barley\|10v1\|BF626442 | barley | 50 | 523 |
| LAB446 | barley\|10v1\|BG299548 | barley | 51 | 524 |
| LAB447 | barley\|10v1\|BG344016 | barley | 52 | 525 |
| LAB448 | barley\|10v1\|BG344289 | barley | 53 | 526 |
| LAB449 | barley\|10v1\|BG344646 | barley | 54 | 527 |
| LAB450 | barley\|10v1\|BG366517 | barley | 55 | 528 |
| LAB451 | barley\|10v1\|BG368827 | barley | 56 | 529 |
| LAB452 | barley\|10v1\|BG415758 | barley | 57 | 530 |
| LAB453 | barley\|10v1\|BG415801 | barley | 58 | 531 |
| LAB454 | barley\|10v1\|BG418591 | barley | 59 | 532 |
| LAB455 | barley\|10v1\|BG439850 | barley | 60 | 533 |
| LAB456 | barley\|10v1\|BI947145 | barley | 61 | 534 |
| LAB457 | barley\|10v1\|BI947191 | barley | 62 | 535 |
| LAB458 | barley\|10v1\|BI947651 | barley | 63 | 536 |
| LAB459 | barley\|10v1\|BI949468 | barley | 64 | 537 |
| LAB460 | barley\|10v1\|BI951244 | barley | 65 | 538 |
| LAB461 | barley\|10v1\|BI958327 | barley | 66 | 539 |
| LAB462 | barley\|10v1\|BI959625 | barley | 67 | 540 |
| LAB463 | barley\|10v1\|BJ454135 | barley | 68 | 541 |
| LAB464 | barley\|10v1\|BLYBA | barley | 69 | 542 |
| LAB465 | barley\|10v1\|BM816841 | barley | 70 | 543 |
| LAB466 | barley\|10v1\|BQ462178 | barley | 71 | 544 |
| LAB467 | barley\|10v1\|BQ462669 | barley | 72 | 545 |
| LAB468 | barley\|10v1\|BQ469387 | barley | 73 | 546 |
| LAB469 | barley\|10v1\|BQ663843 | barley | 74 | 547 |
| LAB470 | barley\|10v1\|BQ762065 | barley | 75 | 548 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB471 | barley|10v1|BQ767166 | barley | 76 | 549 |
| LAB472 | barley|10v1|BU977409 | barley | 77 | 550 |
| LAB473 | barley|10v1|BY877689 | barley | 78 | 551 |
| LAB474 | barley|10v1|CB864695 | barley | 79 | 552 |
| LAB475 | barley|10v1|EX571799 | barley | 80 | 553 |
| LAB476 | barley|10v1|EX581175 | barley | 81 | 554 |
| LAB477 | barley|10v1|FD518903 | barley | 82 | 555 |
| LAB478 | barley|10v1|SLX36R1X0820618D1 | barley | 83 | 556 |
| LAB479 | cotton|10v1barbadense|AI054922 | cotton | 84 | 557 |
| LAB480 | cotton|10v1barbadense|AI055451 | cotton | 85 | 558 |
| LAB481 | cotton|10v1barbadense|AI726415 | cotton | 86 | 559 |
| LAB482 | cotton|10v1barbadense|AI731918 | cotton | 87 | 560 |
| LAB483 | cotton|10v1barbadense|BE052835 | cotton | 88 | 561 |
| LAB484 | cotton|10v1barbadense|BF270722 | cotton | 89 | 562 |
| LAB485 | cotton|10v1barbadense|BF274343 | cotton | 90 | 563 |
| LAB486 | cotton|10v1barbadense|BG441107 | cotton | 91 | 564 |
| LAB487 | cotton|10v1barbadense|CA992786 | cotton | 92 | 565 |
| LAB488 | cotton|10v1barbadense|CA992877 | cotton | 93 | 566 |
| LAB489 | cotton|10v1barbadense|CO069548 | cotton | 94 | 567 |
| LAB490 | cotton|10v1barbadense|CO069691 | cotton | 95 | 568 |
| LAB491 | cotton|10v1barbadense|CO121378 | cotton | 96 | 569 |
| LAB492 | cotton|10v1barbadense|CO126747 | cotton | 97 | 570 |
| LAB493 | cotton|10v1barbadense|DT047583 | cotton | 98 | 571 |
| LAB494 | cotton|10v1barbadense|DT468931 | cotton | 99 | 572 |
| LAB495 | cotton|10v1barbadense|DW478051 | cotton | 100 | 573 |
| LAB496 | cotton|10v1|BG447066 | cotton | 101 | 574 |
| LAB498 | cotton|10v2barbadense|AY857933 | cotton | 102 | 575 |
| LAB499 | cotton|10v2barbadense|BG446626 | cotton | 103 | 576 |
| LAB500 | cotton|10v2barbadense|CO104113 | cotton | 104 | 577 |
| LAB501 | cotton|10v2barbadense|DN800269 | cotton | 105 | 578 |
| LAB502 | cotton|10v2barbadense|ES794842 | cotton | 106 | 579 |
| LAB503 | maize|10v1|AI491334 | maize | 107 | 580 |
| LAB504 | maize|10v1|AI612362 | maize | 108 | 581 |
| LAB505 | maize|10v1|AI855243 | maize | 109 | 582 |
| LAB506 | maize|10v1|AI861715 | maize | 110 | 583 |
| LAB507 | maize|10v1|AI948235 | maize | 111 | 584 |
| LAB508 | maize|10v1|AW129802 | maize | 112 | 585 |
| LAB509 | maize|10v1|AW258131 | maize | 113 | 586 |
| LAB510 | maize|10v1|BE051059 | maize | 114 | 587 |
| LAB511 | maize|10v1|BG349450 | maize | 115 | 588 |
| LAB512 | maize|10v1|BI478654 | maize | 116 | 589 |
| LAB513 | maize|10v1|BM381514 | maize | 117 | 590 |
| LAB516 | rice|gb170|OS01G47540 | rice | 118 | 591 |
| LAB517 | rice|gb170|OS01G68290 | rice | 119 | 592 |
| LAB518 | rice|gb170|OS02G30910 | rice | 120 | 593 |
| LAB519 | rice|gb170|OS03G02050 | rice | 121 | 594 |
| LAB521 | rice|gb170|OS03G16170 | rice | 122 | 595 |
| LAB522 | rice|gb170|OS03G19290 | rice | 123 | 596 |
| LAB523 | rice|gb170|OS04G49980 | rice | 124 | 597 |
| LAB524 | rice|gb170|OS04G58090 | rice | 125 | 598 |
| LAB526 | rice|gb170|OS05G47730 | rice | 126 | 599 |
| LAB527 | rice|gb170|OS06G05470 | rice | 127 | 600 |
| LAB529 | rice|gb170|OS07G46280 | rice | 128 | 601 |
| LAB530 | rice|gb170|OS07G49270 | rice | 129 | 602 |
| LAB531 | rice|gb170|OS08G23870 | rice | 130 | 603 |
| LAB533 | rice|gb170|OS11G10590 | rice | 131 | 604 |
| LAB534 | rice|gb170|OS11G26790 | rice | 132 | 605 |
| LAB535 | rice|gb170|OS12G05210 | rice | 133 | 606 |
| LAB536 | rice|gb170|OS12G32610 | rice | 134 | 607 |
| LAB537 | sorghum|09v1|SB01G008750 | sorghum | 135 | 608 |
| LAB538 | sorghum|09v1|SB01G019140 | sorghum | 136 | 609 |
| LAB539 | sorghum|09v1|SB01G019710 | sorghum | 137 | 610 |
| LAB540 | sorghum|09v1|SB01G030340 | sorghum | 138 | 611 |
| LAB541 | sorghum|09v1|SB01G031950 | sorghum | 139 | 612 |
| LAB542 | sorghum|09v1|SB01G032370 | sorghum | 140 | 613 |
| LAB543 | sorghum|09v1|SB01G033700 | sorghum | 141 | 614 |
| LAB544 | sorghum|09v1|SB01G035240 | sorghum | 142 | 615 |
| LAB545 | sorghum|09v1|SB01G036700 | sorghum | 143 | 616 |
| LAB546 | sorghum|09v1|SB01G039830 | sorghum | 144 | 617 |
| LAB547 | sorghum|09v1|SB01G039890 | sorghum | 145 | 618 |
| LAB548 | sorghum|09v1|SB01G042110 | sorghum | 146 | 619 |
| LAB549 | sorghum|09v1|SB01G047615 | sorghum | 147 | 620 |
| LAB550 | sorghum|09v1|SB01G049830 | sorghum | 148 | 621 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB551 | sorghum\|09v1\|SB02G012470 | sorghum | 149 | 622 |
| LAB552 | sorghum\|09v1\|SB02G024240 | sorghum | 150 | 623 |
| LAB553 | sorghum\|09v1\|SB02G025910 | sorghum | 151 | 624 |
| LAB554 | sorghum\|09v1\|SB02G027340 | sorghum | 152 | 625 |
| LAB555 | sorghum\|09v1\|SB02G035950 | sorghum | 153 | 626 |
| LAB557 | sorghum\|09v1\|SB02G041880 | sorghum | 154 | 627 |
| LAB558 | sorghum\|09v1\|SB03G001350 | sorghum | 155 | 628 |
| LAB559 | sorghum\|09v1\|SB03G002080 | sorghum | 156 | 629 |
| LAB561 | sorghum\|09v1\|SB03G010430 | sorghum | 157 | 630 |
| LAB562 | sorghum\|09v1\|SB03G012950 | sorghum | 158 | 631 |
| LAB563 | sorghum\|09v1\|SB03G027020 | sorghum | 159 | 632 |
| LAB564 | sorghum\|09v1\|SB03G027320 | sorghum | 160 | 633 |
| LAB565 | sorghum\|09v1\|SB03G037550 | sorghum | 161 | 634 |
| LAB566 | sorghum\|09v1\|SB03G039630 | sorghum | 162 | 635 |
| LAB567 | sorghum\|09v1\|SB03G044260 | sorghum | 163 | 636 |
| LAB568 | sorghum\|09v1\|SB0498S002010 | sorghum | 164 | 637 |
| LAB569 | sorghum\|09v1\|SB04G021920 | sorghum | 165 | 638 |
| LAB570 | sorghum\|09v1\|SB04G031810 | sorghum | 166 | 639 |
| LAB571 | sorghum\|09v1\|SB04G032250 | sorghum | 167 | 640 |
| LAB572 | sorghum\|09v1\|SB04G033380 | sorghum | 168 | 641 |
| LAB573 | sorghum\|09v1\|SB04G035130 | sorghum | 169 | 642 |
| LAB575 | sorghum\|09v1\|SB05G023510 | sorghum | 170 | 643 |
| LAB576 | sorghum\|09v1\|SB05G027350 | sorghum | 171 | 644 |
| LAB577 | sorghum\|09v1\|SB06G000550 | sorghum | 172 | 645 |
| LAB578 | sorghum\|09v1\|SB06G018800 | sorghum | 173 | 646 |
| LAB581 | sorghum\|09v1\|SB07G003130 | sorghum | 174 | 647 |
| LAB582 | sorghum\|09v1\|SB07G007030 | sorghum | 175 | 648 |
| LAB584 | sorghum\|09v1\|SB07G029230 | sorghum | 176 | 649 |
| LAB585 | sorghum\|09v1\|SB08G005220 | sorghum | 177 | 650 |
| LAB586 | sorghum\|09v1\|SB08G014065 | sorghum | 178 | 651 |
| LAB587 | sorghum\|09v1\|SB09G006050 | sorghum | 179 | 652 |
| LAB588 | sorghum\|09v1\|SB09G020120 | sorghum | 180 | 653 |
| LAB589 | sorghum\|09v1\|SB09G026410 | sorghum | 181 | 654 |
| LAB590 | sorghum\|09v1\|SB09G027600 | sorghum | 182 | 655 |
| LAB591 | sorghum\|09v1\|SB09G029080 | sorghum | 183 | 656 |
| LAB592 | sorghum\|09v1\|SB10G001440 | sorghum | 184 | 657 |
| LAB593 | sorghum\|09v1\|SB10G006140 | sorghum | 185 | 658 |
| LAB594 | sorghum\|09v1\|SB10G009200 | sorghum | 186 | 659 |
| LAB595 | sorghum\|09v1\|SB10G024850 | sorghum | 187 | 660 |
| LAB596 | sorghum\|09v1\|SB10G025730 | sorghum | 188 | 661 |
| LAB597 | sorghum\|09v1\|SB10G029590 | sorghum | 189 | 662 |
| LAB598 | sunflower\|10v1\|AF030301 | sunflower | 190 | 663 |
| LAB599 | sunflower\|10v1\|EL432405 | sunflower | 191 | 664 |
| LAB600 | sunflower\|10v1\|GE522049 | sunflower | 192 | 665 |
| LAB601 | sunflower\|10v1\|SFSLX00081847D2 | sunflower | 193 | 666 |
| LAB602 | sunflower\|gb162\|CD847580 | sunflower | 194 | 667 |
| LAB603 | tomato\|09v1\|TOMTRALTBD | tomato | 195 | 668 |
| LAB604 | cotton\|10v1barbadense\|BE053925 | cotton | 196 | 669 |
| LAB605 | barley\|10v1\|BE196034 | barley | 197 | 670 |
| LAB607 | rice\|gb170\|OS04G49550 | rice | 198 | 671 |
| LAB608 | sorghum\|09v1\|SB01G040580 | sorghum | 199 | 672 |
| LAB609 | maize\|10v1\|MZEADH1 | maize | 200 | 673 |
| LAB610 | sorghum\|09v1\|SB03G001100 | sorghum | 201 | 674 |
| LAB611 | sorghum\|09v1\|SB03G035000 | sorghum | 202 | 675 |
| LAB612 | cotton\|10v2barbadense\|AI055252 | cotton | 203 | 676 |
| LAB391 | barley\|10v1\|BE438091 | barley | 204 | — |
| LAB403 | barley\|10v1\|AV929051 | barley | 205 | — |
| LAB497 | cotton\|10v1\|DR461487 | cotton | 206 | — |
| LAB390 | barley\|10v1\|AJ478516 | barley | 207 | 677 |
| LAB392 | barley\|10v1\|BG415583 | barley | 208 | 678 |
| LAB394 | sorghum\|09v1\|CF756383 | sorghum | 209 | 679 |
| LAB402 | barley\|10v1\|AV836487 | barley | 210 | 680 |
| LAB404 | barley\|10v1\|BJ458433 | barley | 211 | 681 |
| LAB405 | barley\|10v1\|BM444893 | barley | 212 | 682 |
| LAB408 | sunflower\|gb162\|BU031881 | sunflower | 213 | 683 |
| LAB412 | barley\|10v1\|AV833158 | barley | 214 | 684 |
| LAB413 | barley\|10v1\|AV833237 | barley | 215 | 685 |
| LAB415 | barley\|10v1\|AV833483 | barley | 216 | 686 |
| LAB417 | barley\|10v1\|AV834378 | barley | 217 | 687 |
| LAB418 | barley\|10v1\|AV835376 | barley | 218 | 688 |
| LAB419 | barley\|10v1\|AV835772 | barley | 219 | 689 |
| LAB420 | barley\|10v1\|AV836330 | barley | 220 | 690 |
| LAB422 | barley\|10v1\|AV913803 | barley | 221 | 691 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB424 | barley\|10v1\|AV942850 | barley | 222 | 692 |
| LAB430 | barley\|10v1\|BE420906 | barley | 223 | 509 |
| LAB434 | barley\|10v1\|BE437890 | barley | 224 | 693 |
| LAB435 | barley\|10v1\|BF064545 | barley | 225 | 694 |
| LAB436 | barley\|10v1\|BF266728 | barley | 226 | 695 |
| LAB447 | barley\|10v1\|BG344016 | barley | 227 | 696 |
| LAB448 | barley\|10v1\|BG344289 | barley | 228 | 697 |
| LAB451 | barley\|10v1\|BG368827 | barley | 229 | 698 |
| LAB452 | barley\|10v1\|BG415758 | barley | 230 | 699 |
| LAB454 | barley\|10v1\|BG418591 | barley | 231 | 700 |
| LAB455 | barley\|10v1\|BG439850 | barley | 232 | 701 |
| LAB456 | barley\|10v1\|BI947145 | barley | 233 | 702 |
| LAB459 | barley\|10v1\|BI949468 | barley | 234 | 703 |
| LAB461 | barley\|10v1\|BI958327 | barley | 235 | 704 |
| LAB462 | barley\|10v1\|BI959625 | barley | 236 | 705 |
| LAB463 | barley\|10v1\|BJ454135 | barley | 237 | 706 |
| LAB464 | barley\|10v1\|BLYBA | barley | 238 | 707 |
| LAB465 | barley\|10v1\|BM816841 | barley | 239 | 708 |
| LAB466 | barley\|10v1\|BQ462178 | barley | 240 | 709 |
| LAB467 | barley\|10v1\|BQ462669 | barley | 241 | 710 |
| LAB468 | barley\|10v1\|BQ469387 | barley | 242 | 711 |
| LAB469 | barley\|10v1\|BQ663843 | barley | 243 | 712 |
| LAB470 | barley\|10v1\|BQ762065 | barley | 244 | 713 |
| LAB471 | barley\|10v1\|BQ767166 | barley | 245 | 714 |
| LAB472 | barley\|10v1\|BU977409 | barley | 246 | 715 |
| LAB473 | barley\|10v1\|BY877689 | barley | 247 | 716 |
| LAB474 | barley\|10v1\|CB864695 | barley | 248 | 717 |
| LAB475 | barley\|10v1\|EX571799 | barley | 249 | 718 |
| LAB476 | barley\|10v1\|EX581175 | barley | 250 | 719 |
| LAB477 | barley\|10v1\|FD518903 | barley | 251 | 720 |
| LAB479 | cotton\|10v1barbadense\|AI054922 | cotton | 252 | 721 |
| LAB482 | cotton\|10v1barbadense\|AI731918 | cotton | 253 | 722 |
| LAB484 | cotton\|10v1barbadense\|BF270722 | cotton | 254 | 562 |
| LAB485 | cotton\|10v1barbadense\|BF274343 | cotton | 255 | 563 |
| LAB488 | cotton\|10v1barbadense\|CA992877 | cotton | 256 | 723 |
| LAB489 | cotton\|10v1barbadense\|CO069548 | cotton | 257 | 724 |
| LAB493 | cotton\|10v1barbadense\|DT047583 | cotton | 258 | 725 |
| LAB503 | maize\|10v1\|AI491334 | maize | 259 | 726 |
| LAB512 | maize\|10v1\|BI478654 | maize | 260 | 589 |
| LAB538 | sorghum\|09v1\|SB01G019140 | sorghum | 261 | 727 |
| LAB542 | sorghum\|09v1\|SB01G032370 | sorghum | 262 | 728 |
| LAB543 | sorghum\|09v1\|SB01G033700 | sorghum | 263 | 614 |
| LAB549 | sorghum\|09v1\|SB01G047615 | sorghum | 264 | 729 |
| LAB553 | sorghum\|09v1\|SB02G025910 | sorghum | 265 | 624 |
| LAB572 | sorghum\|09v1\|SB04G033380 | sorghum | 266 | 641 |
| LAB577 | sorghum\|09v1\|SB06G000550 | sorghum | 267 | 730 |
| LAB581 | sorghum\|09v1\|SB07G003130 | sorghum | 268 | 731 |
| LAB594 | sorghum\|09v1\|SB10G009200 | sorghum | 269 | 732 |
| LAB598 | sunflower\|10v1\|AF030301 | sunflower | 270 | 733 |
| LAB604 | cotton\|10v1barbadense\|BE053925 | cotton | 271 | 734 |
| LAB391 | barley\|10v1\|BE438091 | barley | 272 | — |
| LAB393 | barley\|10v1\|CX625772 | barley | 273 | — |
| LAB403 | barley\|10v1\|AV929051 | barley | 274 | — |
| LAB478 | barley\|10v1\|SLX36R1X0820618D1 | barley | 275 | — |
| LAB391 | barley\|10v1\|BE438091 | barley | 204 | — |
| LAB390 | barley\|10v1\|AJ478516 | barley | 276 | 474 |
| LAB393 | barley\|10v1\|CX625772 | barley | 277 | 735 |
| LAB394 | sorghum\|09v1\|CF756383 | sorghum | 278 | 477 |
| LAB395 | sunflower\|10v1\|DY926858 | sunflower | 279 | 736 |
| LAB396 | tomato\|09v1\|AJ001310 | tomato | 280 | 479 |
| LAB397 | tomato\|09v1\|AW934380 | tomato | 281 | 737 |
| LAB398 | tomato\|09v1\|BG123943 | tomato | 282 | 738 |
| LAB399 | tomato\|09v1\|BG134139 | tomato | 283 | 482 |
| LAB400 | tomato\|09v1\|BG134340 | tomato | 284 | 739 |
| LAB401 | tomato\|09v1\|BI406598 | tomato | 285 | 484 |
| LAB402 | barley\|10v1\|AV836487 | barley | 286 | 740 |
| LAB404 | barley\|10v1\|BJ458433 | barley | 287 | 741 |
| LAB405 | barley\|10v1\|BM444893 | barley | 288 | 742 |
| LAB406 | cotton\|10v2barbadense\|BF275651 | cotton | 289 | 743 |
| LAB407 | sunflower\|10v1\|DY918707 | sunflower | 290 | 489 |
| LAB408 | sunflower\|gb162\|BU031881 | sunflower | 291 | 744 |
| LAB409 | tomato\|09v1\|BG129458 | tomato | 292 | 745 |
| LAB410 | barley\|10v1\|AJ475971 | barley | 293 | 492 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB412 | barley\|10v1\|AV833158 | barley | 294 | 746 |
| LAB415 | barley\|10v1\|AV833483 | barley | 295 | 495 |
| LAB417 | barley\|10v1\|AV834378 | barley | 296 | 496 |
| LAB418 | barley\|10v1\|AV835376 | barley | 297 | 747 |
| LAB419 | barley\|10v1\|AV835772 | barley | 298 | 748 |
| LAB420 | barley\|10v1\|AV836330 | barley | 299 | 749 |
| LAB422 | barley\|10v1\|AV913803 | barley | 300 | 501 |
| LAB423 | barley\|10v1\|AV915375 | barley | 301 | 502 |
| LAB424 | barley\|10v1\|AV942850 | barley | 302 | 750 |
| LAB425 | barley\|10v1\|AW982618 | barley | 303 | 504 |
| LAB426 | barley\|10v1\|BE196464 | barley | 304 | 751 |
| LAB427 | barley\|10v1\|BE411674 | barley | 305 | 752 |
| LAB428 | barley\|10v1\|BE413539 | barley | 306 | 507 |
| LAB429 | barley\|10v1\|BE420678XX1 | barley | 307 | 508 |
| LAB430 | barley\|10v1\|BE420906 | barley | 308 | 753 |
| LAB431 | barley\|10v1\|BE421190 | barley | 309 | 754 |
| LAB432 | barley\|10v1\|BE421295 | barley | 310 | 511 |
| LAB433 | barley\|10v1\|BE421516 | barley | 311 | 512 |
| LAB434 | barley\|10v1\|BE437890 | barley | 312 | 755 |
| LAB435 | barley\|10v1\|BF064545 | barley | 313 | 514 |
| LAB437 | barley\|10v1\|BF616473 | barley | 314 | 756 |
| LAB438 | barley\|10v1\|BF620715 | barley | 315 | 757 |
| LAB439 | barley\|10v1\|BF622214 | barley | 316 | 518 |
| LAB440 | barley\|10v1\|BF622859 | barley | 317 | 758 |
| LAB442 | barley\|10v1\|BF624446 | barley | 318 | 759 |
| LAB443 | barley\|10v1\|BF625135 | barley | 319 | 521 |
| LAB444 | barley\|10v1\|BF625350 | barley | 320 | 760 |
| LAB445 | barley\|10v1\|BF626442 | barley | 321 | 523 |
| LAB446 | barley\|10v1\|BG299548 | barley | 322 | 524 |
| LAB447 | barley\|10v1\|BG344016 | barley | 323 | 761 |
| LAB448 | barley\|10v1\|BG344289 | barley | 324 | 762 |
| LAB449 | barley\|10v1\|BG344646 | barley | 325 | 527 |
| LAB450 | barley\|10v1\|BG366517 | barley | 326 | 763 |
| LAB451 | barley\|10v1\|BG368827 | barley | 327 | 764 |
| LAB452 | barley\|10v1\|BG415758 | barley | 328 | 765 |
| LAB453 | barley\|10v1\|BG415801 | barley | 329 | 766 |
| LAB454 | barley\|10v1\|BG418591 | barley | 330 | 767 |
| LAB455 | barley\|10v1\|BG439850 | barley | 331 | 533 |
| LAB456 | barley\|10v1\|BI947145 | barley | 332 | 768 |
| LAB457 | barley\|10v1\|BI947191 | barley | 333 | 769 |
| LAB458 | barley\|10v1\|BI947651 | barley | 334 | 536 |
| LAB459 | barley\|10v1\|BI949468 | barley | 335 | 770 |
| LAB460 | barley\|10v1\|BI951244 | barley | 336 | 538 |
| LAB461 | barley\|10v1\|BI958327 | barley | 337 | 771 |
| LAB462 | barley\|10v1\|BI959625 | barley | 338 | 772 |
| LAB463 | barley\|10v1\|BJ454135 | barley | 339 | 773 |
| LAB465 | barley\|10v1\|BM816841 | barley | 340 | 774 |
| LAB466 | barley\|10v1\|BQ462178 | barley | 341 | 775 |
| LAB467 | barley\|10v1\|BQ462669 | barley | 342 | 545 |
| LAB468 | barley\|10v1\|BQ469387 | barley | 343 | 776 |
| LAB469 | barley\|10v1\|BQ663843 | barley | 344 | 777 |
| LAB470 | barley\|10v1\|BQ762065 | barley | 345 | 778 |
| LAB471 | barley\|10v1\|BQ767166 | barley | 346 | 549 |
| LAB472 | barley\|10v1\|BU977409 | barley | 347 | 779 |
| LAB473 | barley\|10v1\|BY877689 | barley | 348 | 780 |
| LAB474 | barley\|10v1\|CB864695 | barley | 349 | 781 |
| LAB475 | barley\|10v1\|EX571799 | barley | 350 | 782 |
| LAB476 | barley\|10v1\|EX581175 | barley | 351 | 783 |
| LAB477 | barley\|10v1\|FD518903 | barley | 352 | 784 |
| LAB478 | barley\|10v1\|SLX36R1X0820618D1 | barley | 353 | 785 |
| LAB479 | cotton\|10v1barbadense\|AI054922 | cotton | 354 | 786 |
| LAB480 | cotton\|10v1barbadense\|AI055451 | cotton | 355 | 787 |
| LAB481 | cotton\|10v1barbadense\|AI726415 | cotton | 356 | 788 |
| LAB482 | cotton\|10v1barbadense\|AI731918 | cotton | 357 | 560 |
| LAB483 | cotton\|10v1barbadense\|BE052835 | cotton | 358 | 789 |
| LAB484 | cotton\|10v1barbadense\|BF270722 | cotton | 359 | 790 |
| LAB485 | cotton\|10v1barbadense\|BF274343 | cotton | 360 | 563 |
| LAB486 | cotton\|10v1barbadense\|BG441107 | cotton | 361 | 791 |
| LAB487 | cotton\|10v1barbadense\|CA992786 | cotton | 362 | 792 |
| LAB488 | cotton\|10v1barbadense\|CA992877 | cotton | 363 | 793 |
| LAB489 | cotton\|10v1barbadense\|CO069548 | cotton | 364 | 794 |
| LAB490 | cotton\|10v1barbadense\|CO069691 | cotton | 365 | 795 |
| LAB491 | cotton\|10v1barbadense\|CO121378 | cotton | 366 | 796 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB492 | cotton\|10v1barbadense\|CO126747 | cotton | 367 | 797 |
| LAB493 | cotton\|10v1barbadense\|DT047583 | cotton | 368 | 798 |
| LAB494 | cotton\|10v1barbadense\|DT468931 | cotton | 369 | 799 |
| LAB495 | cotton\|10v1barbadense\|DW478051 | cotton | 370 | 800 |
| LAB496 | cotton\|10v1\|BG447066 | cotton | 371 | 801 |
| LAB498 | cotton\|10v1\|AY857933 | cotton | 372 | 802 |
| LAB499 | cotton\|10v2barbadense\|BG446626 | cotton | 373 | 803 |
| LAB500 | cotton\|10v2barbadense\|CO104113 | cotton | 374 | 804 |
| LAB501 | cotton\|10v2barbadense\|DN800269 | cotton | 375 | 805 |
| LAB502 | cotton\|10v2barbadense\|ES794842 | cotton | 376 | 806 |
| LAB503 | maize\|10v1\|AI491334 | maize | 377 | 807 |
| LAB504 | maize\|10v1\|AI612362 | maize | 378 | 581 |
| LAB505 | maize\|10v1\|AI855243 | maize | 379 | 582 |
| LAB506 | maize\|10v1\|AI861715 | maize | 380 | 583 |
| LAB507 | maize\|10v1\|AI948235 | maize | 381 | 584 |
| LAB508 | maize\|10v1\|AW129802 | maize | 382 | 585 |
| LAB509 | maize\|10v1\|AW258131 | maize | 383 | 586 |
| LAB510 | maize\|10v1\|BE051059 | maize | 384 | 808 |
| LAB511 | maize\|10v1\|BG349450 | maize | 385 | 809 |
| LAB512 | maize\|10v1\|BI478654 | maize | 386 | 810 |
| LAB513 | maize\|10v1\|BM381514 | maize | 387 | 590 |
| LAB516 | rice\|gb170\|OS01G47540 | rice | 388 | 591 |
| LAB517 | rice\|gb170\|OS01G68290 | rice | 389 | 811 |
| LAB518 | rice\|gb170\|OS02G30910 | rice | 390 | 593 |
| LAB519 | rice\|gb170\|OS03G02050 | rice | 391 | 594 |
| LAB521 | rice\|gb170\|OS03G16170 | rice | 392 | 595 |
| LAB522 | rice\|gb170\|OS03G19290 | rice | 393 | 596 |
| LAB523 | rice\|gb170\|OS04G49980 | rice | 394 | 597 |
| LAB524 | rice\|gb170\|OS04G58090 | rice | 395 | 598 |
| LAB526 | rice\|gb170\|OS05G47730 | rice | 396 | 599 |
| LAB527 | rice\|gb170\|OS06G05470 | rice | 397 | 600 |
| LAB529 | rice\|gb170\|OS07G46280 | rice | 398 | 601 |
| LAB530 | rice\|gb170\|OS07G49270 | rice | 399 | 602 |
| LAB531 | rice\|gb170\|OS08G23870 | rice | 400 | 603 |
| LAB533 | rice\|gb170\|OS11G10590 | rice | 401 | 812 |
| LAB534 | rice\|gb170\|OS11G26790 | rice | 402 | 605 |
| LAB535 | rice\|gb170\|OS12G05210 | rice | 403 | 606 |
| LAB536 | rice\|gb170\|OS12G32610 | rice | 404 | 813 |
| LAB537 | sorghum\|09v1\|SB01G008750 | sorghum | 405 | 814 |
| LAB538 | sorghum\|09v1\|SB01G019140 | sorghum | 406 | 609 |
| LAB539 | sorghum\|09v1\|SB01G019710 | sorghum | 407 | 610 |
| LAB540 | sorghum\|09v1\|SB01G030340 | sorghum | 408 | 611 |
| LAB541 | sorghum\|09v1\|SB01G031950 | sorghum | 409 | 612 |
| LAB542 | sorghum\|09v1\|SB01G032370 | sorghum | 410 | 815 |
| LAB543 | sorghum\|09v1\|SB01G033700 | sorghum | 411 | 816 |
| LAB544 | sorghum\|09v1\|SB01G035240 | sorghum | 412 | 615 |
| LAB545 | sorghum\|09v1\|SB01G036700 | sorghum | 413 | 616 |
| LAB546 | sorghum\|09v1\|SB01G039830 | sorghum | 414 | 617 |
| LAB547 | sorghum\|09v1\|SB01G039890 | sorghum | 415 | 618 |
| LAB548 | sorghum\|09v1\|SB01G042110 | sorghum | 416 | 619 |
| LAB549 | sorghum\|09v1\|SB01G047615 | sorghum | 417 | 817 |
| LAB550 | sorghum\|09v1\|SB01G049830 | sorghum | 418 | 818 |
| LAB551 | sorghum\|09v1\|SB02G012470 | sorghum | 419 | 622 |
| LAB552 | sorghum\|09v1\|SB02G024240 | sorghum | 420 | 623 |
| LAB553 | sorghum\|09v1\|SB02G025910 | sorghum | 421 | 819 |
| LAB554 | sorghum\|09v1\|SB02G027340 | sorghum | 422 | 820 |
| LAB555 | sorghum\|09v1\|SB02G035950 | sorghum | 423 | 626 |
| LAB557 | sorghum\|09v1\|SB02G041880 | sorghum | 424 | 627 |
| LAB558 | sorghum\|09v1\|SB03G001350 | sorghum | 425 | 628 |
| LAB559 | sorghum\|09v1\|SB03G002080 | sorghum | 426 | 821 |
| LAB561 | sorghum\|09v1\|SB03G010430 | sorghum | 427 | 822 |
| LAB562 | sorghum\|09v1\|SB03G012950 | sorghum | 428 | 631 |
| LAB563 | sorghum\|09v1\|SB03G027020 | sorghum | 429 | 632 |
| LAB564 | sorghum\|09v1\|SB03G027320 | sorghum | 430 | 823 |
| LAB565 | sorghum\|09v1\|SB03G037550 | sorghum | 431 | 634 |
| LAB566 | sorghum\|09v1\|SB03G039630 | sorghum | 432 | 635 |
| LAB567 | sorghum\|09v1\|SB03G044260 | sorghum | 433 | 824 |
| LAB568 | sorghum\|09v1\|SB0498S002010 | sorghum | 434 | 637 |
| LAB569 | sorghum\|09v1\|SB04G021920 | sorghum | 435 | 638 |
| LAB570 | sorghum\|09v1\|SB04G031810 | sorghum | 436 | 639 |
| LAB571 | sorghum\|09v1\|SB04G032250 | sorghum | 437 | 825 |
| LAB572 | sorghum\|09v1\|SB04G033380 | sorghum | 438 | 826 |
| LAB573 | sorghum\|09v1\|SB04G035130 | sorghum | 439 | 827 |

TABLE 70-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB575 | sorghum\|09v1\|SB05G023510 | sorghum | 440 | 828 |
| LAB576 | sorghum\|09v1\|SB05G027350 | sorghum | 441 | 644 |
| LAB577 | sorghum\|09v1\|SB06G000550 | sorghum | 442 | 645 |
| LAB578 | sorghum\|09v1\|SB06G018800 | sorghum | 443 | 646 |
| LAB581 | sorghum\|09v1\|SB07G003130 | sorghum | 444 | 647 |
| LAB582 | sorghum\|09v1\|SB07G007030 | sorghum | 445 | 829 |
| LAB584 | sorghum\|09v1\|SB07G029230 | sorghum | 446 | 649 |
| LAB585 | sorghum\|09v1\|SB08G005220 | sorghum | 447 | 650 |
| LAB586 | sorghum\|09v1\|SB08G014065 | sorghum | 448 | 651 |
| LAB587 | sorghum\|09v1\|SB09G006050 | sorghum | 449 | 652 |
| LAB588 | sorghum\|09v1\|SB09G020120 | sorghum | 450 | 653 |
| LAB589 | sorghum\|09v1\|SB09G026410 | sorghum | 451 | 654 |
| LAB590 | sorghum\|09v1\|SB09G027600 | sorghum | 452 | 655 |
| LAB591 | sorghum\|09v1\|SB09G029080 | sorghum | 453 | 656 |
| LAB592 | sorghum\|09v1\|SB10G001440 | sorghum | 454 | 830 |
| LAB593 | sorghum\|09v1\|SB10G006140 | sorghum | 455 | 831 |
| LAB594 | sorghum\|09v1\|SB10G009200 | sorghum | 456 | 659 |
| LAB595 | sorghum\|09v1\|SB10G024850 | sorghum | 457 | 832 |
| LAB596 | sorghum\|09v1\|SB10G025730 | sorghum | 458 | 661 |
| LAB597 | sorghum\|09v1\|SB10G029590 | sorghum | 459 | 833 |
| LAB598 | sunflower\|10v1\|AF030301 | sunflower | 460 | 733 |
| LAB600 | sunflower\|10v1\|GE522049 | sunflower | 461 | 665 |
| LAB601 | sunflower\|10v1\|SFSLX00081847D2 | sunflower | 462 | 834 |
| LAB602 | sunflower\|gb162\|CD847580 | sunflower | 463 | 667 |
| LAB603 | tomato\|09v1\|TOMTRALTBD | tomato | 464 | 668 |
| LAB604 | cotton\|10v1barbadense\|BE053925 | cotton | 465 | 669 |
| LAB605 | barley\|10v1\|BE196034 | barley | 466 | 670 |
| LAB607 | rice\|gb170\|OS04G49550 | rice | 467 | 671 |
| LAB608 | sorghum\|09v1\|SB01G040580 | sorghum | 468 | 672 |
| LAB609 | maize\|10v1\|MZEADH1 | maize | 469 | 673 |
| LAB610 | sorghum\|09v1\|SB03G001100 | sorghum | 470 | 674 |
| LAB611 | sorghum\|09v1\|SB03G035000 | sorghum | 471 | 675 |
| LAB612 | cotton\|10v2barbadense\|AI055252 | cotton | 472 | 835 |
| LAB403 | barley\|10v1\|AV929051 | barley | 473 | — |

Table 70.
Provided are the identified genes which expression thereof in plants increases abiotic stress tolerance, water use efficiency, yield, growth rate, vigor, biomass, growth rate, oil content, fiber yield, fiber quality, nitrogen use efficiency and fertilizer use efficiency of a plant.
"Polynucl."—polynucleotide;
"Polypep."—polypeptide.

Example 13

Identification of Homologues which Affect ABST, WUE, Yield, Growth Rate, Vigor, Biomass, Oil Content, Fiber Yield, Fiber Quality, NUE and/or FUE of a Plant The concepts of orthology and paralogy have recently been applied to functional characterizations and classifications on the scale of whole-genome comparisons. Orthologs and paralogs constitute two major types of homologs: The first evolved from to a common ancestor by specialization, and the latter are related by duplication events. It is assumed that paralogs arising from ancient duplication events are likely to have diverged in function while true orthologs are more likely to retain identical function over evolutionary time.

To further investigate and identify putative ortholog genes of the genes affecting ABST, WUE, yield (e.g., seed yield, oil yield, biomass, grain quantity and/or quality, fiber yield and/or quality), oil content, growth rate, vigor, NUE and FUE (presented in Table 70, Example 12 above), all sequences were aligned using the BLAST (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing to construct a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Methods for searching and identifying homologues of yield and improved agronomic traits such as ABS tolerance and FUE related polypeptides or polynucleotides are well within the realm of the skilled artisan. The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology is preferably carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes and polypeptides described in Table 70 above have been identified from the databases using BLAST software using the Blastp and tBlastn algorithms. The query nucleotide and polypeptide sequences are described in Table 70 above (polynucleotide to SEQ ID NOs: 1-275 (core polynucleotides), and SEQ ID NOs: 204-473 (cloned polynucleotides); polypeptide SEQ ID NOs: 474-835) and the identified homologues are provided in Table 71, below.

TABLE 71

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Poly n. SEQ ID NO: | Hom. to Gene Name | Cluster name | Poly p. SEQ ID NO: | Hom. to SEQ ID NO: | % Glob. identity | Algor. |
|---|---|---|---|---|---|---|
| 131 | LAB533 | brachypodium\|09v1\|TMPLOS11G10590T1_P1 | 604 | 604 | 100 | globlastp |
| 836 | LAB390 | tobacco\|gb162\|AM820662_P1 | 4178 | 474 | 81.2 | globlastp |
| 837 | LAB394 | sugarcane\|10v1\|AY093816_P1 | 4179 | 477 | 98.4 | globlastp |
| 838 | LAB394 | sugarcane\|10v1\|AY093815_P1 | 4180 | 477 | 94.5 | globlastp |
| 839 | LAB394 | maize\|10v1\|DN207920_P1 | 4181 | 477 | 88.3 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 840 | LAB394 | switchgrass\|gb167\|FE619223_P1 | 4182 | 477 | 87.2 | globlastp |
| 841 | LAB394 | foxtail_millet\|10v2\|SICRP032710_P1 | 4183 | 477 | 85.7 | globlastp |
| 842 | LAB394 | switchgrass\|gb167\|FL735166_P1 | 4184 | 477 | 85.7 | globlastp |
| 843 | LAB394 | maize\|10v1\|AW563002_P1 | 4185 | 477 | 85.3 | globlastp |
| 844 | LAB396 | solanum_phureja\|009v1\|SPHAJ001310 | 4186 | 479 | 97.8 | globlastp |
| 845 | LAB396 | potato\|10v1\|AJ001310_P1 | 4187 | 479 | 94.1 | globlastp |
| 846 | LAB396 | tobacco\|gb162\|EB425890 | 4188 | 479 | 88.9 | globlastp |
| 847 | LAB396 | petunia\|gb171\|FN012365_P1 | 4189 | 479 | 87.4 | globlastp |
| 848 | LAB398 | solanum_phureja\|09v1\|SPHAW038321 | 4190 | 481 | 92.5 | globlastp |
| 849 | LAB398 | potato\|10v1\|BQ519384_P1 | 4191 | 481 | 86.2 | globlastp |
| 850 | LAB398 | solanum_phureja\|09v1\|SPHBG631843 | 4192 | 481 | 81.9 | globlastp |
| 851 | LAB399 | solanum_phureja\|09v1\|SPHBG134139 | 4193 | 482 | 92.4 | globlastp |
| 852 | LAB400 | potato\|10v1\|BM404509_P1 | 4194 | 483 | 94.5 | globlastp |
| 853 | LAB400 | solanum_phureja\|09v1\|SPHBG134340 | 4194 | 483 | 94.5 | globlastp |
| 854 | LAB400 | eggplant\|10v1\|FS008838_P1 | 4195 | 483 | 87.2 | globlastp |
| 855 | LAB400 | pepper\|gb171\|BM061988_P1 | 4196 | 483 | 84.3 | globlastp |
| 856 | LAB401 | solanum_phureja\|09v1\|SPHB1406598 | 4197 | 484 | 88 | globlastp |
| 857 | LAB401 | potato\|10v1\|BI406598_P1 | 4198 | 484 | 87.2 | globlastp |
| 858 | LAB405 | pseudoroegneria\|gb167\|FF363334 | 4199 | 487 | 90.7 | globlastp |
| 859 | LAB405 | fescue\|gb161\|DT680373_P1 | 4200 | 487 | 82.9 | globlastp |
| 860 | LAB406 | cotton\|10v1\|DW509291 | 4201 | 488 | 89.3 | globlastp |
| 861 | LAB407 | arnica\|11v1\|SRR099034X137832_P1 | 4202 | 489 | 93.5 | globlastp |
| 862 | LAB407 | artemisia\|10v1\|EY064587_P1 | 4203 | 489 | 92.4 | globlastp |
| 863 | LAB407 | sunflower\|10v1\|DY909374 | 4204 | 489 | 90.6 | globlastp |
| 864 | LAB407 | parthenium\|10v1\|GW780300_P1 | 4205 | 489 | 90 | globlastp |
| 865 | LAB407 | cynara\|gb167\|GE589287_P1 | 4206 | 489 | 89.4 | globlastp |
| 866 | LAB407 | safflower\|gb162\|EL372873 | 4207 | 489 | 89 | globlastp |
| 867 | LAB407 | cichorium\|gb171\|EH692326_P1 | 4208 | 489 | 88.4 | globlastp |
| 868 | LAB407 | arnica\|11v1\|SRR099034X1122_T1 | 4209 | 489 | 88.24 | glotblastn |
| 869 | LAB407 | centaurea\|gb166\|EH790067_P1 | 4210 | 489 | 87.8 | globlastp |
| 870 | LAB407 | dandelion\|10v1\|DR400124_P1 | 4211 | 489 | 87.3 | globlastp |
| 871 | LAB407 | lettuce\|10v1\|DW046418_P1 | 4212 | 489 | 85.5 | globlastp |
| 872 | LAB407 | cacao\|10v1\|CU481075_P1 | 4213 | 489 | 82.4 | globlastp |
| 873 | LAB407 | cacao\|gb167\|CU481075 | 4213 | 489 | 82.4 | globlastp |
| 874 | LAB407 | castorbean\|09v1\|EE254974_P1 | 4214 | 489 | 82 | globlastp |
| 875 | LAB407 | spurge\|gb161\|DV113524 | 4215 | 489 | 81.9 | globlastp |
| 876 | LAB407 | gerbera\|09v1\|AJ750040_P1 | 4216 | 489 | 81.3 | globlastp |
| 877 | LAB407 | cotton\|10v1\|AI727555 | 4217 | 489 | 80.6 | globlastp |
| 878 | LAB407 | cotton\|10v2\|SRR032367S0127841_P1 | 4217 | 489 | 80.6 | globlastp |
| 879 | LAB407 | liquorice\|gb171\|FS240259_P1 | 4218 | 489 | 80.1 | globlastp |
| 880 | LAB407 | strawberry\|11v1\|CO378695_P1 | 4219 | 489 | 80.1 | globlastp |
| 881 | LAB407 | strawberry\|gb164\|CO380926 | 4219 | 489 | 80.1 | globlastp |
| 882 | LAB407 | prunus\|10v1\|BU572894 | 4220 | 489 | 80 | glotblastn |
| 883 | LAB409 | potato\|10v1\|AY356245_P1 | 4221 | 491 | 85.9 | globlastp |
| 884 | LAB409 | solanum_phureja\|09v1\|SPHBG129458 | 4221 | 491 | 85.9 | globlastp |
| 885 | LAB410 | wheat\|10v2\|CK217348_P1 | 4222 | 492 | 98.6 | globlastp |
| 886 | LAB410 | wheat\|gb164\|BE399512 | 4222 | 492 | 98.6 | globlastp |
| 887 | LAB410 | wheat\|gb164\|BM134653 | 4222 | 492 | 98.6 | globlastp |
| 888 | LAB410 | wheat\|10v2\|BE399512_P1 | 4222 | 492 | 98.6 | globlastp |
| 889 | LAB410 | oat\|10v2\|CN819700_P1 | 4223 | 492 | 90 | globlastp |
| 890 | LAB410 | brachypodium\|09v1\|GT784255_P1 | 4224 | 492 | 84.3 | globlastp |
| 891 | LAB410 | rice\|gb170\|OS07G38600 | 4225 | 492 | 81.4 | globlastp |
| 892 | LAB410 | sugarcane\|10v1\|CA150101 | 4226 | 492 | 81.4 | globlastp |
| 893 | LAB410 | clementine\|11v1\|CF419072_P1 | 4227 | 492 | 80 | globlastp |
| 894 | LAB410 | orange\|11v1\|CF419072_P1 | 4227 | 492 | 80 | globlastp |
| 895 | LAB410 | citrus\|gb166\|CF419072_P1 | 4228 | 492 | 80 | globlastp |
| 896 | LAB410 | citrus\|gb166\|CK665241_P1 | 4227 | 492 | 80 | globlastp |
| 897 | LAB410 | cynodon\|10v1\|ES300655_T1 | 4229 | 492 | 80 | glotblastn |
| 898 | LAB410 | rice\|gb170\|OS05G10980 | 4230 | 492 | 80 | globlastp |
| 899 | LAB410 | switchgrass\|gb167\|FE604373 | 4231 | 492 | 80 | globlastp |
| 900 | LAB410 | switchgrass\|gb167\|FL730541 | 4231 | 492 | 80 | globlastp |
| 901 | LAB410 | switchgrass\|gb167\|FL793561 | 4231 | 492 | 80 | globlastp |
| 902 | LAB415 | brachypodium\|09v1\|SRR031796S0027761_P1 | 4232 | 495 | 86.3 | globlastp |
| 902 | LAB561 | brachypodium\|09v1\|SRR031796S0027761_P1 | 4232 | 822 | 82.8 | globlastp |
| 903 | LAB415 | rice\|gb170\|OS12G43120 | 4233 | 495 | 81.5 | globlastp |
| 903 | LAB561 | rice\|gb170\|OS12G43120 | 4233 | 822 | 80.8 | globlastp |
| 904 | LAB417 | brachypodium\|09v1\|DV476368_P1 | 4234 | 496 | 87 | globlastp |
| 905 | LAB417 | rice\|gb170\|OS05G31480 | 4235 | 496 | 81.9 | globlastp |
| 906 | LAB417 | sorghum\|09v1\|SB09G018820 | 4236 | 496 | 81.5 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 907 | LAB417 | maize\|10v1\|AW282392_P1 | 4237 | 496 | 81.2 | globlastp |
| 908 | LAB417 | millet\|10v1\|EVO454PM008887_P1 | 4238 | 496 | 80.1 | globlastp |
| 909 | LAB421 | brachypodium\|09v1\|DV482180_T1 | 4239 | 500 | 98.79 | glotblastn |
| 910 | LAB421 | barley\|10v2\|BF254090_T1 | 4240 | 500 | 97.78 | glotblastn |
| 911 | LAB421 | barley\|10v1\|BF254090 | 4241 | 500 | 97.78 | glotblastn |
| 912 | LAB421 | wheat\|gb164\|BE419274 | 4242 | 500 | 97.78 | glotblastn |
| 913 | LAB421 | wheat\|10v2\|BE415063_T1 | 4243 | 500 | 97.58 | glotblastn |
| 914 | LAB421 | oat\|10v2\|CN814770_P1 | 4244 | 500 | 97.4 | globlastp |
| 915 | LAB421 | switchgrass\|gb167\|DN151545 | 4245 | 500 | 96.98 | glotblastn |
| 916 | LAB421 | foxtail_millet\|10v2\|SICRP005057_T1 | 4246 | 500 | 96.77 | glotblastn |
| 917 | LAB421 | rice\|gb170\|OS05G07050 | 4247 | 500 | 96.77 | glotblastn |
| 918 | LAB421 | rice\|gb170\|OS06G07080 | 4248 | 500 | 96.77 | glotblastn |
| 919 | LAB421 | sorghum\|09v1\|SB10G004680 | 4249 | 500 | 96.57 | glotblastn |
| 920 | LAB421 | sugarcane\|10v1\|BU102943 | 4250 | 500 | 96.57 | glotblastn |
| 921 | LAB421 | maize\|10v1\|AI461525_T1 | 4251 | 500 | 96.37 | glotblastn |
| 922 | LAB421 | maize\|10v1\|AI586541_T1 | 4252 | 500 | 96.37 | glotblastn |
| 923 | LAB421 | millet\|10v1\|CD724387_T1 | 4253 | 500 | 95.36 | glotblastn |
| 924 | LAB421 | tabernaemontana\|11v1\|SRR098689X100540_T1 | 4254 | 500 | 91.13 | glotblastn |
| 925 | LAB421 | chestnut\|gb170\|SRR006295S0000735_T1 | 4255 | 500 | 90.95 | glotblastn |
| 926 | LAB421 | clementine\|11v1\|CB417409_T1 | 4256 | 500 | 90.93 | glotblastn |
| 927 | LAB421 | orange\|11v1\|CB417409_T1 | 4257 | 500 | 90.93 | glotblastn |
| 928 | LAB421 | cassava\|09v1\|JGICASSAVA8343VALIDM1_T1 | 4258 | 500 | 90.93 | glotblastn |
| 929 | LAB421 | oak\|10v1\|FP043555_T1 | 4259 | 500 | 90.74 | glotblastn |
| 930 | LAB421 | cacao\|10v1\|CF973003_T1 | 4260 | 500 | 90.73 | glotblastn |
| 931 | LAB421 | podocarpus\|10v1\|SRR065014S0002586_T1 | 4261 | 500 | 90.73 | glotblastn |
| 932 | LAB421 | artemisia\|10v1\|EY044009_T1 | 4262 | 500 | 90.73 | glotblastn |
| 933 | LAB421 | castorbean\|09v1\|EG661695_T1 | 4263 | 500 | 90.73 | glotblastn |
| 934 | LAB421 | cotton\|10v1\|BG441446 | 4264 | 500 | 90.73 | glotblastn |
| 935 | LAB421 | cucumber\|09v1\|CO997690_T1 | 4265 | 500 | 90.73 | glotblastn |
| 936 | LAB421 | grape\|gb160\|CB346776_T1 | 4266 | 500 | 90.73 | glotblastn |
| 937 | LAB421 | tabernaemontana\|11v1\|SRR098689X108007_T1 | 4267 | 500 | 90.52 | glotblastn |
| 938 | LAB421 | taxus\|10v1\|SRR03252350016046_T1 | 4268 | 500 | 90.52 | glotblastn |
| 939 | LAB421 | cotton\|10v2\|BG441446_T1 | 4269 | 500 | 90.52 | glotblastn |
| 940 | LAB421 | poplar\|10v1\|BI138432_T1 | 4270 | 500 | 90.52 | glotblastn |
| 941 | LAB421 | abies\|11v2\|SRR098676X100277_T1 | 4271 | 500 | 90.32 | glotblastn |
| 942 | LAB421 | cephalotaxus\|11v1\|SRR064395X103007_T1 | 4272 | 500 | 90.32 | glotblastn |
| 943 | LAB421 | cotton\|10v2\|BM360520_T1 | 4273 | 500 | 90.32 | glotblastn |
| 944 | LAB421 | distylium\|11v1\|SRR065077X106878_T1 | 4274 | 500 | 90.32 | glotblastn |
| 945 | LAB421 | eucalyptus\|11v2\|CU397726_T1 | 4275 | 500 | 90.32 | glotblastn |
| 946 | LAB421 | pseudotsuga\|10v1\|SRR065119S0009681_T1 | 4276 | 500 | 90.32 | glotblastn |
| 947 | LAB421 | sciadopitys\|10v1\|SRR065035S0003810_T1 | 4277 | 500 | 90.32 | glotblastn |
| 948 | LAB421 | cotton\|10v1\|BE054726 | 4278 | 500 | 90.32 | glotblastn |
| 949 | LAB421 | aristolochia\|10v1\|FD757638_T1 | 4279 | 500 | 90.12 | glotblastn |
| 950 | LAB421 | arnica\|11v1\|SRR099034X103171_T1 | 4280 | 500 | 90.12 | glotblastn |
| 951 | LAB421 | pine\|10v2\|AW698074_T1 | 4281 | 500 | 90.12 | glotblastn |
| 952 | LAB421 | vinca\|11v1\|SRR098690X100651_T1 | 4282 | 500 | 90.12 | glotblastn |
| 953 | LAB421 | vinca\|11v1\|SRR098690X102229_T1 | 4283 | 500 | 90.12 | glotblastn |
| 954 | LAB421 | cotton\|10v2\|SRR032368S0465084_T1 | 4284 | 500 | 90.12 | glotblastn |
| 955 | LAB421 | medicago\|09v1\|AL376386_T1 | 4285 | 500 | 89.94 | glotblastn |
| 956 | LAB421 | amsonia\|11v1\|SRR098688X104187_T1 | 4286 | 500 | 89.92 | glotblastn |
| 957 | LAB421 | euphorbia\|11v1\|DV113292_T1 | 4287 | 500 | 89.92 | glotblastn |
| 958 | LAB421 | maritime_pine\|10v1\|BX678428_T1 | 4288 | 500 | 89.92 | glotblastn |
| 959 | LAB421 | kiwi\|gb166\|FG400650_T1 | 4289 | 500 | 89.92 | glotblastn |
| 960 | LAB421 | soybean\|11v1\|GLYMA15G00980_T1 | 4290 | 500 | 89.74 | globlastp |
| 961 | LAB421 | soybean\|gb168\|AL382640 | 4291 | 500 | 89.74 | glotblastn |
| 962 | LAB421 | tripterygium\|11v1\|SRR098677X103246_T1 | 4292 | 500 | 89.72 | glotblastn |
| 963 | LAB421 | lotus\|09v1\|CB827365_T1 | 4293 | 500 | 89.56 | glotblastn |
| 964 | LAB421 | soybean\|11v1\|GLYMA13G44290_T1 | 4294 | 500 | 89.54 | glotblastn |
| 965 | LAB421 | soybean\|gb168\|AW736471 | 4295 | 500 | 89.54 | glotblastn |
| 966 | LAB421 | chelidonium\|11v1\|SRR084752X101365_T1 | 4296 | 500 | 89.52 | glotblastn |
| 967 | LAB421 | euonymus\|11v1\|SRR070038X108321_T1 | 4297 | 500 | 89.52 | glotblastn |
| 968 | LAB421 | apple\|11v1\|CN866479_T1 | 4298 | 500 | 89.52 | glotblastn |
| 969 | LAB421 | apple\|gb171\|CN866479 | 4299 | 500 | 89.52 | glotblastn |
| 970 | LAB421 | cassava\|09v1\|AI253960_T1 | 4300 | 500 | 89.52 | glotblastn |
| 971 | LAB421 | gnetum\|10v1\|SRR064399S0016974_T1 | 4301 | 500 | 89.31 | glotblastn |
| 972 | LAB421 | zostera\|10v1\|SRR057351S0015784_T1 | 4302 | 500 | 89.31 | glotblastn |
| 973 | LAB421 | prunus\|10v1\|BU041820 | 4303 | 500 | 89.31 | glotblastn |
| 974 | LAB421 | tomato\|09v1\|BG124884 | 4304 | 500 | 89.31 | glotblastn |
| 975 | LAB421 | tomato\|10v1\|BG124884_T1 | 4305 | 500 | 89.31 | glotblastn |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 976 | LAB421 | potato\|10v1\|BF054229_T1 | 4306 | 500 | 89.11 | glotblastn |
| 977 | LAB421 | spikemoss\|gb165\|DN838555 | 4307 | 500 | 89.11 | glotblastn |
| 978 | LAB421 | ceratodon\|10v1\|SRR074890S0026445_T1 | 4308 | 500 | 88.91 | glotblastn |
| 979 | LAB421 | strawberry\|11v1\|DV440517_T1 | 4309 | 500 | 88.91 | glotblastn |
| 980 | LAB421 | solanum_phureja\|09v1\|SPHAI773279 | 4310 | 500 | 88.91 | glotblastn |
| 981 | LAB421 | trigonella\|11v1\|SRR066194X129587_T1 | 4311 | 500 | 88.73 | glotblastn |
| 982 | LAB421 | eucalyptus\|11v2\|CT982504_T1 | 4312 | 500 | 88.71 | glotblastn |
| 983 | LAB421 | physcomitrella\|10v1\|BQ827451_T1 | 4313 | 500 | 88.71 | glotblastn |
| 984 | LAB421 | physcomitrella\|10v1\|FC334960_T1 | 4314 | 500 | 88.71 | glotblastn |
| 985 | LAB421 | medicago\|09v1\|BI310942_T1 | 4315 | 500 | 88.53 | glotblastn |
| 986 | LAB421 | aquilegia\|10v2\|DT735457_T1 | 4316 | 500 | 88.31 | glotblastn |
| 987 | LAB421 | monkeyflower\|10v1\|CV521537_T1 | 4317 | 500 | 88.31 | glotblastn |
| 988 | LAB421 | arabidopsis\|10v1\|AT1G80070_T1 | 4318 | 500 | 88.1 | glotblastn |
| 989 | LAB421 | triphysaria\|10v1\|EX995803 | 4319 | 500 | 88.1 | glotblastn |
| 990 | LAB421 | arabidopsis_lyrata\|09v1\|JGIAL008354_T1 | 4320 | 500 | 87.9 | glotblastn |
| 991 | LAB421 | sequoia\|10v1\|SRR065044S0036452_T1 | 4321 | 500 | 87.7 | glotblastn |
| 992 | LAB421 | radish\|gb164\|EV536842 | 4322 | 500 | 86.69 | glotblastn |
| 993 | LAB421 | plantago\|11v1\|SRR066373X209132_T1 | 4323 | 500 | 86.49 | glotblastn |
| 994 | LAB421 | silene\|11v1\|SRR096785X108103_T1 | 4324 | 500 | 86.09 | glotblastn |
| 995 | LAB421 | arabidopsis_lyrata\|09v1\|JGIAL023955_T1 | 4325 | 500 | 85.51 | glotblastn |
| 996 | LAB421 | citrus\|gb166\|CB417429_P1 | 4326 | 500 | 85.3 | globlastp |
| 997 | LAB421 | fagopyrum\|11v1\|SRR063689X135908_T1 | 4327 | 500 | 84.68 | glotblastn |
| 998 | LAB421 | sunflower\|10v1\|CD853108 | 4328 | 500 | 84.5 | globlastp |
| 999 | LAB421 | nasturtium\|10v1\|SRR032558S0004676_P1 | 4329 | 500 | 84.3 | globlastp |
| 1000 | LAB421 | arabidopsis\|10v1\|AT4G38780_T1 | 4330 | 500 | 83.3 | glotblastn |
| 1001 | LAB421 | orobanche\|10v1\|SRR023189S0000062_P1 | 4331 | 500 | 81.9 | globlastp |
| 1002 | LAB421 | arabidopsis_lyrata\|09v1\|JGIAL026730_T1 | 4332 | 500 | 81.29 | glotblastn |
| 1003 | LAB421 | pteridium\|11v1\|SRR043594X136790_T1 | 4333 | 500 | 80.85 | glotblastn |
| 1004 | LAB421 | wheat\|10v2\|BE419274_P1 | 4334 | 500 | 80.8 | globlastp |
| 1005 | LAB422 | wheat\|10v2\|BE407000_P1 | 4335 | 501 | 99.6 | globlastp |
| 1006 | LAB422 | wheat\|gb164\|BQ162660 | 4335 | 501 | 99.6 | globlastp |
| 1007 | LAB422 | leymus\|gb166\|EG396351_P1 | 4336 | 501 | 98.9 | globlastp |
| 1008 | LAB422 | brachypodium\|09v1\|DV470327_P1 | 4337 | 501 | 94.3 | globlastp |
| 1009 | LAB422 | rice\|gb170\|OS08G02360 | 4338 | 501 | 91.3 | globlastp |
| 1010 | LAB422 | rice\|gb170\|OS03G62720 | 4339 | 501 | 91.2 | globlastp |
| 1011 | LAB422 | foxtail_millet\|10v2\|FXTRMSLX04846314D1_P1 | 4340 | 501 | 89.3 | globlastp |
| 1012 | LAB422 | switchgrass\|gb167\|FE606414 | 4341 | 501 | 88.5 | globlastp |
| 1013 | LAB422 | maize\|10v1\|AI920401_P1 | 4342 | 501 | 87 | globlastp |
| 1014 | LAB422 | sorghum\|09v1\|SB02G040250 | 4343 | 501 | 86.6 | globlastp |
| 1015 | LAB423 | wheat\|10v2\|BE402481_P1 | 4344 | 502 | 83.8 | globlastp |
| 1016 | LAB423 | wheat\|gb164\|BE402481 | 4344 | 502 | 83.8 | globlastp |
| 1017 | LAB423 | wheat\|gb164\|BE497978 | 4345 | 502 | 83.33 | glotblastn |
| 1018 | LAB423 | wheat\|10v2\|CA608820_P1 | 4346 | 502 | 81.4 | globlastp |
| 1019 | LAB423 | wheat\|gb164\|CA608820 | 4347 | 502 | 81.37 | glotblastn |
| 1020 | LAB425 | wheat\|10v2\|BF429218_P1 | 4348 | 504 | 96.6 | globlastp |
| 1021 | LAB425 | wheat\|gb164\|BF429218 | 4348 | 504 | 96.6 | globlastp |
| 1022 | LAB425 | leymus\|gb166\|EG377728_P1 | 4349 | 504 | 96.1 | globlastp |
| 1023 | LAB425 | wheat\|gb164\|BE402540 | 4350 | 504 | 96.1 | globlastp |
| 1024 | LAB425 | wheat\|10v2\|BE402540_P1 | 4350 | 504 | 96.1 | globlastp |
| 1025 | LAB425 | oat\|10v2\|GO595780_P1 | 4351 | 504 | 95.6 | globlastp |
| 1026 | LAB425 | oat\|10v2\|GO596287_P1 | 4352 | 504 | 95.6 | globlastp |
| 1027 | LAB425 | wheat\|gb164\|BF483423 | 4353 | 504 | 95.6 | globlastp |
| 1028 | LAB425 | brachypodium\|09v1\|DV487841_P1 | 4354 | 504 | 94.1 | globlastp |
| 1029 | LAB425 | foxtail_millet\|10v2\|FXTRMSLX00299188D1_P1 | 4355 | 504 | 91.6 | globlastp |
| 1030 | LAB425 | millet\|10v1\|EVO454PM001705_P1 | 4356 | 504 | 91.1 | globlastp |
| 1031 | LAB425 | rice\|gb170\|OS06G06410 | 4357 | 504 | 91.1 | globlastp |
| 1032 | LAB425 | maize\|10v1\|AI901976_P1 | 4358 | 504 | 90.6 | globlastp |
| 1033 | LAB425 | maize\|10v1\|AI920322_P1 | 4359 | 504 | 90.6 | globlastp |
| 1034 | LAB425 | maize\|10v1\|AI941801_P1 | 4360 | 504 | 90.6 | globlastp |
| 1035 | LAB425 | sorghum\|09v1\|SB10G004030 | 4361 | 504 | 90.6 | globlastp |
| 1036 | LAB425 | sugarcane\|10v1\|BQ537272 | 4362 | 504 | 90.1 | globlastp |
| 1037 | LAB425 | cenchrus\|gb166\|EB660001_P1 | 4363 | 504 | 88.2 | globlastp |
| 1038 | LAB425 | switchgrass\|gb167\|FE609708 | 4364 | 504 | 87.2 | globlastp |
| 1039 | LAB425 | oil_palm\|gb166\|EL682137_P1 | 4365 | 504 | 84.7 | globlastp |
| 1040 | LAB425 | abies\|11v2\|SRR098676X210626_P1 | 4366 | 504 | 84.2 | globlastp |
| 1041 | LAB425 | maritime_pine\|10v1\|BX784206_P1 | 4367 | 504 | 84.2 | globlastp |
| 1042 | LAB425 | pine\|10v2\|CX652920_P1 | 4368 | 504 | 84.2 | globlastp |
| 1043 | LAB425 | pine\|10v2\|DR387521_P1 | 4368 | 504 | 84.2 | globlastp |
| 1044 | LAB425 | pseudotsuga\|10v1\|SRR065119S0001013_P1 | 4369 | 504 | 84.2 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1045 | LAB425 | centaurea\|gb166\|EH712515_P1 | 4370 | 504 | 84.2 | globlastp |
| 1046 | LAB425 | pine\|10v1\|BQ635327 | 4368 | 504 | 84.2 | globlastp |
| 1047 | LAB425 | pine\|10v1\|DR387521 | 4368 | 504 | 84.2 | globlastp |
| 1048 | LAB425 | sunflower\|10v1\|AJ828648 | 4371 | 504 | 84.2 | globlastp |
| 1049 | LAB425 | pseudotsuga\|10v1\|SRR065119S0078070_P1 | 4372 | 504 | 83.7 | globlastp |
| 1050 | LAB425 | strawberry\|11v1\|EX683772_P1 | 4373 | 504 | 83.7 | globlastp |
| 1051 | LAB425 | tomato\|10v1\|BE431430_P1 | 4374 | 504 | 83.7 | globlastp |
| 1052 | LAB425 | ipomoea_nil\|10v1\|CJ754611_P1 | 4375 | 504 | 83.7 | globlastp |
| 1053 | LAB425 | pepper\|gb171\|CO906530_P1 | 4376 | 504 | 83.7 | globlastp |
| 1054 | LAB425 | tomato\|09v1\|BE431430 | 4374 | 504 | 83.7 | globlastp |
| 1055 | LAB425 | aristolochia\|10v1\|SRR039082S0320371_P1 | 4377 | 504 | 83.3 | globlastp |
| 1056 | LAB425 | apple\|gb171\|CN496912 | 4378 | 504 | 83.3 | globlastp |
| 1057 | LAB425 | castorbean\|09v1\|EG667258_P1 | 4379 | 504 | 83.3 | globlastp |
| 1058 | LAB425 | castorbean\|09v1\|EG667652_P1 | 4379 | 504 | 83.3 | globlastp |
| 1059 | LAB425 | cowpea\|gb166\|FF382081_P1 | 4380 | 504 | 83.3 | globlastp |
| 1060 | LAB425 | grape\|gb160\|BQ800449_P1 | 4381 | 504 | 83.3 | globlastp |
| 1061 | LAB425 | potato\|10v1\|BE923938_P1 | 4382 | 504 | 83.3 | globlastp |
| 1062 | LAB425 | solanum_phureja\|09v1\|SPHBE431430 | 4382 | 504 | 83.3 | globlastp |
| 1063 | LAB425 | petunia\|gb171\|FN000863_T1 | 4383 | 504 | 83.25 | glotblastn |
| 1064 | LAB425 | cedrus\|11v1\|SRR065007X116729_P1 | 4384 | 504 | 82.8 | globlastp |
| 1065 | LAB425 | cephalotaxus\|11v1\|SRR064395X132743_P1 | 4385 | 504 | 82.8 | globlastp |
| 1066 | LAB425 | clementine\|11v1\|CF507041_P1 | 4386 | 504 | 82.8 | globlastp |
| 1067 | LAB425 | orange\|11v1\|CF507041_P1 | 4386 | 504 | 82.8 | globlastp |
| 1068 | LAB425 | podocarpus\|10v1\|SRR065014S0131164_P1 | 4387 | 504 | 82.8 | globlastp |
| 1069 | LAB425 | sciadopitys\|10v1\|SRR065035S0015023_P1 | 4388 | 504 | 82.8 | globlastp |
| 1070 | LAB425 | taxus\|10v1\|SRR032523S0003511_P1 | 4389 | 504 | 82.8 | globlastp |
| 1071 | LAB425 | aquilegia\|10v1\|DR936227 | 4390 | 504 | 82.8 | globlastp |
| 1072 | LAB425 | aquilegia\|10v2\|DR936227_P1 | 4391 | 504 | 82.8 | globlastp |
| 1073 | LAB425 | banana\|10v1\|BBS2586T3_P1 | 4392 | 504 | 82.8 | globlastp |
| 1074 | LAB425 | citrus\|gb166\|CF507041_P1 | 4386 | 504 | 82.8 | globlastp |
| 1075 | LAB425 | cycas\|gb166\|DR063094_P1 | 4393 | 504 | 82.8 | globlastp |
| 1076 | LAB425 | heritiera\|10v1\|SRR005794S0000207_P1 | 4394 | 504 | 82.8 | globlastp |
| 1077 | LAB425 | monkeyflower\|10v1\|CV521573_P1 | 4395 | 504 | 82.8 | globlastp |
| 1078 | LAB425 | soybean\|11v1\|GLYMA12G31740_P1 | 4396 | 504 | 82.8 | globlastp |
| 1079 | LAB425 | soybean\|gb168\|BU964962 | 4396 | 504 | 82.8 | globlastp |
| 1080 | LAB425 | soybean\|11v1\|GLYMA13G38690_P1 | 4396 | 504 | 82.8 | globlastp |
| 1081 | LAB425 | soybean\|gb168\|CB891643 | 4396 | 504 | 82.8 | globlastp |
| 1082 | LAB425 | tragopogon\|10v1\|SRR020205S0199529 | 4397 | 504 | 82.8 | globlastp |
| 1083 | LAB425 | tabernaemontana\|11v1\|SRR098689X160075_T1 | 4398 | 504 | 82.76 | glotblastn |
| 1084 | LAB425 | artemisia\|10v1\|SRR019254S0017375_P1 | 4399 | 504 | 82.3 | globlastp |
| 1085 | LAB425 | cassava\|09v1\|CK649611_P1 | 4400 | 504 | 82.3 | globlastp |
| 1086 | LAB425 | coffea\|10v1\|DV681597_P1 | 4401 | 504 | 82.3 | globlastp |
| 1087 | LAB425 | cyamopsis\|10v1\|EG987817_P1 | 4402 | 504 | 82.3 | globlastp |
| 1088 | LAB425 | lettuce\|10v1\|DW086896_P1 | 4403 | 504 | 82.3 | globlastp |
| 1089 | LAB425 | poplar\|10v1\|BU825635_P1 | 4404 | 504 | 82.3 | globlastp |
| 1090 | LAB425 | prunus\|10v1\|CN496912 | 4405 | 504 | 82.3 | globlastp |
| 1091 | LAB425 | tobacco\|gb162\|EB446192 | 4406 | 504 | 82.3 | globlastp |
| 1092 | LAB425 | cucurbita\|11v1\|SRR091276X107795XX1_T1 | 4407 | 504 | 82.27 | glotblastn |
| 1093 | LAB425 | sequoia\|10v1\|SRR065044S0050653_T1 | 4408 | 504 | 82.27 | glotblastn |
| 1094 | LAB425 | avocado\|10v1\|FD502205_T1 | 4409 | 504 | 82.27 | glotblastn |
| 1095 | LAB425 | cacao\|10v1\|CF974061_P1 | 4410 | 504 | 81.8 | globlastp |
| 1096 | LAB425 | eucalyptus\|11v2\|ES590792_P1 | 4411 | 504 | 81.8 | globlastp |
| 1097 | LAB425 | fagopyrum\|11v1\|SRR063689X120384_P1 | 4412 | 504 | 81.8 | globlastp |
| 1098 | LAB425 | dandelion\|10v1\|DR399434_P1 | 4413 | 504 | 81.8 | globlastp |
| 1099 | LAB425 | rhizophora\|10v1\|SRR005792S0004218 | 4414 | 504 | 81.8 | globlastp |
| 1100 | LAB425 | apple\|11v1\|CN496912_T1 | 4415 | 504 | 81.77 | glotblastn |
| 1101 | LAB425 | pigeonpea\|10v1\|SRR054580S0031890_T1 | 4416 | 504 | 81.77 | glotblastn |
| 1102 | LAB425 | cucumber\|09v1\|AM718860_P1 | 4417 | 504 | 81.3 | globlastp |
| 1103 | LAB425 | triphysaria\|10v1\|EY015864 | 4418 | 504 | 81.3 | globlastp |
| 1104 | LAB425 | nuphar\|gb166\|CK744675_T1 | 4419 | 504 | 81.28 | glotblastn |
| 1105 | LAB425 | cotton\|10v2\|BE053360_P1 | 4420 | 504 | 80.8 | globlastp |
| 1106 | LAB425 | vinca\|11v1\|SRR098690X106552_P1 | 4421 | 504 | 80.8 | globlastp |
| 1107 | LAB425 | oak\|10v1\|DB997251_P1 | 4422 | 504 | 80.8 | globlastp |
| 1108 | LAB425 | poplar\|10v1\|AI165058_P1 | 4423 | 504 | 80.8 | globlastp |
| 1109 | LAB425 | apple\|11v1\|CN917509_T1 | 4424 | 504 | 80.79 | glotblastn |
| 1110 | LAB425 | chelidonium\|11v1\|SRR084752X143524_T1 | 4425 | 504 | 80.79 | glotblastn |
| 1111 | LAB425 | euphorbia\|11v1\|DV113808_P1 | 4426 | 504 | 80.3 | globlastp |
| 1111 | LAB425 | spurge\|gb161\|DV113808 | 4426 | 504 | 80.3 | globlastp |
| 1112 | LAB425 | phyla\|11v1\|SRR099037X100518_P1 | 4427 | 504 | 80.3 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1113 | LAB425 | primula\|11v1\|SRR098679X125048_P1 | 4428 | 504 | 80.3 | globlastp |
| 1114 | LAB425 | trigonella\|11v1\|SRR066194X109128_P1 | 4429 | 504 | 80.3 | globlastp |
| 1115 | LAB425 | medicago\|09v1\|AL389183_P1 | 4430 | 504 | 80.3 | globlastp |
| 1116 | LAB425 | safflower\|gb162\|EL407461 | 4431 | 504 | 80.3 | globlastp |
| 1117 | LAB426 | wheat\|10v2\|BE515522_T1 | 4432 | 505 | 93.44 | glotblastn |
| 1118 | LAB426 | wheat\|10v2\|BE516764_T1 | 4433 | 505 | 93.44 | glotblastn |
| 1119 | LAB426 | wheat\|gb164\|AL817087 | 4434 | 505 | 93.4 | globlastp |
| 1120 | LAB426 | wheat\|gb164\|BE515522 | 4435 | 505 | 93.4 | globlastp |
| 1121 | LAB426 | wheat\|gb164\|BE516764 | 4436 | 505 | 93.4 | globlastp |
| 1122 | LAB426 | pseudoroegneria\|gb167\|FF343793 | 4437 | 505 | 91.9 | globlastp |
| 1123 | LAB427 | wheat\|10v2\|BE418194_T1 | 4438 | 506 | 97.34 | glotblastn |
| 1124 | LAB427 | leymus\|gb166\|EG375038_P1 | 4439 | 506 | 96.8 | globlastp |
| 1125 | LAB427 | wheat\|gb164\|BE418194 | 4440 | 506 | 94.1 | globlastp |
| 1126 | LAB427 | brachypodium\|09v1\|DV475640_P1 | 4441 | 506 | 87.7 | globlastp |
| 1127 | LAB427 | rice\|gb170\|OS06G20320 | 4442 | 506 | 82.7 | globlastp |
| 1128 | LAB427 | sorghum\|09v1\|SB08G001930 | 4443 | 506 | 80.6 | globlastp |
| 1129 | LAB428 | wheat\|10v2\|BE517179_P1 | 4444 | 507 | 99 | globlastp |
| 1130 | LAB428 | brachypodium\|09v1\|DV487448_P1 | 4445 | 507 | 95.2 | globlastp |
| 1131 | LAB428 | oat\|10v2\|GO592191_T1 | 4446 | 507 | 90.3 | glotblastn |
| 1132 | LAB428 | rice\|gb170\|OS06G09570 | 4447 | 507 | 89.2 | globlastp |
| 1133 | LAB428 | foxtail_millet\|10v2\|SICRP017295_P1 | 4448 | 507 | 89.1 | globlastp |
| 1134 | LAB428 | rice\|gb170\|OS07G01920 | 4449 | 507 | 89.1 | globlastp |
| 1135 | LAB428 | sorghum\|09v1\|SB10G006410 | 4450 | 507 | 89.1 | globlastp |
| 1136 | LAB428 | millet\|10v1\|EVO454PM001652_P1 | 4451 | 507 | 88.5 | globlastp |
| 1137 | LAB428 | maize\|10v1\|BE186693_P1 | 4452 | 507 | 88.4 | globlastp |
| 1138 | LAB428 | maize\|10v1\|AI665338_P1 | 4453 | 507 | 87.8 | globlastp |
| 1139 | LAB428 | millet\|10v1\|EVO454PM021658_P1 | 4454 | 507 | 84.5 | globlastp |
| 1140 | LAB428 | apple\|11v1\|CN495979_P1 | 4455 | 507 | 81.7 | globlastp |
| 1141 | LAB428 | cotton\|10v1\|AI727676 | 4456 | 507 | 81.4 | globlastp |
| 1142 | LAB428 | cotton\|10v2\|SRR032367S0000768_P1 | 4457 | 507 | 81.4 | globlastp |
| 1143 | LAB428 | poplar\|10v1\|CV265791_P1 | 4458 | 507 | 81.4 | globlastp |
| 1144 | LAB428 | prunus\|10v1\|CN904855 | 4459 | 507 | 81.4 | globlastp |
| 1145 | LAB428 | amsonia\|11v1\|SRR098688X135297_P1 | 4460 | 507 | 81.2 | globlastp |
| 1146 | LAB428 | oak\|10v1\|FP045986_P1 | 4461 | 507 | 81 | globlastp |
| 1147 | LAB428 | oak\|10v1\|FP056498_P1 | 4462 | 507 | 81 | globlastp |
| 1148 | LAB428 | eucalyptus\|11v2\|CD669060_P1 | 4463 | 507 | 80.9 | globlastp |
| 1149 | LAB428 | monkeyflower\|10v1\|DV212070_P1 | 4464 | 507 | 80.7 | globlastp |
| 1150 | LAB428 | castorbean\|09v1\|EV520636_P1 | 4465 | 507 | 80.6 | globlastp |
| 1151 | LAB428 | clementine\|11v1\|EY770412_P1 | 4466 | 507 | 80.5 | globlastp |
| 1152 | LAB428 | aristolochia\|10v1\|FD748454_P1 | 4467 | 507 | 80.4 | globlastp |
| 1153 | LAB428 | cassava\|09v1\|DB921557_P1 | 4468 | 507 | 80.4 | globlastp |
| 1154 | LAB428 | cassava\|09v1\|FF534596_P1 | 4469 | 507 | 80.4 | globlastp |
| 1155 | LAB428 | tomato\|09v1\|AI490117 | 4470 | 507 | 80.4 | globlastp |
| 1156 | LAB428 | tomato\|10v1\|AI490117_P1 | 4470 | 507 | 80.4 | globlastp |
| 1157 | LAB428 | poplar\|10v1\|BU812813_P1 | 4471 | 507 | 80.2 | globlastp |
| 1158 | LAB428 | euonymus\|11v1\|SRR070038X103545_T1 | 4472 | 507 | 80.12 | glotblastn |
| 1159 | LAB428 | vinca\|11v1\|SRR098690X182908_T1 | 4473 | 507 | 80.06 | glotblastn |
| 1160 | LAB430 | pseudoroegneria\|gb167\|FF354308 | 4474 | 509 | 88.7 | globlastp |
| 1161 | LAB430 | wheat\|10v2\|CA659369_P1 | 4475 | 509 | 87.4 | globlastp |
| 1162 | LAB430 | wheat\|10v2\|AL823443_P1 | 4476 | 509 | 86.7 | globlastp |
| 1163 | LAB430 | wheat\|gb164\|AL823443 | 4476 | 509 | 86.7 | globlastp |
| 1164 | LAB430 | wheat\|10v2\|BE429943_P1 | 4477 | 509 | 86 | globlastp |
| 1165 | LAB430 | wheat\|gb164\|BE429943 | 4477 | 509 | 86 | globlastp |
| 1166 | LAB430 | oat\|10v2\|GR313816_P1 | 4478 | 509 | 80.6 | globlastp |
| 1167 | LAB431 | barley\|10v2\|AJ432638_P1 | 4479 | 510 | 96.2 | globlastp |
| 1168 | LAB431 | wheat\|10v2\|BE518296_P1 | 4480 | 510 | 91.9 | globlastp |
| 1169 | LAB431 | wheat\|gb164\|BE518296 | 4480 | 510 | 91.9 | globlastp |
| 1170 | LAB431 | pseudoroegneria\|gb167\|FF345714 | 4481 | 510 | 81 | globlastp |
| 1171 | LAB432 | rye\|gb164\|BE586255 | 4482 | 511 | 97.33 | glotblastn |
| 1172 | LAB432 | wheat\|gb164\|BE213392 | 4483 | 511 | 97.33 | glotblastn |
| 1173 | LAB432 | wheat\|gb164\|BE401545 | 4483 | 511 | 97.33 | glotblastn |
| 1174 | LAB432 | wheat\|gb164\|WHTWALI1A | 4484 | 511 | 97.33 | glotblastn |
| 1175 | LAB432 | foxtail_millet\|10v2\|FXTSLX00007196_P1 | 4485 | 511 | 97.3 | globlastp |
| 1176 | LAB432 | foxtail_millet\|10v2\|OXFXTSLX00003496T1_P1 | 4485 | 511 | 97.3 | globlastp |
| 1177 | LAB432 | wheat\|10v2\|BE431169XX1_P1 | 4485 | 511 | 97.3 | globlastp |
| 1178 | LAB432 | wheat\|10v2\|BQ901926_P1 | 4485 | 511 | 97.3 | globlastp |
| 1179 | LAB432 | wheat\|10v2\|WHTWALI1A_P1 | 4485 | 511 | 97.3 | globlastp |
| 1180 | LAB432 | oat\|10v2\|GR365951_P1 | 4486 | 511 | 97.3 | globlastp |
| 1181 | LAB432 | pseudoroegneria\|gb167\|FF344184 | 4485 | 511 | 97.3 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1182 | LAB432 | leymus\|gb166\|CN465843_P1 | 4487 | 511 | 96 | globlastp |
| 1183 | LAB432 | wheat\|gb164\|BE403268 | 4488 | 511 | 96 | globlastp |
| 1184 | LAB432 | wheat\|gb164\|BE406805 | 4489 | 511 | 96 | glotblastn |
| 1185 | LAB432 | wheat\|gb164\|CA608021 | 4490 | 511 | 96 | glotblastn |
| 1186 | LAB432 | wheat\|10v2\|BE429271_P1 | 4491 | 511 | 96 | globlastp |
| 1187 | LAB432 | wheat\|10v2\|CA613919_P1 | 4492 | 511 | 92 | globlastp |
| 1188 | LAB432 | wheat\|10v2\|CA611927_T1 | 4493 | 511 | 90.67 | glotblastn |
| 1189 | LAB432 | wheat\|gb164\|CA598475 | 4494 | 511 | 90.67 | glotblastn |
| 1190 | LAB432 | wheat\|gb164\|CA613919 | 4495 | 511 | 90.67 | glotblastn |
| 1191 | LAB432 | wheat\|gb164\|CA689163 | 4496 | 511 | 89.33 | globlastp |
| 1192 | LAB432 | wheat\|10v2\|CA687691XX1_P1 | 4497 | 511 | 88.6 | globlastp |
| 1193 | LAB432 | pseudoroegneria\|gb167\|FF365910 | 4498 | 511 | 85.33 | glotblastn |
| 1194 | LAB432 | barley\|10v2\|BG366082_T1 | — | 511 | 85.33 | glotblastn |
| 1195 | LAB432 | fescue\|gb161\|CK801146_P1 | 4499 | 511 | 80 | globlastp |
| 1196 | LAB432 | fescue\|gb161\|CK801246_T1 | 4500 | 511 | 80 | glotblastn |
| 1197 | LAB432 | wheat\|gb164\|DR733728 | 4501 | 511 | 80 | glotblastn |
| 1198 | LAB433 | wheat\|10v2\|BE423144_P1 | 4502 | 512 | 96.2 | globlastp |
| 1199 | LAB433 | wheat\|gb164\|BE213571 | 4503 | 512 | 96.18 | glotblastn |
| 1200 | LAB433 | leymus\|gb166\|CD809234_P1 | 4504 | 512 | 95.4 | globlastp |
| 1201 | LAB433 | pseudoroegneria\|gb167\|FF353479 | 4505 | 512 | 95 | globlastp |
| 1202 | LAB433 | brachypodium\|09v1\|GT769078_P1 | 4506 | 512 | 86.1 | globlastp |
| 1203 | LAB433 | wheat\|gb164\|BE426425 | 4507 | 512 | 84.35 | glotblastn |
| 1204 | LAB433 | oat\|10v2\|GR313136_P1 | 4508 | 512 | 83.8 | globlastp |
| 1205 | LAB433 | fescue\|gb161\|DT679446_P1 | 4509 | 512 | 83.2 | globlastp |
| 1206 | LAB435 | barley\|10v2\|BE413161_P1 | 4510 | 514 | 99.4 | globlastp |
| 1207 | LAB435 | wheat\|10v2\|BE401001_P1 | 4511 | 514 | 95.1 | globlastp |
| 1208 | LAB435 | wheat\|gb164\|BF474492 | 4512 | 514 | 94.8 | globlastp |
| 1209 | LAB435 | wheat\|10v2\|BE419192_P1 | 4513 | 514 | 90.6 | globlastp |
| 1210 | LAB435 | brachypodium\|09v1\|DV486409_P1 | 4514 | 514 | 82.8 | globlastp |
| 1211 | LAB437 | wheat\|10v2\|BE405124_P1 | 4515 | 516 | 98.2 | globlastp |
| 1212 | LAB437 | rice\|gb170\|OS08G32850 | 4516 | 516 | 91.1 | globlastp |
| 1213 | LAB437 | brachypodium\|09v1\|GT764231_P1 | 4517 | 516 | 90.7 | globlastp |
| 1214 | LAB437 | switchgrass\|gb167\|FL695036 | 4518 | 516 | 89.14 | glotblastn |
| 1215 | LAB437 | millet\|10v1\|EB410953_P1 | 4519 | 516 | 89 | globlastp |
| 1216 | LAB437 | foxtail_millet\|10v2\|FXTRMSLX00176383D1_P1 | 4520 | 516 | 88.6 | globlastp |
| 1217 | LAB437 | sugarcane\|10v1\|CA083097 | 4521 | 516 | 88.4 | globlastp |
| 1218 | LAB437 | sorghum\|09v1\|SB07G020640 | 4522 | 516 | 87.9 | globlastp |
| 1219 | LAB437 | maize\|10v1\|AI664918_P1 | 4523 | 516 | 87.4 | globlastp |
| 1220 | LAB437 | wheat\|gb164\|BE488760 | 4524 | 516 | 84.9 | globlastp |
| 1221 | LAB437 | wheat\|gb164\|BE405124 | 4525 | 516 | 82.2 | globlastp |
| 1222 | LAB437 | wheat\|10v2\|BE488760_T1 | 4526 | 516 | 82.03 | glotblastn |
| 1223 | LAB438 | wheat\|10v2\|BF483640_P1 | 4527 | 517 | 92 | globlastp |
| 1224 | LAB438 | wheat\|gb164\|BF483640 | 4528 | 517 | 90.99 | glotblastn |
| 1225 | LAB439 | barley\|10v2\|BE412611_P1 | 4529 | 518 | 94.5 | globlastp |
| 1226 | LAB439 | wheat\|10v2\|CK156459XX1_P1 | 4530 | 518 | 93.8 | globlastp |
| 1227 | LAB439 | wheat\|gb164\|BF484029 | 4531 | 518 | 93.5 | globlastp |
| 1228 | LAB439 | wheat\|10v2\|CA661965_T1 | 4532 | 518 | 93.49 | glotblastn |
| 1229 | LAB439 | brachypodium\|09v1\|DV473493_P1 | 4533 | 518 | 92.5 | globlastp |
| 1230 | LAB439 | leymus\|gb166\|CN465892_P1 | 4534 | 518 | 92.2 | globlastp |
| 1231 | LAB439 | wheat\|gb164\|BE400338 | 4535 | 518 | 91.9 | globlastp |
| 1232 | LAB439 | wheat\|10v2\|BG262444_P1 | 4536 | 518 | 91.9 | globlastp |
| 1233 | LAB439 | wheat\|gb164\|BE637702 | 4537 | 518 | 91.9 | globlastp |
| 1234 | LAB439 | barley\|10v1\|BE412611 | 4538 | 518 | 91.5 | globlastp |
| 1235 | LAB439 | oat\|10v2\|CN820116_P1 | 4539 | 518 | 89.6 | globlastp |
| 1236 | LAB439 | rice\|gb170\|OS07G32230 | 4540 | 518 | 88.3 | globlastp |
| 1237 | LAB439 | millet\|10v1\|EVO454PM023397_P1 | 4541 | 518 | 87.3 | globlastp |
| 1238 | LAB439 | foxtail_millet\|10v2\|EC613776_P1 | 4542 | 518 | 86.6 | globlastp |
| 1239 | LAB439 | maize\|10v1\|AI947353_P1 | 4543 | 518 | 86.3 | globlastp |
| 1240 | LAB439 | sugarcane\|10v1\|BQ536391 | 4544 | 518 | 86 | globlastp |
| 1241 | LAB439 | switchgrass\|gb167\|FE601170 | 4545 | 518 | 86 | globlastp |
| 1242 | LAB439 | switchgrass\|gb167\|FL737941 | 4546 | 518 | 86 | globlastp |
| 1243 | LAB439 | wheat\|10v2\|CA613928XX1_P1 | 4547 | 518 | 85.7 | globlastp |
| 1244 | LAB439 | sorghum\|09v1\|SB02G034200 | 4548 | 518 | 83.7 | globlastp |
| 1245 | LAB440 | wheat\|10v2\|BE585998_P1 | 4549 | 519 | 84.9 | globlastp |
| 1246 | LAB440 | wheat\|gb164\|BE585998 | 4550 | 519 | 81.2 | globlastp |
| 1247 | LAB442 | wheat\|10v2\|BE420126_P1 | 4551 | 520 | 94 | globlastp |
| 1248 | LAB442 | wheat\|gb164\|BE420126 | 4552 | 520 | 93.6 | globlastp |
| 1249 | LAB442 | brachypodium\|09v1\|DV473416_P1 | 4553 | 520 | 85.9 | globlastp |
| 1250 | LAB442 | wheat\|gb164\|BE488794 | 4554 | 520 | 82.1 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1251 | LAB443 | cotton\|10v2\|BF277776_P1 | 521 | 521 | 100 | globlastp |
| 1252 | LAB443 | wheat\|gb164\|CD894740 | 4555 | 521 | 92.5 | globlastp |
| 1253 | LAB443 | pseudoroegneria\|gb167\|FF343234 | 4556 | 521 | 91.6 | globlastp |
| 1254 | LAB443 | wheat\|gb164\|BE517403 | 4557 | 521 | 89.72 | glotblastn |
| 1255 | LAB443 | wheat\|10v2\|AL819218_P1 | 4558 | 521 | 89.2 | globlastp |
| 1256 | LAB443 | wheat\|gb164\|AL819218 | 4558 | 521 | 89.2 | globlastp |
| 1257 | LAB443 | wheat\|10v2\|BE517403XX1_P1 | 4559 | 521 | 88.9 | globlastp |
| 1258 | LAB443 | rye\|gb164\|BE588133 | 4560 | 521 | 88.9 | globlastp |
| 1259 | LAB443 | wheat\|gb164\|CA697871 | 4561 | 521 | 80.73 | glotblastn |
| 1260 | LAB445 | wheat\|10v2\|BE428350_P1 | 4562 | 523 | 94.5 | globlastp |
| 1261 | LAB445 | wheat\|gb164\|BE403110 | 4563 | 523 | 89.9 | globlastp |
| 1262 | LAB446 | wheat\|gb164\|BE444792 | 4564 | 524 | 92.5 | globlastp |
| 1263 | LAB446 | leymus\|gb166\|CD808760_P1 | 4565 | 524 | 91.5 | globlastp |
| 1264 | LAB446 | pseudoroegneria\|gb167\|FF345806 | 4566 | 524 | 91.5 | globlastp |
| 1265 | LAB446 | wheat\|gb164\|CA659582 | 4567 | 524 | 91.5 | globlastp |
| 1266 | LAB446 | wheat\|10v2\|BM134536_P1 | 4568 | 524 | 89.9 | globlastp |
| 1267 | LAB446 | wheat\|gb164\|BE442599 | 4568 | 524 | 89.9 | globlastp |
| 1268 | LAB446 | wheat\|10v2\|BE426104_P1 | 4569 | 524 | 89.5 | globlastp |
| 1269 | LAB446 | wheat\|gb164\|BE591174 | 4570 | 524 | 88.9 | globlastp |
| 1270 | LAB446 | wheat\|10v2\|BG263844_P1 | 4571 | 524 | 88.6 | globlastp |
| 1271 | LAB446 | wheat\|10v2\|BE591679_T1 | 4572 | 524 | 86.27 | glotblastn |
| 1272 | LAB446 | wheat\|10v2\|BF478896_P1 | 4573 | 524 | 85 | globlastp |
| 1273 | LAB446 | brachypodium\|09v1\|DV470899_P1 | 4574 | 524 | 83 | globlastp |
| 1274 | LAB449 | wheat\|10v2\|BE427206_P1 | 4575 | 527 | 96.2 | globlastp |
| 1275 | LAB449 | wheat\|gb164\|CA657188 | 4576 | 527 | 91.9 | globlastp |
| 1276 | LAB449 | wheat\|gb164\|BE427206 | 4577 | 527 | 91.5 | globlastp |
| 1277 | LAB449 | brachypodium\|09v1\|DV470718_P1 | 4578 | 527 | 90.2 | globlastp |
| 1278 | LAB449 | rice\|gb170\|OS11G17610 | 4579 | 527 | 85.6 | globlastp |
| 1279 | LAB449 | switchgrass\|gb167\|DN142527 | 4580 | 527 | 84.5 | globlastp |
| 1280 | LAB449 | sorghum\|09v1\|SB05G010020 | 4581 | 527 | 83.7 | globlastp |
| 1281 | LAB449 | sugarcane\|10v1\|BQ534978 | 4582 | 527 | 82.9 | globlastp |
| 1282 | LAB449 | millet\|10v1\|EVO454PM019979_P1 | 4583 | 527 | 81.4 | globlastp |
| 1283 | LAB449 | maize\|10v1\|AI629645_T1 | 4584 | 527 | 81.07 | glotblastn |
| 1284 | LAB455 | leymus\|gb166\|EG383825_P1 | 4585 | 533 | 99.1 | globlastp |
| 1285 | LAB455 | wheat\|10v2\|BE406652_P1 | 4586 | 533 | 98.9 | globlastp |
| 1286 | LAB455 | wheat\|10v2\|BE414830_P1 | 4587 | 533 | 98.6 | globlastp |
| 1287 | LAB455 | brachypodium\|09v1\|DV476569_P1 | 4588 | 533 | 94.7 | globlastp |
| 1288 | LAB455 | oat\|10v2\|CN820931_P1 | 4589 | 533 | 93.2 | globlastp |
| 1289 | LAB455 | foxtail_millet\|10v2\|EC613055_P1 | 4590 | 533 | 92.2 | globlastp |
| 1290 | LAB455 | switchgrass\|gb167\|FE607853 | 4591 | 533 | 92.2 | globlastp |
| 1291 | LAB455 | switchgrass\|gb167\|DN141032 | 4592 | 533 | 92.2 | globlastp |
| 1292 | LAB455 | sorghum\|09v1\|SB09G004830 | 4593 | 533 | 91.7 | globlastp |
| 1293 | LAB455 | sugarcane\|10v1\|CA116373 | 4594 | 533 | 91.5 | globlastp |
| 1294 | LAB455 | wheat\|gb164\|BE414919 | 4595 | 533 | 91.3 | globlastp |
| 1295 | LAB455 | brachypodium\|09v1\|GT777908_P1 | 4596 | 533 | 91.3 | globlastp |
| 1296 | LAB455 | maize\|10v1\|AI586456_P1 | 4597 | 533 | 91 | globlastp |
| 1297 | LAB455 | millet\|10v1\|EVO454PM003477_P1 | 4598 | 533 | 90.8 | globlastp |
| 1298 | LAB455 | rice\|gb170\|OS05G07090 | 4599 | 533 | 90.3 | globlastp |
| 1299 | LAB455 | foxtail_millet\|10v2\|SICRP017940_P1 | 4600 | 533 | 87.1 | globlastp |
| 1300 | LAB455 | sugarcane\|10v1\|CA092814 | 4601 | 533 | 85.6 | globlastp |
| 1301 | LAB455 | fescue\|gb161\|DT681701_T1 | 4602 | 533 | 85.39 | glotblastn |
| 1302 | LAB455 | rice\|gb170\|OS01G06600 | 4603 | 533 | 84.8 | globlastp |
| 1303 | LAB455 | sorghum\|09v1\|SB03G005265 | 4604 | 533 | 84.7 | globlastp |
| 1304 | LAB455 | millet\|10v1\|EVO454PM013112_P1 | 4605 | 533 | 84.6 | globlastp |
| 1305 | LAB455 | maize\|10v1\|AI396382_P1 | 4606 | 533 | 83.5 | globlastp |
| 1306 | LAB455 | aristolochia\|10v1\|FD757054_P1 | 4607 | 533 | 80.7 | globlastp |
| 1307 | LAB456 | wheat\|10v2\|BE405251_P1 | 4608 | 534 | 93.1 | globlastp |
| 1308 | LAB456 | brachypodium\|09v1\|GT804828_P1 | 4609 | 534 | 80.3 | globlastp |
| 1309 | LAB458 | wheat\|gb164\|BE398978 | 4610 | 536 | 99.4 | globlastp |
| 1310 | LAB458 | wheat\|gb164\|BE413632 | 4611 | 536 | 98.9 | globlastp |
| 1311 | LAB458 | leymus\|gb166\|CD808941_P1 | 4612 | 536 | 98.6 | globlastp |
| 1312 | LAB458 | wheat\|gb164\|BE419580 | 4613 | 536 | 98.6 | globlastp |
| 1313 | LAB458 | pseudoroegneria\|gb167\|FF347415 | 4614 | 536 | 98.3 | globlastp |
| 1314 | LAB458 | rye\|gb164\|BE586229 | 4615 | 536 | 97.8 | globlastp |
| 1315 | LAB458 | wheat\|gb164\|BE414916 | 4616 | 536 | 97.8 | globlastp |
| 1316 | LAB458 | barley\|10v1\|BF621453 | 4617 | 536 | 97.77 | glotblastn |
| 1317 | LAB458 | wheat\|gb164\|BE403620 | 4618 | 536 | 97.2 | globlastp |
| 1318 | LAB458 | wheat\|gb164\|BE400719 | 4619 | 536 | 96.9 | globlastp |
| 1319 | LAB458 | wheat\|gb164\|BE403541 | 4620 | 536 | 96.9 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1320 | LAB458 | wheat\|10v2\|BE428158_P1 | 4621 | 536 | 95 | globlastp |
| 1321 | LAB458 | wheat\|10v2\|BF199652_P1 | 4622 | 536 | 94.7 | globlastp |
| 1322 | LAB458 | wheat\|10v2\|CA690561_P1 | 4623 | 536 | 93.6 | globlastp |
| 1323 | LAB458 | oat\|10v2\|CN815558_P1 | 4624 | 536 | 93.3 | globlastp |
| 1324 | LAB458 | wheat\|10v2\|BE402970XX1_P1 | 4625 | 536 | 92.7 | globlastp |
| 1325 | LAB458 | brachypodium\|09v1\|DV468894_P1 | 4626 | 536 | 92.7 | globlastp |
| 1326 | LAB458 | rice\|gb170\|OS05G33380 | 4627 | 536 | 92.7 | globlastp |
| 1327 | LAB458 | switchgrass\|gb167\|DN140946 | 4628 | 536 | 90.2 | globlastp |
| 1328 | LAB458 | rice\|gb170\|OS10G08022 | 4629 | 536 | 89.9 | globlastp |
| 1329 | LAB458 | sorghum\|09v1\|SB04G019020 | 4630 | 536 | 89.9 | globlastp |
| 1330 | LAB458 | switchgrass\|gb167\|DN151390 | 4631 | 536 | 89.9 | globlastp |
| 1331 | LAB458 | sugarcane\|10v1\|BU925732 | 4632 | 536 | 89.7 | globlastp |
| 1332 | LAB458 | rice\|gb170\|OS01G67860 | 4633 | 536 | 89.4 | globlastp |
| 1333 | LAB458 | switchgrass\|gb167\|DN142786 | 4634 | 536 | 89.11 | globlastn |
| 1334 | LAB458 | cassava\|09v1\|BM259862_P1 | 4635 | 536 | 89.1 | globlastp |
| 1335 | LAB458 | sorghum\|09v1\|SB03G043140 | 4636 | 536 | 89.1 | globlastp |
| 1336 | LAB458 | cassava\|09v1\|CK643092_P1 | 4637 | 536 | 88.8 | globlastp |
| 1337 | LAB458 | maize\|10v1\|MZEALD_P1 | 4638 | 536 | 88.8 | globlastp |
| 1338 | LAB458 | oil_palm\|gb166\|CN601184_P1 | 4639 | 536 | 88.8 | globlastp |
| 1339 | LAB458 | ginger\|gb164\|DY346481_P1 | 4640 | 536 | 88.5 | globlastp |
| 1340 | LAB458 | grape\|gb160\|BM437040_P1 | 4641 | 536 | 88.5 | globlastp |
| 1341 | LAB458 | maize\|10v1\|AI001253_P1 | 4642 | 536 | 88.5 | globlastp |
| 1342 | LAB458 | oil_palm\|gb166\|CN599435_P1 | 4643 | 536 | 88.3 | globlastp |
| 1343 | LAB458 | cynodon\|10v1\|ES296554_P1 | 4644 | 536 | 88.1 | globlastp |
| 1344 | LAB458 | platanus\|11v1\|SRR096786X104675_T1 | 4645 | 536 | 87.99 | glotblastn |
| 1345 | LAB458 | sugarcane\|10v1\|BQ478952 | 4646 | 536 | 87.71 | glotblastn |
| 1346 | LAB458 | platanus\|11v1\|SRR096786X112205_P1 | 4647 | 536 | 87.7 | globlastp |
| 1347 | LAB458 | banana\|10v1\|ES431582_P1 | 4648 | 536 | 87.7 | globlastp |
| 1348 | LAB458 | clementine\|11v1\|BQ623139_P1 | 4649 | 536 | 87.4 | globlastp |
| 1349 | LAB458 | cucurbita\|11v1\|FG227043_P1 | 4650 | 536 | 87.4 | globlastp |
| 1350 | LAB458 | orange\|11v1\|BQ623139_P1 | 4651 | 536 | 87.4 | globlastp |
| 1351 | LAB458 | citrus\|gb166\|BQ623798_P1 | 4651 | 536 | 87.4 | globlastp |
| 1352 | LAB458 | cucumber\|09v1\|DV631545_P1 | 4652 | 536 | 87.4 | globlastp |
| 1353 | LAB458 | aristolochia\|10v1\|SRR039082S0035607_P1 | 4653 | 536 | 87.2 | globlastp |
| 1354 | LAB458 | chelidonium\|11v1\|SRR084752X102854_P1 | 4654 | 536 | 87.2 | globlastp |
| 1355 | LAB458 | humulus\|11v1\|ES437788_P1 | 4655 | 536 | 86.9 | globlastp |
| 1356 | LAB458 | curcuma\|10v1\|DY389035_P1 | 4656 | 536 | 86.9 | globlastp |
| 1357 | LAB458 | prunus\|10v1\|BU039816 | 4657 | 536 | 86.9 | globlastp |
| 1358 | LAB458 | aristolochia\|10v1\|SRR039082S0328710_P1 | 4658 | 536 | 86.6 | globlastp |
| 1359 | LAB458 | euonymus\|11v1\|SRR070038X115862_P1 | 4659 | 536 | 86.6 | globlastp |
| 1360 | LAB458 | phyla\|11v1\|SRR099035X105047_P1 | 4660 | 536 | 86.6 | globlastp |
| 1361 | LAB458 | apple\|11v1\|CN490730_P1 | 4661 | 536 | 86.6 | globlastp |
| 1362 | LAB458 | apple\|gb171\|CN490730 | 4661 | 536 | 86.6 | globlastp |
| 1363 | LAB458 | avocado\|10v1\|AJ133146_P1 | 4662 | 536 | 86.6 | globlastp |
| 1364 | LAB458 | wheat\|gb164\|BE398829 | 4663 | 536 | 86.6 | globlastp |
| 1365 | LAB458 | foxtail_millet\|10v2\|SICRP007988_T1 | 4664 | 536 | 86.31 | glotblastn |
| 1366 | LAB458 | euonymus\|11v1\|SRR070038X10141_P1 | 4665 | 536 | 86.3 | globlastp |
| 1367 | LAB458 | tripterygium\|11v1\|SRR098677X101221_P1 | 4666 | 536 | 86.3 | globlastp |
| 1368 | LAB458 | aquilegia\|10v1\|DR915781 | 4667 | 536 | 86.3 | globlastp |
| 1369 | LAB458 | aquilegia\|10v2\|DR915781_P1 | 4667 | 536 | 86.3 | globlastp |
| 1370 | LAB458 | castorbean\|09v1\|T14941_P1 | 4668 | 536 | 86.3 | globlastp |
| 1371 | LAB458 | chestnut\|gb170\|SRR006295S0002306_P1 | 4669 | 536 | 86.3 | globlastp |
| 1372 | LAB458 | eucalyptus\|11v2\|CD668585_P1 | 4670 | 536 | 86.3 | globlastp |
| 1373 | LAB458 | eucalyptus\|gb166\|CD668585 | 4671 | 536 | 86.3 | globlastp |
| 1374 | LAB458 | poplar\|10v1\|AI164661_P1 | 4672 | 536 | 86.3 | globlastp |
| 1375 | LAB458 | aquilegia\|10v2\|DR953019_P1 | 4673 | 536 | 86.3 | globlastp |
| 1376 | LAB458 | euonymus\|11v1\|SRR070038X155610_P1 | 4674 | 536 | 86 | globlastp |
| 1377 | LAB458 | apple\|11v1\|CN444122_P1 | 4675 | 536 | 86 | globlastp |
| 1378 | LAB458 | apple\|gb171\|CN444122 | 4675 | 536 | 86 | globlastp |
| 1379 | LAB458 | aquilegia\|10v1\|DR953019 | 4676 | 536 | 86 | globlastp |
| 1380 | LAB458 | oak\|10v1\|DB996997_P1 | 4677 | 536 | 86 | globlastp |
| 1381 | LAB458 | strawberry\|gb164\|CO379809 | 4678 | 536 | 86 | globlastp |
| 1382 | LAB458 | eucalyptus\|11v2\|CD668002_P1 | 4679 | 536 | 85.8 | globlastp |
| 1383 | LAB458 | euphorbia\|11v1\|BP958881_P1 | 4680 | 536 | 85.8 | globlastp |
| 1384 | LAB458 | olea\|11v1\|SRR014463.10558_P1 | 4681 | 536 | 85.8 | globlastp |
| 1385 | LAB458 | monkeyflower\|10v1\|DV206104_P1 | 4682 | 536 | 85.8 | globlastp |
| 1386 | LAB458 | pigeonpea\|10v1\|EE605082_P1 | 4683 | 536 | 85.8 | globlastp |
| 1387 | LAB458 | apple\|11v1\|CN491039_T1 | 4684 | 536 | 85.75 | glotblastn |
| 1388 | LAB458 | euonymus\|11v1\|SRR070038X107693_T1 | 4685 | 536 | 85.75 | glotblastn |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1389 | LAB458 | peanut\|10v1\|EG029688_T1 | 4686 | 536 | 85.75 | glotblastn |
| 1390 | LAB458 | basilicum\|10v1\|DY321429_P1 | 4687 | 536 | 85.5 | globlastp |
| 1391 | LAB458 | eggplant\|10v1\|FS006599_P1 | 4688 | 536 | 85.5 | globlastp |
| 1392 | LAB458 | eschscholzia\|10v1\|CD477905_P1 | 4689 | 536 | 85.5 | globlastp |
| 1393 | LAB458 | peanut\|10v1\|CD038112_P1 | 4690 | 536 | 85.5 | globlastp |
| 1394 | LAB458 | peanut\|10v1\|EG028989_P1 | 4691 | 536 | 85.5 | globlastp |
| 1395 | LAB458 | prunus\|10v1\|CN887490 | 4692 | 536 | 85.5 | globlastp |
| 1396 | LAB458 | strawberry\|gb164\|AF308587 | 4693 | 536 | 85.5 | globlastp |
| 1397 | LAB458 | strawberry\|11v1\|AF308587_P1 | 4693 | 536 | 85.5 | globlastp |
| 1398 | LAB458 | banana\|10v1\|BBS633T3_T1 | 4694 | 536 | 85.2 | glotblastn |
| 1399 | LAB458 | euonymus\|11v1\|SRR070038X17757_T1 | 4695 | 536 | 85.2 | glotblastn |
| 1400 | LAB458 | parthenium\|10v1\|GW779155_P1 | 4696 | 536 | 85.2 | globlastp |
| 1401 | LAB458 | thalictrum\|11v1\|SRR096787X100289_P1 | 4697 | 536 | 85.2 | globlastp |
| 1402 | LAB458 | tripterygium\|11v1\|SRR098677X101571_P1 | 4698 | 536 | 85.2 | globlastp |
| 1403 | LAB458 | amborella\|gb166\|CD482989_P1 | 4699 | 536 | 85.2 | globlastp |
| 1404 | LAB458 | sunflower\|10v1\|CD849306 | 4700 | 536 | 85.2 | globlastp |
| 1405 | LAB458 | tobacco\|gb162\|AF154648 | 4701 | 536 | 85.2 | globlastp |
| 1406 | LAB458 | tomato\|09v1\|BG130504 | 4702 | 536 | 85.2 | globlastp |
| 1407 | LAB458 | tomato\|10v1\|BG130504_P1 | 4702 | 536 | 85.2 | globlastp |
| 1408 | LAB458 | cynara\|gb167\|GE590228_T1 | 4703 | 536 | 84.92 | glotblastn |
| 1409 | LAB458 | euonymus\|11v1\|SRR070038X100888_P1 | 4704 | 536 | 84.9 | globlastp |
| 1410 | LAB458 | euonymus\|11v1\|SRR070038X105118_P1 | 4704 | 536 | 84.9 | globlastp |
| 1411 | LAB458 | humulus\|11v1\|GD247981_P1 | 4705 | 536 | 84.9 | globlastp |
| 1412 | LAB458 | momordica\|10v1\|SRR071315S0000834_P1 | 4706 | 536 | 84.9 | globlastp |
| 1413 | LAB458 | tabernaemontana\|11v1\|SRR098689X101680_P1 | 4707 | 536 | 84.9 | globlastp |
| 1414 | LAB458 | artemisia\|10v1\|EY042375_P1 | 4708 | 536 | 84.9 | globlastp |
| 1415 | LAB458 | iceplant\|gb164\|AF003124_P1 | 4709 | 536 | 84.9 | globlastp |
| 1416 | LAB458 | lotus\|09v1\|LLAI967813_P1 | 4710 | 536 | 84.9 | globlastp |
| 1417 | LAB458 | melon\|10v1\|DV632894_P1 | 4711 | 536 | 84.9 | globlastp |
| 1418 | LAB458 | orobanche\|10v1\|SRR023189S0001013_P1 | 4712 | 536 | 84.9 | globlastp |
| 1419 | LAB458 | orobanche\|10v1\|SRR023189S0014271_P1 | 4713 | 536 | 84.9 | globlastp |
| 1420 | LAB458 | potato\|10v1\|AJ487389_P1 | 4714 | 536 | 84.9 | globlastp |
| 1421 | LAB458 | solanum_phureja\|09v1\|SPHBG130504 | 4714 | 536 | 84.9 | globlastp |
| 1422 | LAB458 | sunflower\|10v1\|CD845933 | 4715 | 536 | 84.9 | globlastp |
| 1423 | LAB458 | tobacco\|gb162\|CV018270 | 4716 | 536 | 84.9 | globlastp |
| 1424 | LAB458 | amsonia\|11v1\|SRR098688X10275_P1 | 4717 | 536 | 84.6 | globlastp |
| 1425 | LAB458 | euonymus\|11v1\|SRR070038X10229_P1 | 4718 | 536 | 84.6 | globlastp |
| 1426 | LAB458 | beet\|gb162\|AW777203_P1 | 4719 | 536 | 84.6 | globlastp |
| 1427 | LAB458 | cowpea\|gb166\|FF537768_P1 | 4720 | 536 | 84.6 | globlastp |
| 1428 | LAB458 | cucumber\|09v1\|DN909229_P1 | 4721 | 536 | 84.6 | globlastp |
| 1429 | LAB458 | nicotiana_benthamiana\|gb162\|CN655500_P1 | 4722 | 536 | 84.6 | globlastp |
| 1430 | LAB458 | pepper\|gb171\|BM062056_P1 | 4723 | 536 | 84.6 | globlastp |
| 1431 | LAB458 | soybean\|11v1\|GLYMA03G34950_P1 | 4724 | 536 | 84.6 | globlastp |
| 1432 | LAB458 | soybean\|gb168\|AW719994 | 4724 | 536 | 84.6 | globlastp |
| 1433 | LAB458 | arnica\|11v1\|SRR099034X105550_P1 | 4725 | 536 | 84.4 | globlastp |
| 1434 | LAB458 | cotton\|10v2\|CO070989_P1 | 4726 | 536 | 84.4 | globlastp |
| 1435 | LAB458 | cotton\|10v2\|DT468264_P1 | 4727 | 536 | 84.4 | globlastp |
| 1436 | LAB458 | euphorbia\|11v1\|AW862621XX2_P1 | 4728 | 536 | 84.4 | globlastp |
| 1437 | LAB458 | plantago\|11v1\|SRR066373X331728_P1 | 4729 | 536 | 84.4 | globlastp |
| 1438 | LAB458 | primula\|11v1\|SRR098679X101506_P1 | 4730 | 536 | 84.4 | globlastp |
| 1439 | LAB458 | zostera\|10v1\|AM766468_P1 | 4731 | 536 | 84.4 | globlastp |
| 1440 | LAB458 | cleome_spinosa\|10v1\|SRR015531S0004086_P1 | 4732 | 536 | 84.4 | globlastp |
| 1441 | LAB458 | cowpea\|gb166\|FC457624_P1 | 4733 | 536 | 84.4 | globlastp |
| 1442 | LAB458 | ipomoea_nil\|10v1\|BJ553693_P1 | 4734 | 536 | 84.4 | globlastp |
| 1443 | LAB458 | poplar\|10v1\|BI128057_P1 | 4735 | 536 | 84.4 | globlastp |
| 1444 | LAB458 | tobacco\|gb162\|EB425694 | 4736 | 536 | 84.4 | globlastp |
| 1445 | LAB458 | silene\|11v1\|GH292290_T1 | 4737 | 536 | 84.36 | glotblastn |
| 1446 | LAB458 | millet\|10v1\|EVO454PM586598_T1 | 4738 | 536 | 84.36 | glotblastn |
| 1447 | LAB458 | chelidonium\|11v1\|SRR084752X101686_P1 | 4739 | 536 | 84.1 | globlastp |
| 1448 | LAB458 | zostera\|10v1\|FC822225_P1 | 4740 | 536 | 84.1 | globlastp |
| 1449 | LAB458 | radish\|gb164\|EV549626 | 4741 | 536 | 84.1 | globlastp |
| 1450 | LAB458 | triphysaria\|10v1\|DR172758 | 4742 | 536 | 84.1 | globlastp |
| 1451 | LAB458 | primula\|11v1\|SRR098679X218861_T1 | 4743 | 536 | 84.08 | glotblastn |
| 1452 | LAB458 | cotton\|10v1\|BE052033 | 4744 | 536 | 84.08 | glotblastn |
| 1453 | LAB458 | cacao\|10v1\|CA794448_P1 | 4745 | 536 | 83.8 | globlastp |
| 1454 | LAB458 | cotton\|10v2\|BF271391_P1 | 4746 | 536 | 83.8 | globlastp |
| 1455 | LAB458 | cotton\|10v2\|DT053209_P1 | 4746 | 536 | 83.8 | globlastp |
| 1456 | LAB458 | cucurbita\|11v1\|FG227018_P1 | 4747 | 536 | 83.8 | globlastp |
| 1457 | LAB458 | silene\|11v1\|SRR096785X101249_P1 | 4748 | 536 | 83.8 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1458 | LAB458 | artemisia\|10v1\|EY082116_P1 | 4749 | 536 | 83.8 | globlastp |
| 1459 | LAB458 | b_oleracea\|gb161\|DY026842_P1 | 4750 | 536 | 83.8 | globlastp |
| 1460 | LAB458 | b_rapa\|gb162\|D78500_P1 | 4751 | 536 | 83.8 | globlastp |
| 1461 | LAB458 | cacao\|gb167\|CA794448 | 4745 | 536 | 83.8 | globlastp |
| 1462 | LAB458 | canola\|10v1\|CD813992_P1 | 4750 | 536 | 83.8 | globlastp |
| 1463 | LAB458 | canola\|10v1\|CD817837_P1 | 4750 | 536 | 83.8 | globlastp |
| 1464 | LAB458 | cassava\|09v1\|JGICASSAVA26923M1_P1 | 4752 | 536 | 83.8 | globlastp |
| 1465 | LAB458 | cichorium\|gb171\|DT212060_P1 | 4753 | 536 | 83.8 | globlastp |
| 1466 | LAB458 | ipomoea_batatas\|10v1\|BM878857_P1 | 4754 | 536 | 83.8 | globlastp |
| 1467 | LAB458 | lettuce\|10v1\|DW103502_P1 | 4755 | 536 | 83.8 | globlastp |
| 1468 | LAB458 | millet\|10v1\|EVO454PM003170_T1 | 4756 | 536 | 83.8 | glotblastn |
| 1469 | LAB458 | tomato\|09v1\|BG132689 | 4757 | 536 | 83.8 | globlastp |
| 1470 | LAB458 | tomato\|10v1\|BG132689_P1 | 4757 | 536 | 83.8 | globlastp |
| 1471 | LAB458 | triphysaria\|10v1\|DR174434 | 4758 | 536 | 83.8 | globlastp |
| 1472 | LAB458 | catharanthus\|11v1\|EG554564_T1 | 4759 | 536 | 83.52 | glotblastn |
| 1473 | LAB458 | fagopyrum\|11v1\|SRR063689X267491_T1 | 4760 | 536 | 83.52 | glotblastn |
| 1474 | LAB458 | dandelion\|10v1\|DQ160154_T1 | 4761 | 536 | 83.52 | glotblastn |
| 1475 | LAB458 | lettuce\|10v1\|DW051053_T1 | 4762 | 536 | 83.52 | glotblastn |
| 1476 | LAB458 | radish\|gb164\|EW717924 | 4763 | 536 | 83.52 | glotblastn |
| 1477 | LAB458 | apple\|11v1\|MDPRD004692_P1 | 4764 | 536 | 83.5 | globlastp |
| 1478 | LAB458 | plantago\|11v1\|SRR066373X100810_P1 | 4765 | 536 | 83.5 | globlastp |
| 1479 | LAB458 | vinca\|11v1\|SRR098690X100683_P1 | 4766 | 536 | 83.5 | globlastp |
| 1480 | LAB458 | arabidopsis_lyrata\|09v1\|JGIAL014795_P1 | 4767 | 536 | 83.5 | globlastp |
| 1481 | LAB458 | arabidopsis_lyrata\|09v1\|JGIAL018527_P1 | 4768 | 536 | 83.5 | globlastp |
| 1482 | LAB458 | arabidopsis\|10v1\|AT2G36460_P1 | 4769 | 536 | 83.5 | globlastp |
| 1483 | LAB458 | b_juncea\|10v2\|E6ANDIZ01A1P9R_P1 | 4770 | 536 | 83.5 | globlastp |
| 1484 | LAB458 | b_juncea\|10v2\|E6ANDIZ01A2N5R_P1 | 4770 | 536 | 83.5 | globlastp |
| 1485 | LAB458 | b_rapa\|gb162\|L33566_P1 | 4771 | 536 | 83.5 | globlastp |
| 1486 | LAB458 | canola\|10v1\|CD815000_P1 | 4771 | 536 | 83.5 | globlastp |
| 1487 | LAB458 | canola\|10v1\|CD837817_P1 | 4772 | 536 | 83.5 | globlastp |
| 1488 | LAB458 | catharanthus\|gb166\|EG554564 | 4773 | 536 | 83.5 | globlastp |
| 1489 | LAB458 | kiwi\|gb166\|FG400089_P1 | 4774 | 536 | 83.5 | globlastp |
| 1490 | LAB458 | nasturtium\|10v1\|GH169104_P1 | 4775 | 536 | 83.5 | globlastp |
| 1491 | LAB458 | sunflower\|10v1\|CD852757 | 4776 | 536 | 83.5 | globlastp |
| 1492 | LAB458 | soybean\|11v1\|GLYMA13G21540_P1 | 4777 | 536 | 83.5 | globlastp |
| 1493 | LAB458 | arnica\|11v1\|SRR099034X100515_P1 | 4778 | 536 | 83.2 | globlastp |
| 1494 | LAB458 | arnica\|11v1\|SRR099034X100720_P1 | 4779 | 536 | 83.2 | globlastp |
| 1495 | LAB458 | fagopyrum\|11v1\|SRR063689X102342XX1_P1 | 4780 | 536 | 83.2 | globlastp |
| 1496 | LAB458 | silene\|11v1\|SRR096785X102753_P1 | 4781 | 536 | 83.2 | globlastp |
| 1497 | LAB458 | b_rapa\|gb162\|CV545602_P1 | 4782 | 536 | 83.2 | globlastp |
| 1498 | LAB458 | castorbean\|09v1\|EE255081_P1 | 4783 | 536 | 83.2 | globlastp |
| 1499 | LAB458 | kiwi\|gb166\|FG404653_P1 | 4784 | 536 | 83.2 | globlastp |
| 1500 | LAB458 | potato\|10v1\|BF153977_P1 | 4785 | 536 | 83.2 | globlastp |
| 1501 | LAB458 | solanum_phureja\|09v1\|SPHBG132689 | 4785 | 536 | 83.2 | globlastp |
| 1502 | LAB458 | thalictrum\|11v1\|SRR096787X104743_P1 | 4786 | 536 | 83 | globlastp |
| 1503 | LAB458 | trigonella\|11v1\|SRR066197X430762_P1 | 4787 | 536 | 83 | globlastp |
| 1504 | LAB458 | vinca\|11v1\|SRR098690X102929_P1 | 4788 | 536 | 83 | globlastp |
| 1505 | LAB458 | arabidopsis\|10v1\|AT3G52930_P1 | 4789 | 536 | 83 | globlastp |
| 1506 | LAB458 | canola\|10v1\|CD835639_P1 | 4790 | 536 | 83 | globlastp |
| 1507 | LAB458 | cassava\|09v1\|JGICASSAVA14140M1_P1 | 4791 | 536 | 83 | globlastp |
| 1508 | LAB458 | lettuce\|10v1\|DW064471_P1 | 4792 | 536 | 83 | globlastp |
| 1509 | LAB458 | lotus\|09v1\|AW719994_P1 | 4793 | 536 | 83 | globlastp |
| 1510 | LAB458 | artemisia\|10v1\|EY047545_T1 | 4794 | 536 | 82.96 | glotblastn |
| 1511 | LAB458 | arabidopsis_lyrata\|09v1\|JGIAL020009_T1 | 4795 | 536 | 82.73 | glotblastn |
| 1512 | LAB458 | distylium\|11v1\|SRR065077X105524_P1 | 4796 | 536 | 82.7 | globlastp |
| 1513 | LAB458 | olea\|11v1\|SRRO14463.11041_P1 | 4797 | 536 | 82.7 | globlastp |
| 1514 | LAB458 | coffea\|10v1\|DV663504_P1 | 4798 | 536 | 82.7 | globlastp |
| 1515 | LAB458 | medicago\|09v1\|AI974858_P1 | 4799 | 536 | 82.7 | globlastp |
| 1516 | LAB458 | medicago\|09v1\|LLAI974579_P1 | 4800 | 536 | 82.7 | globlastp |
| 1517 | LAB458 | soybean\|gb168\|BE660126 | 4801 | 536 | 82.7 | globlastp |
| 1518 | LAB458 | apple\|11v1\|MDP0000162204_P1 | 4802 | 536 | 82.6 | globlastp |
| 1519 | LAB458 | cotton\|10v2\|BF268965_P1 | 4803 | 536 | 82.4 | globlastp |
| 1520 | LAB458 | cotton\|10v2\|SRR032367S0158681_T1 | 4804 | 536 | 82.4 | glotblastn |
| 1521 | LAB458 | soybean\|11v1\|GLYMA10G07710_P1 | 4805 | 536 | 82.4 | globlastp |
| 1522 | LAB458 | soybean\|gb168\|AW349238 | 4805 | 536 | 82.4 | globlastp |
| 1523 | LAB458 | soybean\|gb168\|SB2GWP126913 | 4806 | 536 | 82.4 | globlastp |
| 1524 | LAB458 | vinca\|11v1\|SRR098690X102009_P1 | 4807 | 536 | 82.1 | globlastp |
| 1525 | LAB458 | cowpea\|gb166\|FF541685_P1 | 4808 | 536 | 82.1 | globlastp |
| 1526 | LAB458 | cotton\|10v2\|CO112135_P1 | 4809 | 536 | 82.1 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1527 | LAB458 | arabidopsis\|10v1\|AT5G03690_P1 | 4810 | 536 | 81.9 | globlastp |
| 1528 | LAB458 | b_oleracea\|gb161\|AM061891_P1 | 4811 | 536 | 81.9 | globlastp |
| 1529 | LAB458 | canola\|10v1\|CN728005_P1 | 4812 | 536 | 81.9 | globlastp |
| 1530 | LAB458 | chickpea\|09v2\|AB025002_P1 | 4813 | 536 | 81.9 | globlastp |
| 1531 | LAB458 | radish\|gb164\|EV525233 | 4814 | 536 | 81.9 | globlastp |
| 1532 | LAB458 | melon\|10v1\|DV631545_T1 | 4815 | 536 | 81.89 | glotblastn |
| 1533 | LAB458 | senecio\|gb170\|CO553162 | 4816 | 536 | 81.8 | globlastp |
| 1534 | LAB458 | soybean\|11v1\|GLYMA02G38730_P1 | 4817 | 536 | 81.8 | globlastp |
| 1535 | LAB458 | soybean\|gb168\|AL376119 | 4817 | 536 | 81.8 | globlastp |
| 1536 | LAB458 | phyla\|11v1\|SRR099035X111384_P1 | 4818 | 536 | 81.6 | globlastp |
| 1537 | LAB458 | trigonella\|11v1\|SRR066194X382912_P1 | 4819 | 536 | 81.6 | globlastp |
| 1538 | LAB458 | pea\|09v1\|CD860851 | 4820 | 536 | 81.6 | globlastp |
| 1539 | LAB458 | centaurea\|gb166\|EL932792_T1 | 4821 | 536 | 81.56 | glotblastn |
| 1540 | LAB458 | cedrus\|11v1\|SRR065007X100692_P1 | 4822 | 536 | 81.3 | globlastp |
| 1541 | LAB458 | bean\|gb167\|CA896780_P1 | 4823 | 536 | 81.3 | globlastp |
| 1542 | LAB458 | cassava\|09v1\|DV443120_P1 | 4824 | 536 | 81.3 | globlastp |
| 1543 | LAB458 | cotton\|10v2\|AI726428_P1 | 4825 | 536 | 81.3 | globlastp |
| 1544 | LAB458 | marchantia\|gb166\|BJ841094_P1 | 4826 | 536 | 81.3 | globlastp |
| 1545 | LAB458 | oak\|10v1\|CU657139_P1 | 4827 | 536 | 81.3 | globlastp |
| 1546 | LAB458 | sunflower\|10v1\|CD852579 | 4828 | 536 | 81.3 | globlastp |
| 1547 | LAB458 | ipomoea_batatas\|10v1\|CB330228_T1 | 4829 | 536 | 81.28 | glotblastn |
| 1548 | LAB458 | lotus\|09v1\|AV409869_P1 | 4830 | 536 | 81.1 | globlastp |
| 1549 | LAB458 | pigeonpea\|10v1\|GR471244_P1 | 4831 | 536 | 81.1 | globlastp |
| 1550 | LAB458 | cotton\|10v1\|BG444440 | 4832 | 536 | 81.01 | glotblastn |
| 1551 | LAB458 | pea\|11v1\|AJ308123XX1_P1 | 4833 | 536 | 81 | globlastp |
| 1552 | LAB458 | sciadopitys\|10v1\|SRR065035S0007926_P1 | 4834 | 536 | 81 | globlastp |
| 1553 | LAB458 | castorbean\|09v1\|EG656836_P1 | 4835 | 536 | 81 | globlastp |
| 1554 | LAB458 | spruce\|gb162\|CO216032 | 4836 | 536 | 81 | globlastp |
| 1555 | LAB458 | tragopogon\|10v1\|SRR020205S0022415 | 4837 | 536 | 81 | globlastp |
| 1556 | LAB458 | medicago\|09v1\|AW698818_P1 | 4838 | 536 | 80.8 | globlastp |
| 1557 | LAB458 | soybean\|11v1\|GLYMA02G47280_P1 | 4839 | 536 | 80.8 | globlastp |
| 1558 | LAB458 | soybean\|gb168\|AW777056 | 4839 | 536 | 80.8 | globlastp |
| 1559 | LAB458 | soybean\|11v1\|GLYMA14G01470_P1 | 4840 | 536 | 80.8 | globlastp |
| 1560 | LAB458 | soybean\|gb168\|BE322399 | 4840 | 536 | 80.8 | globlastp |
| 1561 | LAB458 | salvia\|10v1\|CV167659 | 4841 | 536 | 80.73 | glotblastn |
| 1562 | LAB458 | maritime_pine\|10v1\|AL750452_P1 | 4842 | 536 | 80.7 | globlastp |
| 1563 | LAB458 | platanus\|11v1\|SRR096786X100252_P1 | 4843 | 536 | 80.7 | globlastp |
| 1564 | LAB458 | pseudotsuga\|10v1\|SRR065119S0008687_P1 | 4844 | 536 | 80.7 | globlastp |
| 1565 | LAB458 | bean\|gb167\|CB280699_P1 | 4845 | 536 | 80.7 | globlastp |
| 1566 | LAB458 | oak\|10v1\|FN726569_P1 | 4846 | 536 | 80.7 | globlastp |
| 1567 | LAB458 | distylium\|11v1\|SRR065077X101970_P1 | 4847 | 536 | 80.4 | globlastp |
| 1568 | LAB458 | eucalyptus\|11v2\|CD668932_P1 | 4848 | 536 | 80.4 | globlastp |
| 1569 | LAB458 | gnetum\|10v1\|CB081662_P1 | 4849 | 536 | 80.4 | globlastp |
| 1570 | LAB458 | eucalyptus\|11v2\|CD668000_P1 | 4850 | 536 | 80.4 | globlastp |
| 1571 | LAB458 | eucalyptus\|gb166\|CD668000 | 4850 | 536 | 80.4 | globlastp |
| 1572 | LAB458 | grape\|gb160\|BM436926_P1 | 4851 | 536 | 80.4 | globlastp |
| 1573 | LAB458 | sunflower\|10v1\|CF081850 | 4852 | 536 | 80.4 | globlastp |
| 1574 | LAB458 | sunflower\|10v1\|DY929197 | 4853 | 536 | 80.4 | globlastp |
| 1575 | LAB458 | abies\|11v2\|SRR098676X103955_P1 | 4854 | 536 | 80.2 | globlastp |
| 1576 | LAB458 | cotton\|10v2\|BG444440_P1 | 4855 | 536 | 80.2 | globlastp |
| 1577 | LAB458 | podocarpus\|10v1\|SRR065014S0000448_P1 | 4856 | 536 | 80.2 | globlastp |
| 1578 | LAB458 | clover\|gb162\|BB902728_P1 | 4857 | 536 | 80.2 | globlastp |
| 1579 | LAB458 | cowpea\|gb166\|FG902694_P1 | 4858 | 536 | 80.2 | globlastp |
| 1580 | LAB458 | lettuce\|10v1\|DW057238_P1 | 4859 | 536 | 80.2 | globlastp |
| 1581 | LAB458 | oak\|10v1\|FN723614_P1 | 4860 | 536 | 80.2 | globlastp |
| 1582 | LAB458 | peanut\|10v1\|GO268612_P1 | 4861 | 536 | 80.2 | globlastp |
| 1583 | LAB458 | prunus\|10v1\|CN877054 | 4862 | 536 | 80.2 | globlastp |
| 1584 | LAB458 | taxus\|10v1\|SRR032523S0006875_T1 | 4863 | 536 | 80.17 | glotblastn |
| 1585 | LAB459 | wheat\|10v2\|AK331287_P1 | 4864 | 537 | 88 | globlastp |
| 1586 | LAB460 | wheat\|10v2\|BG263004_P1 | 4865 | 538 | 94 | globlastp |
| 1587 | LAB460 | wheat\|gb164\|BG263185 | 4866 | 538 | 92.97 | glotblastn |
| 1588 | LAB460 | pseudoroegneria\|gb167\|FF347892 | 4867 | 538 | 92.3 | globlastp |
| 1589 | LAB460 | wheat\|gb164\|BG263004 | 4868 | 538 | 91.85 | glotblastn |
| 1590 | LAB460 | brachypodium\|09v1\|GT813904_P1 | 4869 | 538 | 81 | globlastp |
| 1591 | LAB462 | wheat\|10v2\|BE471001_P1 | 4870 | 540 | 95.6 | globlastp |
| 1592 | LAB462 | wheat\|gb164\|BE471001 | 4871 | 540 | 85.7 | globlastp |
| 1593 | LAB462 | rice\|gb170\|OS07G36180 | 4872 | 540 | 83.5 | globlastp |
| 1594 | LAB464 | millet\|10v1\|EVO454PM011606_P1 | 4873 | 542 | 88.8 | globlastp |
| 1594 | LAB530 | millet\|10v1\|EVO454PM011606_P1 | 4873 | 602 | 84.7 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1595 | LAB464 | wheat\|10v2\|BG604518_P1 | 4874 | 542 | 87.2 | globlastp |
| 1595 | LAB530 | wheat\|10v2\|BG604518_P1 | 4874 | 602 | 89.5 | globlastp |
| 1596 | LAB464 | foxtail_millet\|10v2\|FXTRMSLX00456556D1_P1 | 4875 | 542 | 86.7 | globlastp |
| 1597 | LAB464 | wheat\|gb164\|BG604518 | 4876 | 542 | 86.3 | globlastp |
| 1597 | LAB530 | wheat\|gb164\|BG604518 | 4876 | 602 | 86.7 | globlastp |
| 1598 | LAB464 | brachypodium\|09v1\|GT764209_P1 | 4877 | 542 | 84.7 | globlastp |
| 1598 | LAB530 | brachypodium\|09v1\|GT764209_P1 | 4877 | 602 | 90.8 | globlastp |
| 1599 | LAB464 | maize\|10v1\|AI372361_P1 | 4878 | 542 | 82.8 | globlastp |
| 1599 | LAB530 | maize\|10v1\|AI372361_P1 | 4878 | 602 | 89.4 | globlastp |
| 1600 | LAB464 | sorghum\|09v1\|SB02G043940 | 4879 | 542 | 82.8 | globlastp |
| 1600 | LAB530 | sorghum\|09v1\|SB02G043940 | 4879 | 602 | 90 | globlastp |
| 1601 | LAB466 | barley\|10v1\|BE060901 | 4880 | 544 | 83.6 | globlastp |
| 1602 | LAB466 | barley\|10v2\|BE060901_P1 | 4881 | 544 | 81.3 | globlastp |
| 1603 | LAB474 | wheat\|10v2\|BE400489_P1 | 4882 | 552 | 95 | globlastp |
| 1604 | LAB474 | brachypodium\|09v1\|GT783956_P1 | 4883 | 552 | 84.2 | globlastp |
| 1605 | LAB478 | barley\|10v2\|BJ463421_P1 | 4884 | 556 | 80.9 | globlastp |
| 1606 | LAB481 | cotton\|10v1\|AI726546 | 4885 | 559 | 96.5 | globlastp |
| 1607 | LAB481 | cotton\|10v2\|AF009568_P1 | 4886 | 559 | 96.4 | globlastp |
| 1608 | LAB481 | cotton\|10v1\|BF272973 | 4887 | 559 | 96.4 | globlastp |
| 1609 | LAB481 | cotton\|10v2\|BF277102_T1 | 4888 | 559 | 96.36 | glotblastn |
| 1610 | LAB481 | cotton\|10v1\|CO081040 | 4889 | 559 | 96.2 | globlastp |
| 1611 | LAB481 | cotton\|10v2\|BF272973_P1 | 4890 | 559 | 96.1 | globlastp |
| 1612 | LAB481 | orange\|11v1\|CF509797_P1 | 4891 | 559 | 94.3 | globlastp |
| 1613 | LAB481 | castorbean\|09v1\|EE259341_P1 | 4892 | 559 | 94.3 | globlastp |
| 1614 | LAB481 | clementine\|11v1\|CF509797_P1 | 4893 | 559 | 94 | globlastp |
| 1615 | LAB481 | tobacco\|gb162\|X83730 | 4894 | 559 | 93.2 | globlastp |
| 1616 | LAB481 | kiwi\|gb166\|FG403367_P1 | 4895 | 559 | 93.1 | globlastp |
| 1617 | LAB481 | soybean\|11v1\|GLYMA13G23170_P1 | 4896 | 559 | 93.1 | globlastp |
| 1618 | LAB481 | soybean\|gb168\|VRU31467 | 4896 | 559 | 93.1 | globlastp |
| 1619 | LAB481 | cowpea\|gb166\|VRU31467_P1 | 4897 | 559 | 93 | globlastp |
| 1620 | LAB481 | soybean\|11v1\|GLYMA17G11710_T1 | 4898 | 559 | 92.99 | glotblastn |
| 1621 | LAB481 | soybean\|gb168\|AA660838 | 4898 | 559 | 92.99 | glotblastn |
| 1622 | LAB481 | cassava\|09v1\|CK643668_P1 | 4899 | 559 | 92.7 | globlastp |
| 1623 | LAB481 | cassava\|09v1\|DV441675_P1 | 4900 | 559 | 92.7 | globlastp |
| 1624 | LAB481 | oak\|10v1\|SRR006307S0022134_P1 | 4901 | 559 | 92.5 | globlastp |
| 1625 | LAB481 | soybean\|11v1\|GLYMA08G22880_P1 | 4902 | 559 | 92.5 | globlastp |
| 1626 | LAB481 | soybean\|gb168\|AW349704 | 4902 | 559 | 92.5 | globlastp |
| 1627 | LAB481 | soybean\|11v1\|GLYMA07G03220_P1 | 4903 | 559 | 92.5 | globlastp |
| 1628 | LAB481 | soybean\|gb168\|CD393926 | 4903 | 559 | 92.5 | globlastp |
| 1629 | LAB481 | amsonia\|11v1\|SRR098688X104538_P1 | 4904 | 559 | 92.3 | globlastp |
| 1630 | LAB481 | chestnut\|gb170\|SRR006295S0008739_P1 | 4905 | 559 | 92.3 | globlastp |
| 1631 | LAB481 | prunus\|10v1\|CN488670 | 4906 | 559 | 92.2 | globlastp |
| 1632 | LAB481 | tripterygium\|11v1\|SRR098677X111961_P1 | 4907 | 559 | 92.1 | globlastp |
| 1633 | LAB481 | cotton\|10v1\|CO088859 | 4908 | 559 | 91.9 | globlastp |
| 1634 | LAB481 | aristolochia\|10v1\|SRR039082S0081620_P1 | 4909 | 559 | 91.8 | globlastp |
| 1635 | LAB481 | medicago\|09v1\|AA660838_P1 | 4910 | 559 | 91.8 | globlastp |
| 1636 | LAB481 | oak\|10v1\|CU640285_P1 | 4911 | 559 | 91.8 | globlastp |
| 1637 | LAB481 | potato\|10v1\|BG351257_P1 | 4912 | 559 | 91.7 | globlastp |
| 1638 | LAB481 | solanum_phureja\|09v1\|SPHBG127993 | 4912 | 559 | 91.7 | globlastp |
| 1639 | LAB481 | tomato\|09v1\|BG127993 | 4913 | 559 | 91.7 | globlastp |
| 1640 | LAB481 | tomato\|10v1\|X83728_P1 | 4913 | 559 | 91.7 | globlastp |
| 1641 | LAB481 | tripterygium\|11v1\|SRR098677X100748_P1 | 4914 | 559 | 91.6 | globlastp |
| 1642 | LAB481 | vinca\|11v1\|SRR098690X113425_P1 | 4915 | 559 | 91.6 | globlastp |
| 1643 | LAB481 | cotton\|10v2\|SRR032367S0004034_P1 | 4916 | 559 | 91.6 | globlastp |
| 1644 | LAB481 | tomato\|09v1\|BG133975 | 4917 | 559 | 91.6 | globlastp |
| 1645 | LAB481 | tomato\|10v1\|BG133975_P1 | 4917 | 559 | 91.6 | globlastp |
| 1646 | LAB481 | orobanche\|10v1\|SRR023189S0005882_P1 | 4918 | 559 | 91.4 | globlastp |
| 1647 | LAB481 | solanum_phureja\|09v1\|SPHBG133975 | 4919 | 559 | 91.4 | globlastp |
| 1648 | LAB481 | trigonella\|11v1\|SRR066194X111116_P1 | 4920 | 559 | 91.2 | globlastp |
| 1649 | LAB481 | cotton\|10v1\|CO076233 | 4921 | 559 | 91.2 | globlastp |
| 1650 | LAB481 | oak\|10v1\|FP033843_P1 | 4922 | 559 | 91.2 | globlastp |
| 1651 | LAB481 | eucalyptus\|11v2\|CT980875_P1 | 4923 | 559 | 91.1 | globlastp |
| 1652 | LAB481 | euphorbia\|11v1\|BG459109_P1 | 4924 | 559 | 91.1 | globlastp |
| 1653 | LAB481 | tobacco\|gb162\|X83728 | 4925 | 559 | 91.1 | globlastp |
| 1654 | LAB481 | beet\|gb162\|BF011063_P1 | 4926 | 559 | 91 | globlastp |
| 1655 | LAB481 | cucumber\|09v1\|AA660118_P1 | 4927 | 559 | 90.9 | globlastp |
| 1656 | LAB481 | cotton\|10v2\|SRR032367S0045221_P1 | 4928 | 559 | 90.8 | globlastp |
| 1657 | LAB481 | melon\|10v1\|DV631579_P1 | 4929 | 559 | 90.8 | globlastp |
| 1658 | LAB481 | triphysaria\|10v1\|BM357294 | 4930 | 559 | 90.6 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1659 | LAB481 | cacao\|10v1\|CF973552_T1 | 4931 | 559 | 90.57 | glotblastn |
| 1660 | LAB481 | chestnut\|gb170\|SRR006295S0010458_P1 | 4932 | 559 | 90.4 | globlastp |
| 1661 | LAB481 | clementine\|11v1\|CX047553_P1 | 4933 | 559 | 90 | globlastp |
| 1662 | LAB481 | orange\|11v1\|CX047553_P1 | 4934 | 559 | 90 | globlastp |
| 1663 | LAB481 | triphysaria\|10v1\|DR173825 | 4935 | 559 | 90 | globlastp |
| 1664 | LAB481 | orobanche\|10v1\|SRR023189S0007167_P1 | 4936 | 559 | 89.8 | globlastp |
| 1665 | LAB481 | silene\|11v1\|SRR096785X112917_P1 | 4937 | 559 | 89.6 | globlastp |
| 1666 | LAB481 | sunflower\|10v1\|DY905308 | 4938 | 559 | 89.6 | globlastp |
| 1667 | LAB481 | monkeyflower\|10v1\|DV208867_P1 | 4939 | 559 | 89.4 | globlastp |
| 1668 | LAB481 | monkeyflower\|10v1\|GO944535_P1 | 4940 | 559 | 89.4 | globlastp |
| 1669 | LAB481 | rice\|gb170\|OS02G09150 | 4941 | 559 | 89.4 | globlastp |
| 1670 | LAB481 | sunflower\|10v1\|CD847398 | 4942 | 559 | 89.4 | globlastp |
| 1671 | LAB481 | nasturtium\|10v1\|GH162817_T1 | 4943 | 559 | 89.22 | glotblastn |
| 1672 | LAB481 | distylium\|11v1\|SRR065077X102295_P1 | 4944 | 559 | 89.2 | globlastp |
| 1673 | LAB481 | taxus\|10v1\|SRR032523S0001870_P1 | 4945 | 559 | 89.2 | globlastp |
| 1674 | LAB481 | sunflower\|10v1\|CD848206 | 4946 | 559 | 89.2 | globlastp |
| 1675 | LAB481 | beet\|gb162\|BE590400_P1 | 4947 | 559 | 89.1 | globlastp |
| 1676 | LAB481 | plantago\|11v1\|SRR066373X104842_P1 | 4948 | 559 | 89 | globlastp |
| 1677 | LAB481 | silene\|11v1\|SRR096785X112300_P1 | 4949 | 559 | 89 | globlastp |
| 1678 | LAB481 | rice\|gb170\|OS06G43660 | 4950 | 559 | 89 | globlastp |
| 1679 | LAB481 | thellungiella\|gb167\|AY436553 | 4951 | 559 | 89 | globlastp |
| 1680 | LAB481 | maize\|10v1\|BG265229_P1 | 4952 | 559 | 88.9 | globlastp |
| 1681 | LAB481 | maize\|10v1\|AI612448_T1 | 4953 | 559 | 88.7 | glotblastn |
| 1682 | LAB481 | sorghum\|09v1\|SB04G005710 | 4954 | 559 | 88.6 | globlastp |
| 1683 | LAB481 | arabidopsis_lyrata\|09v1\|JGIAL001652_P1 | 4955 | 559 | 88.5 | globlastp |
| 1684 | LAB481 | arabidopsis\|10v1\|AT1G15690_P1 | 4956 | 559 | 88.5 | globlastp |
| 1685 | LAB481 | chelidonium\|11v1\|SRR084752X100155_T1 | 4957 | 559 | 88.44 | glotblastn |
| 1686 | LAB481 | maize\|10v1\|W21635_P1 | 4958 | 559 | 88.3 | globlastp |
| 1687 | LAB481 | maize\|10v1\|AA979892_P1 | 4959 | 559 | 88.2 | globlastp |
| 1688 | LAB481 | maize\|10v1\|BM079943_P1 | 4960 | 559 | 88.2 | globlastp |
| 1689 | LAB481 | b_rapa\|gb162\|BG543565_T1 | 4961 | 559 | 88.05 | glotblastn |
| 1690 | LAB481 | monkeyflower\|10v1\|CV520128_P1 | 4962 | 559 | 87.9 | globlastp |
| 1691 | LAB481 | millet\|10v1\|EVO454PM000144_T1 | 4963 | 559 | 87.84 | glotblastn |
| 1692 | LAB481 | monkeyflower\|10v1\|DV206850_P1 | 4964 | 559 | 87.5 | globlastp |
| 1693 | LAB481 | brachypodium\|09v1\|DV474968_P1 | 4965 | 559 | 87 | globlastp |
| 1694 | LAB481 | barley\|10v2\|BE413106_P1 | 4966 | 559 | 86.7 | globlastp |
| 1695 | LAB481 | oat\|10v2\|CN817269_P1 | 4967 | 559 | 86.5 | globlastp |
| 1696 | LAB481 | foxtail_millet\|10v2\|OXEC611994T1_T1 | 4968 | 559 | 86.49 | glotblastn |
| 1697 | LAB481 | barley\|10v1\|BE413106 | 4969 | 559 | 86.49 | glotblastn |
| 1698 | LAB481 | wheat\|gb164\|BE428281 | 4970 | 559 | 86.3 | globlastp |
| 1699 | LAB481 | plantago\|11v1\|SRR066373X101178_P1 | 4971 | 559 | 86.1 | globlastp |
| 1700 | LAB481 | zostera\|10v1\|AM770742_P1 | 4972 | 559 | 86 | globlastp |
| 1701 | LAB481 | podocarpus\|10v1\|SRR065014S0004368_P1 | 4973 | 559 | 85.4 | globlastp |
| 1702 | LAB481 | millet\|10v1\|EVO454PM052717_T1 | 4974 | 559 | 84.66 | glotblastn |
| 1703 | LAB481 | poplar\|10v1\|BU817235_P1 | 4975 | 559 | 83.8 | globlastp |
| 1704 | LAB481 | grape\|gb160\|AF192308_P1 | 4976 | 559 | 83.5 | globlastp |
| 1705 | LAB481 | prunus\|10v1\|AF367447 | 4977 | 559 | 83.5 | globlastp |
| 1706 | LAB481 | poplar\|10v1\|BI122033_P1 | 4978 | 559 | 83.4 | globlastp |
| 1707 | LAB481 | eucalyptus\|11v2\|ES588492_P1 | 4979 | 559 | 83.3 | globlastp |
| 1708 | LAB481 | cacao\|10v1\|CA796984_P1 | 4980 | 559 | 83.1 | globlastp |
| 1709 | LAB481 | kiwi\|gb166\|FG397352_P1 | 4981 | 559 | 83.1 | globlastp |
| 1710 | LAB481 | cassava\|09v1\|DV441776_P1 | 4982 | 559 | 83 | globlastp |
| 1711 | LAB481 | castorbean\|09v1\|GE633029_P1 | 4983 | 559 | 83 | globlastp |
| 1712 | LAB481 | eucalyptus\|gb166\|ES588492 | 4984 | 559 | 83 | globlastp |
| 1713 | LAB481 | cotton\|10v2\|ES834967_P1 | 4985 | 559 | 82.9 | globlastp |
| 1714 | LAB481 | strawberry\|11v1\|CO380087_P1 | 4986 | 559 | 82.9 | globlastp |
| 1715 | LAB481 | oak\|10v1\|CU640062_P1 | 4987 | 559 | 82.7 | globlastp |
| 1716 | LAB481 | cotton\|10v2\|SRR032367S0008632_P1 | 4988 | 559 | 82.7 | globlastp |
| 1717 | LAB481 | cotton\|10v1\|DN803729 | 4989 | 559 | 82.41 | glotblastn |
| 1718 | LAB481 | chestnut\|gb170\|SRR006295S0027715_P1 | 4990 | 559 | 82.3 | globlastp |
| 1719 | LAB481 | cotton\|10v2\|SRR032367S0092592_T1 | 4991 | 559 | 82.15 | glotblastn |
| 1720 | LAB481 | cotton\|10v2\|CO087099_P1 | 4992 | 559 | 81.9 | globlastp |
| 1721 | LAB481 | cassava\|09v1\|JGICASSAVA16446M1_P1 | 4993 | 559 | 81.8 | globlastp |
| 1722 | LAB481 | millet\|10v1\|EVO454PM019835_T1 | 4994 | 559 | 81.69 | glotblastn |
| 1723 | LAB481 | cotton\|10v2\|SRR032367S0036220_T1 | 4995 | 559 | 81.56 | glotblastn |
| 1724 | LAB481 | euonymus\|11v1\|SRR070038X106104_P1 | 4996 | 559 | 81.5 | globlastp |
| 1725 | LAB481 | gnetum\|10v1\|CB081867_P1 | 4997 | 559 | 80.9 | globlastp |
| 1726 | LAB481 | soybean\|11v1\|GLYMA20G23070_P1 | 4998 | 559 | 80.8 | globlastp |
| 1727 | LAB481 | soybean\|gb168\|SB2GWP053332 | 4998 | 559 | 80.8 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1728 | LAB481 | sorghum\|09v1\|SB10G025280 | 4999 | 559 | 80.19 | glotblastn |
| 1729 | LAB481 | taxus\|10v1\|SRR032523S0004490_T1 | 5000 | 559 | 80.17 | glotblastn |
| 1730 | LAB482 | phyla\|11v1\|SRR099035X148666_P1 | 5001 | 560 | 81.2 | globlastp |
| 1731 | LAB482 | antirrhinum\|gb166\|AJ792508_P1 | 5002 | 560 | 80.9 | globlastp |
| 1732 | LAB482 | cotton\|10v2\|BQ405024_P1 | 5003 | 560 | 80.5 | globlastp |
| 1733 | LAB482 | cassava\|09v1\|CK649746_P1 | 5004 | 560 | 80.3 | globlastp |
| 1734 | LAB482 | poplar\|10v1\|AI162720_P1 | 5005 | 560 | 80.3 | globlastp |
| 1735 | LAB483 | cacao\|10v1\|CU478418_P1 | 5006 | 561 | 85.4 | globlastp |
| 1736 | LAB483 | heritiera\|10v1\|SRR005794S0001053_P1 | 5007 | 561 | 81.5 | globlastp |
| 1737 | LAB483 | cotton\|10v1\|BE052876 | 5008 | 561 | 80.1 | globlastp |
| 1738 | LAB483 | cotton\|10v2\|BE052876_P1 | 5008 | 561 | 80.1 | globlastp |
| 1739 | LAB484 | cacao\|10v1\|ES440806_P1 | 5009 | 562 | 88.4 | globlastp |
| 1740 | LAB484 | humulus\|11v1\|SRR098687X115804_P1 | 5010 | 562 | 86.8 | globlastp |
| 1741 | LAB484 | heritiera\|10v1\|SRR005794S0001702_P1 | 5011 | 562 | 86.8 | globlastp |
| 1742 | LAB484 | papaya\|gb165\|AM903643_P1 | 5012 | 562 | 85.7 | globlastp |
| 1743 | LAB484 | oak\|10v1\|SRR006307S0036070_P1 | 5013 | 562 | 85.2 | globlastp |
| 1744 | LAB484 | cassava\|09v1\|DB942971_P1 | 5014 | 562 | 83.8 | globlastp |
| 1745 | LAB484 | humulus\|11v1\|GD253421_P1 | 5015 | 562 | 83.6 | globlastp |
| 1746 | LAB484 | strawberry\|11v1\|SRR034866S0028966_P1 | 5016 | 562 | 83.2 | globlastp |
| 1747 | LAB484 | euonymus\|11v1\|SRR070038X10950_P1 | 5017 | 562 | 82.5 | globlastp |
| 1748 | LAB484 | kiwi\|gb166\|FG405279_P1 | 5018 | 562 | 82.5 | globlastp |
| 1749 | LAB484 | prunus\|10v1\|CN489228 | 5019 | 562 | 82.5 | globlastp |
| 1750 | LAB484 | apple\|gb171\|CN489228 | 5020 | 562 | 81.8 | globlastp |
| 1751 | LAB484 | poplar\|10v1\|AI162287_P1 | 5021 | 562 | 81.5 | globlastp |
| 1752 | LAB484 | apple\|11v1\|CN489228_P1 | 5022 | 562 | 81.2 | globlastp |
| 1753 | LAB484 | castorbean\|09v1\|XM002513747_P1 | 5023 | 562 | 80.5 | globlastp |
| 1754 | LAB484 | eucalyptus\|11v2\|CT984609_T1 | 5024 | 562 | 80.42 | glotblastn |
| 1755 | LAB484 | euphorbia\|11v1\|SRR098678X159369_P1 | 5025 | 562 | 80.4 | globlastp |
| 1756 | LAB485 | cotton\|10v2\|DN802824_T1 | 5026 | 563 | 99.84 | glotblastn |
| 1757 | LAB486 | cotton\|10v2\|DT543569_P1 | 5027 | 564 | 96.4 | globlastp |
| 1758 | LAB489 | cotton\|10v2\|SRR032368S0260783_P1 | 5028 | 567 | 99.4 | globlastp |
| 1759 | LAB489 | cotton\|10v1\|SRR032799S0349345 | 5029 | 567 | 86.6 | globlastp |
| 1760 | LAB490 | cotton\|10v2\|DW493181_P1 | 5030 | 568 | 99.7 | globlastp |
| 1761 | LAB492 | cotton\|10v2\|CO127471_P1 | 5031 | 570 | 99.6 | globlastp |
| 1762 | LAB493 | cacao\|10v1\|CU517669_P1 | 5032 | 571 | 83.7 | globlastp |
| 1763 | LAB494 | cotton\|10v2\|DT545208_P1 | 5033 | 572 | 98.3 | globlastp |
| 1764 | LAB494 | cacao\|10v1\|CU469967_P1 | 5034 | 572 | 82.5 | globlastp |
| 1765 | LAB498 | cotton\|10v2\|DN801422_P1 | 5035 | 575 | 90.5 | globlastp |
| 1766 | LAB498 | cotton\|10v1\|CO076923 | 5035 | 575 | 90.5 | globlastp |
| 1767 | LAB498 | cotton\|10v2\|SRR032877S0318264_P1 | 5036 | 575 | 88.9 | globlastp |
| 1768 | LAB498 | cotton\|10v2\|SRR032799S0045008_T1 | — | 575 | 87.5 | glotblastn |
| 1769 | LAB498 | blueberry\|10v1\|CV090317_P1 | 5037 | 575 | 81.2 | globlastp |
| 1770 | LAB498 | cacao\|10v1\|CA794723_P1 | 5038 | 575 | 81 | globlastp |
| 1771 | LAB498 | pteridium\|11v1\|SRR043594X101655_P1 | 5038 | 575 | 81 | globlastp |
| 1772 | LAB498 | cacao\|gb167\|CA794723 | 5038 | 575 | 81 | globlastp |
| 1773 | LAB498 | heritiera\|10v1\|SRR005795S0005772_P1 | 5039 | 575 | 81 | globlastp |
| 1774 | LAB499 | cacao\|10v1\|CA795630_P1 | 5040 | 576 | 95.3 | globlastp |
| 1775 | LAB499 | cacao\|gb167\|CA795630 | 5041 | 576 | 95 | globlastp |
| 1776 | LAB499 | melon\|10v1\|AM729987_P1 | 5042 | 576 | 89.8 | globlastp |
| 1777 | LAB499 | euonymus\|11v1\|SRR070038X118659_P1 | 5043 | 576 | 89.6 | globlastp |
| 1778 | LAB499 | apple\|11v1\|CN495453_P1 | 5044 | 576 | 89.5 | globlastp |
| 1779 | LAB499 | pigeonpea\|10v1\|SRR054580S0008053_P1 | 5045 | 576 | 89.5 | globlastp |
| 1780 | LAB499 | prunus\|10v1\|BU044669 | 5046 | 576 | 89.5 | globlastp |
| 1781 | LAB499 | cowpea\|gb166\|FF386018_P1 | 5047 | 576 | 89 | globlastp |
| 1782 | LAB499 | cucumber\|09v1\|CK085877_P1 | 5048 | 576 | 88.9 | globlastp |
| 1783 | LAB499 | eucalyptus\|11v2\|CB009716_P1 | 5049 | 576 | 88.7 | globlastp |
| 1784 | LAB499 | soybean\|11v1\|GLYMA07G20400_P1 | 5050 | 576 | 88.7 | globlastp |
| 1785 | LAB499 | soybean\|gb168\|AW685489 | 5050 | 576 | 88.7 | globlastp |
| 1786 | LAB499 | chestnut\|gb170\|SRR006295S0000111_P1 | 5051 | 576 | 88.6 | globlastp |
| 1787 | LAB499 | cucurbita\|11v1\|FG227654_P1 | 5052 | 576 | 88.5 | globlastp |
| 1788 | LAB499 | eucalyptus\|11v2\|SRR001660X312472_P1 | 5053 | 576 | 88.1 | globlastp |
| 1789 | LAB499 | oak\|10v1\|CU639758_P1 | 5054 | 576 | 88.1 | globlastp |
| 1790 | LAB499 | trigonella\|11v1\|SRR066194X185094_P1 | 5055 | 576 | 88 | globlastp |
| 1791 | LAB499 | tripterygium\|11v1\|SRR098677X102656_P1 | 5056 | 576 | 88 | globlastp |
| 1792 | LAB499 | lotus\|09v1\|BI419810_P1 | 5057 | 576 | 88 | globlastp |
| 1793 | LAB499 | soybean\|11v1\|GLYMA20G01010_P1 | 5058 | 576 | 88 | globlastp |
| 1794 | LAB499 | soybean\|gb168\|AW328937 | 5058 | 576 | 88 | globlastp |
| 1795 | LAB499 | poplar\|10v1\|BI119865_P1 | 5059 | 576 | 87.7 | globlastp |
| 1796 | LAB499 | medicago\|09v1\|AI974685_P1 | 5060 | 576 | 87.5 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1797 | LAB499 | cassava\|09v1\|CK643285_P1 | 5061 | 576 | 87 | globlastp |
| 1798 | LAB499 | vinca\|11v1\|SRR098690X106362_P1 | 5062 | 576 | 86.7 | globlastp |
| 1799 | LAB499 | nasturtium\|10v1\|SRR032558S0000407_P1 | 5063 | 576 | 86.5 | globlastp |
| 1800 | LAB499 | euphorbia\|11v1\|BI993469XX2_P1 | 5064 | 576 | 86.4 | globlastp |
| 1801 | LAB499 | amsonia\|11v1\|SRR098688X101312_P1 | 5065 | 576 | 86.2 | globlastp |
| 1802 | LAB499 | chelidonium\|11v1\|SRR084752X106241_P1 | 5066 | 576 | 85.4 | globlastp |
| 1803 | LAB499 | cassava\|09v1\|CK643058_P1 | 5067 | 576 | 85.4 | globlastp |
| 1804 | LAB499 | radish\|gb164\|EW732421 | 5068 | 576 | 84.2 | globlastp |
| 1805 | LAB499 | canola\|10v1\|CD827162_P1 | 5069 | 576 | 84.1 | globlastp |
| 1806 | LAB499 | canola\|10v1\|CD824916_P1 | 5070 | 576 | 84 | globlastp |
| 1807 | LAB499 | arabidopsis_lyrata\|09v1\|JGIAL007930_P1 | 5071 | 576 | 83.8 | globlastp |
| 1808 | LAB499 | arabidopsis\|10v1\|AT1G20950_P1 | 5072 | 576 | 83.8 | globlastp |
| 1809 | LAB499 | arabidopsis_lyrata\|09v1\|JGIAL002216_P1 | 5073 | 576 | 83.2 | globlastp |
| 1810 | LAB499 | arabidopsis\|10v1\|AT1G76550_P1 | 5074 | 576 | 82.8 | globlastp |
| 1811 | LAB499 | vinca\|11v1\|SRR098690X138381_P1 | 5075 | 576 | 82.5 | globlastp |
| 1812 | LAB499 | foxtail_millet\|10v2\|OXFXTRMSLX00257796D1T1_P1 | 5076 | 576 | 81.3 | globlastp |
| 1813 | LAB499 | millet\|10v1\|EVO454PM002516_P1 | 5077 | 576 | 81.2 | globlastp |
| 1814 | LAB499 | switchgrass\|gb167\|FE604860 | 5078 | 576 | 81.2 | globlastp |
| 1815 | LAB499 | rice\|gb170\|OS02G48360 | 5079 | 576 | 81 | globlastp |
| 1816 | LAB499 | sorghum\|09v1\|SB04G030000 | 5080 | 576 | 80.6 | globlastp |
| 1817 | LAB499 | sugarcane\|10v1\|CA068589 | 5081 | 576 | 80.5 | globlastp |
| 1818 | LAB499 | zostera\|10v1\|SRR057351S0059301_P1 | 5082 | 576 | 80.4 | globlastp |
| 1819 | LAB499 | rice\|gb170\|OS06G22060 | 5083 | 576 | 80.2 | globlastp |
| 1820 | LAB499 | maize\|10v1\|AI600747_T1 | 5084 | 576 | 80.19 | glotblastn |
| 1821 | LAB499 | switchgrass\|gb167\|FL704259 | 5085 | 576 | 80.19 | glotblastn |
| 1822 | LAB499 | maize\|10v1\|AI444734_P1 | 5086 | 576 | 80 | globlastp |
| 1823 | LAB500 | cacao\|10v1\|CU487640_P1 | 5087 | 577 | 85.8 | globlastp |
| 1824 | LAB502 | cassava\|09v1\|CK643529_P1 | 5088 | 579 | 93.1 | globlastp |
| 1825 | LAB502 | grape\|gb160\|BQ793761_P1 | 5089 | 579 | 91.3 | globlastp |
| 1826 | LAB502 | rice\|gb170\|OS08G45010 | 5090 | 579 | 89.3 | globlastp |
| 1827 | LAB502 | foxtail_millet\|10v2\|SICRP017280_P1 | 5091 | 579 | 89.1 | globlastp |
| 1828 | LAB502 | sorghum\|09v1\|SB08G012980 | 5092 | 579 | 88.9 | globlastp |
| 1829 | LAB502 | maize\|10v1\|AW066961_P1 | 5093 | 579 | 88.3 | globlastp |
| 1830 | LAB502 | maize\|10v1\|BG316809_P1 | 5094 | 579 | 87.9 | globlastp |
| 1831 | LAB502 | switchgrass\|gb167\|DN147398 | 5095 | 579 | 86.93 | glotblastn |
| 1832 | LAB502 | silene\|11v1\|SRR096785X100317_P1 | 5096 | 579 | 86.8 | globlastp |
| 1833 | LAB502 | cycas\|gb166\|CB088881_P1 | 5097 | 579 | 86.6 | globlastp |
| 1834 | LAB502 | sciadopitys\|10v1\|SRR065035S0004853_P1 | 5098 | 579 | 86.4 | globlastp |
| 1835 | LAB502 | rice\|gb170\|OS09G39910 | 5099 | 579 | 86.3 | globlastp |
| 1836 | LAB502 | maritime_pine\|10v1\|AL749760_P1 | 5100 | 579 | 86.2 | globlastp |
| 1837 | LAB502 | pine\|10v1\|AA739530 | 5101 | 579 | 86.2 | globlastp |
| 1838 | LAB502 | spruce\|gb162\|CO222579 | 5102 | 579 | 85.9 | globlastp |
| 1839 | LAB502 | cedrus\|11v1\|SRR065007X101901_T1 | 5103 | 579 | 85.86 | glotblastn |
| 1840 | LAB502 | arabidopsis_lyrata\|09v1\|JGIAL030697_P1 | 5104 | 579 | 85.8 | globlastp |
| 1841 | LAB502 | arabidopsis\|10v1\|AT5G60790_P1 | 5105 | 579 | 85.8 | globlastp |
| 1842 | LAB502 | millet\|10v1\|EVO454PM000810_P1 | 5106 | 579 | 85.4 | globlastp |
| 1843 | LAB502 | pseudotsuga\|10v1\|SRR065119S0003973_T1 | 5107 | 579 | 85.36 | glotblastn |
| 1844 | LAB502 | pine\|10v2\|BX252128_T1 | 5108 | 579 | 85.19 | glotblastn |
| 1845 | LAB502 | wheat\|10v2\|BQ238261_T1 | 5109 | 579 | 85.12 | glotblastn |
| 1846 | LAB502 | zostera\|10v1\|SRR057351S0028409_T1 | 5110 | 579 | 84.76 | glotblastn |
| 1847 | LAB502 | canola\|10v1\|CD825416_T1 | 5111 | 579 | 84.62 | glotblastn |
| 1848 | LAB502 | canola\|10v1\|CD835952_P1 | 5112 | 579 | 84.6 | globlastp |
| 1849 | LAB502 | abies\|11v2\|SRR098676X100005_P1 | 5113 | 579 | 84.4 | globlastp |
| 1850 | LAB502 | canola\|10v1\|CD833218_P1 | 5114 | 579 | 84.3 | globlastp |
| 1851 | LAB502 | artemisia\|10v1\|EY040224_P1 | 5115 | 579 | 81.9 | globlastp |
| 1852 | LAB504 | sorghum\|09v1\|SB09G008170 | 5116 | 581 | 87.5 | globlastp |
| 1853 | LAB505 | wheat\|gb164\|CA625895 | 5117 | 582 | 99 | globlastp |
| 1854 | LAB506 | sorghum\|09v1\|SB04G033230 | 5118 | 583 | 97.7 | globlastp |
| 1855 | LAB506 | sugarcane\|10v1\|BQ535519 | 5119 | 583 | 97.7 | globlastp |
| 1856 | LAB506 | switchgrass\|gb167\|FE622399 | 5120 | 583 | 97 | globlastp |
| 1857 | LAB506 | foxtail_millet\|10v2\|FXTRMSLX00100542D1_P1 | 5121 | 583 | 96.6 | globlastp |
| 1858 | LAB506 | wheat\|10v2\|BE406004_P1 | 5122 | 583 | 92.2 | globlastp |
| 1859 | LAB506 | wheat\|gb164\|BE406004 | 5122 | 583 | 92.2 | globlastp |
| 1860 | LAB506 | millet\|10v1\|EVO454PM010828_P1 | 5123 | 583 | 91.4 | globlastp |
| 1861 | LAB506 | rice\|gb170\|OS02G43590 | 5124 | 583 | 91.1 | globlastp |
| 1862 | LAB506 | brachypodium\|09v1\|DV469963_P1 | 5125 | 583 | 90.7 | globlastp |
| 1863 | LAB506 | fescue\|gb161\|DT684550_P1 | 5126 | 583 | 90.7 | globlastp |
| 1864 | LAB506 | leymus\|gb166\|EG390153_P1 | 5127 | 583 | 90.7 | globlastp |
| 1865 | LAB506 | millet\|10v1\|EVO454PM033075_P1 | 5128 | 583 | 82.4 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1866 | LAB506 | maize\|10v1\|AI944284_P1 | 5129 | 583 | 82 | globlastp |
| 1867 | LAB506 | switchgrass\|gb167\|FL794039 | 5130 | 583 | 81.6 | globlastp |
| 1868 | LAB506 | sorghum\|09v1\|SB06G024230 | 5131 | 583 | 80.8 | globlastp |
| 1869 | LAB506 | wheat\|10v2\|BE404821_P1 | 5132 | 583 | 80.4 | globlastp |
| 1870 | LAB506 | wheat\|gb164\|BE404821 | 5132 | 583 | 80.4 | globlastp |
| 1871 | LAB506 | rice\|gb170\|OS04G46079 | 5133 | 583 | 80.1 | globlastp |
| 1872 | LAB507 | sorghum\|09v1\|SB01G002400 | 5134 | 584 | 87.5 | globlastp |
| 1873 | LAB507 | switchgrass\|gb167\|FE598758 | 5135 | 584 | 84.2 | globlastp |
| 1874 | LAB508 | sorghum\|09v1\|SB04G021400 | 5136 | 585 | 90 | globlastp |
| 1875 | LAB508 | millet\|10v1\|EVO454PM017951_P1 | 5137 | 585 | 87.1 | globlastp |
| 1876 | LAB509 | sorghum\|09v1\|SB01G004240 | 5138 | 586 | 86.2 | globlastp |
| 1877 | LAB510 | sorghum\|09v1\|SB03G043040 | 5139 | 587 | 96 | globlastp |
| 1878 | LAB510 | maize\|10v1\|AI649953_P1 | 5140 | 587 | 94.8 | globlastp |
| 1879 | LAB510 | switchgrass\|gb167\|FE658308 | 5141 | 587 | 92.05 | glotblastn |
| 1880 | LAB510 | rice\|gb170\|OS01G67720 | 5142 | 587 | 86.9 | globlastp |
| 1881 | LAB510 | wheat\|10v2\|BF200834XX2_T1 | 5143 | 587 | 85.56 | glotblastn |
| 1882 | LAB510 | brachypodium\|09v1\|GT819105_P1 | 5144 | 587 | 85.4 | globlastp |
| 1883 | LAB510 | wheat\|gb164\|BF200834 | 5145 | 587 | 85.4 | globlastp |
| 1884 | LAB510 | barley\|10v2\|BU992651_T1 | 5146 | 587 | 84.16 | glotblastn |
| 1885 | LAB511 | sorghum\|09v1\|SB06G031180 | 5147 | 588 | 84.1 | globlastp |
| 1886 | LAB511 | maize\|10v1\|CD970855_P1 | 5148 | 588 | 82.1 | globlastp |
| 1887 | LAB511 | switchgrass\|gb167\|FE644985 | 5149 | 588 | 81.97 | glotblastn |
| 1888 | LAB511 | maize\|10v1\|AW331220_P1 | 5150 | 588 | 80.8 | globlastp |
| 1889 | LAB513 | sorghum\|09v1\|SB03G031290 | 5151 | 590 | 86.1 | globlastp |
| 1890 | LAB513 | sugarcane\|10v1\|BQ536263 | 5152 | 590 | 85.3 | globlastp |
| 1891 | LAB513 | maize\|10v1\|AI622767_P1 | 5153 | 590 | 84.3 | globlastp |
| 1892 | LAB517 | wheat\|10v2\|CA484993_P1 | 592 | 592 | 100 | globlastp |
| 1893 | LAB517 | wheat\|gb164\|CA484993 | 5154 | 592 | 93.5 | globlastp |
| 1894 | LAB522 | switchgrass\|gb167\|FE600611 | 5155 | 596 | 82.5 | globlastp |
| 1895 | LAB522 | foxtail_millet\|10v2\|SICRP014205_P1 | 5156 | 596 | 81.9 | globlastp |
| 1896 | LAB522 | millet\|10v1\|PMSLX0018237D1_P1 | 5157 | 596 | 80.8 | globlastp |
| 1897 | LAB522 | pseudoroegneria\|gb167\|FF348657 | 5158 | 596 | 80 | glotblastn |
| 1898 | LAB522 | wheat\|gb164\|BE428635 | 5159 | 596 | 80 | globlastp |
| 1899 | LAB522 | wheat\|gb164\|CD901776 | 5160 | 596 | 80 | glotblastn |
| 1900 | LAB522 | wheat\|10v2\|BE428635_T1 | 5161 | 596 | 80 | glotblastn |
| 1901 | LAB529 | sugarcane\|10v1\|CA125416 | 5162 | 601 | 86.2 | globlastp |
| 1902 | LAB529 | sorghum\|09v1\|SB02G041550 | 5163 | 601 | 86 | globlastp |
| 1903 | LAB529 | maize\|10v1\|AW352489_P1 | 5164 | 601 | 85.2 | globlastp |
| 1904 | LAB529 | brachypodium\|09v1\|DV474255_P1 | 5165 | 601 | 81.4 | globlastp |
| 1905 | LAB529 | foxtail_millet\|10v2\|SICRP038525_P1 | 5166 | 601 | 80.6 | globlastp |
| 1906 | LAB534 | wheat\|10v2\|CA484573_P1 | 5167 | 605 | 86 | globlastp |
| 1907 | LAB534 | wheat\|gb164\|CA484573 | 5167 | 605 | 86 | globlastp |
| 1908 | LAB537 | maize\|10v1\|BQ294175_P1 | 5168 | 608 | 92.9 | globlastp |
| 1909 | LAB537 | foxtail_millet\|10v2\|SICRP000746_P1 | 5169 | 608 | 89.5 | globlastp |
| 1910 | LAB538 | maize\|10v1\|AW055917_P1 | 5170 | 609 | 91.1 | globlastp |
| 1911 | LAB538 | millet\|10v1\|EVO454PM004023_P1 | 5171 | 609 | 91.1 | globlastp |
| 1912 | LAB538 | switchgrass\|gb167\|FL732618 | 5172 | 609 | 90.52 | glotblastn |
| 1913 | LAB538 | rice\|gb170\|OS10G33930 | 5173 | 609 | 88 | globlastp |
| 1914 | LAB538 | sugarcane\|10v1\|CA067330 | 5174 | 609 | 87.48 | glotblastn |
| 1915 | LAB538 | wheat\|10v2\|BF484992_P1 | 5175 | 609 | 85.1 | globlastp |
| 1916 | LAB538 | brachypodium\|09v1\|DV471199_P1 | 5176 | 609 | 83.7 | globlastp |
| 1917 | LAB539 | sugarcane\|10v1\|CA076703 | 5177 | 610 | 83.5 | globlastp |
| 1918 | LAB540 | sugarcane\|10v1\|BQ535916 | 5178 | 611 | 98.1 | globlastp |
| 1919 | LAB540 | maize\|10v1\|AI939747_P1 | 5179 | 611 | 93.6 | globlastp |
| 1920 | LAB540 | maize\|10v1\|AI372193_P1 | 5180 | 611 | 92.6 | globlastp |
| 1921 | LAB540 | switchgrass\|gb167\|FL717243 | 5181 | 611 | 90.7 | globlastp |
| 1922 | LAB540 | switchgrass\|gb167\|FE622735 | 5182 | 611 | 90 | globlastp |
| 1923 | LAB540 | millet\|10v1\|EVO454PM005876_P1 | 5183 | 611 | 87.5 | globlastp |
| 1924 | LAB540 | rice\|gb170\|OS10G39620 | 5184 | 611 | 81.9 | globlastp |
| 1925 | LAB540 | leymus\|gb166\|EG377740_T1 | 5185 | 611 | 80.07 | glotblastn |
| 1926 | LAB541 | maize\|10v1\|CD442535_P1 | 5186 | 612 | 94.4 | globlastp |
| 1927 | LAB541 | foxtail_millet\|10v2\|SICRP003640_P1 | 5187 | 612 | 90.7 | globlastp |
| 1928 | LAB541 | millet\|10v1\|EVO454PM007541_P1 | 5188 | 612 | 88.9 | globlastp |
| 1929 | LAB541 | brachypodium\|09v1\|GT766945_P1 | 5189 | 612 | 87.4 | globlastp |
| 1930 | LAB541 | sugarcane\|10v1\|CA125626 | 5190 | 612 | 87.37 | glotblastn |
| 1931 | LAB541 | oat\|10v2\|GR333938_P1 | 5191 | 612 | 84.6 | globlastp |
| 1932 | LAB541 | rice\|gb170\|OS03G32170 | 5192 | 612 | 84.3 | globlastp |
| 1933 | LAB541 | wheat\|gb164\|BE402809 | 5193 | 612 | 80.6 | glotblastn |
| 1934 | LAB541 | wheat\|10v2\|BE402809_P1 | 5194 | 612 | 80.6 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1935 | LAB541 | wheat\|gb164\|BE414209 | 5195 | 612 | 80.1 | globlastp |
| 1936 | LAB542 | maize\|10v1\|AI920567_P1 | 5196 | 613 | 83 | globlastp |
| 1937 | LAB542 | maize\|10v1\|AW231890_P1 | 5197 | 613 | 81.3 | globlastp |
| 1938 | LAB544 | maize\|10v1\|AI491671_P1 | 5198 | 615 | 89.5 | globlastp |
| 1939 | LAB544 | foxtail_millet\|10v2\|FXTRMSLX01776707D1_P1 | 5199 | 615 | 87.8 | globlastp |
| 1940 | LAB544 | foxtail_millet\|10v2\|SICRP020217_P1 | 5200 | 615 | 87.3 | globlastp |
| 1941 | LAB544 | switchgrass\|gb167\|FE607451 | 5201 | 615 | 86.9 | globlastp |
| 1942 | LAB544 | sugarcane\|10v1\|CA071081 | 5202 | 615 | 86.4 | globlastp |
| 1943 | LAB544 | switchgrass\|gb167\|FL823712 | 5203 | 615 | 84.72 | glotblastn |
| 1944 | LAB545 | maize\|10v1\|DR801861_P1 | 5204 | 616 | 89.4 | globlastp |
| 1945 | LAB545 | foxtail_millet\|10v2\|SICRP042102_T1 | 5205 | 616 | 84.21 | glotblastn |
| 1946 | LAB545 | switchgrass\|gb167\|FL703918 | 5206 | 616 | 80.6 | globlastp |
| 1947 | LAB546 | maize\|10v1\|EB160115_P1 | 5207 | 617 | 83.2 | globlastp |
| 1948 | LAB547 | sugarcane\|10v1\|CA070480 | 5208 | 618 | 90.3 | globlastp |
| 1949 | LAB547 | maize\|10v1\|AI711829_P1 | 5209 | 618 | 88.2 | globlastp |
| 1950 | LAB547 | foxtail_millet\|10v2\|SICRP035814_P1 | 5210 | 618 | 88 | globlastp |
| 1951 | LAB548 | sorghum\|09v1\|SB07G023880 | 5211 | 619 | 94.9 | globlastp |
| 1952 | LAB548 | maize\|10v1\|BG462428_P1 | 5212 | 619 | 91.3 | globlastp |
| 1953 | LAB548 | maize\|10v1\|DY536598_P1 | 5213 | 619 | 89.7 | globlastp |
| 1954 | LAB548 | foxtail_millet\|10v2\|SICRP040384_P1 | 5214 | 619 | 87.1 | globlastp |
| 1955 | LAB548 | millet\|10v1\|EVO454PM043822_P1 | 5215 | 619 | 86.2 | globlastp |
| 1956 | LAB548 | oat\|10v2\|GO589264_P1 | 5216 | 619 | 84 | globlastp |
| 1957 | LAB548 | rice\|gb170\|OS02G08370 | 5217 | 619 | 84 | globlastp |
| 1958 | LAB548 | brachypodium\|09v1\|DV474172_P1 | 5218 | 619 | 83.7 | globlastp |
| 1959 | LAB548 | foxtail_millet\|10v2\|SICRP034233_P1 | 5219 | 619 | 83.5 | globlastp |
| 1960 | LAB548 | barley\|10v1\|AV834723 | 5220 | 619 | 83.1 | globlastp |
| 1961 | LAB548 | wheat\|10v2\|BE499924_P1 | 5221 | 619 | 82.5 | globlastp |
| 1962 | LAB548 | wheat\|gb164\|BE499924 | 5222 | 619 | 82.5 | globlastp |
| 1963 | LAB550 | wheat\|10v2\|CA486353_P1 | 5223 | 621 | 91.3 | globlastp |
| 1964 | LAB550 | wheat\|gb164\|CA486353 | 5223 | 621 | 91.3 | globlastp |
| 1965 | LAB552 | sugarcane\|10v1\|CA116626 | 5224 | 623 | 86.5 | globlastp |
| 1966 | LAB552 | sugarcane\|10v1\|CA134844 | 5225 | 623 | 84.9 | globlastp |
| 1967 | LAB553 | rice\|gb170\|OS09G27010 | 5226 | 624 | 81.9 | globlastp |
| 1968 | LAB554 | maize\|10v1\|AI665631_P1 | 5227 | 625 | 93.9 | globlastp |
| 1969 | LAB555 | maize\|10v1\|BE025456_P1 | 5228 | 626 | 92.3 | globlastp |
| 1970 | LAB555 | millet\|10v1\|EVO454PM090664_P1 | 5229 | 626 | 86.5 | globlastp |
| 1971 | LAB555 | maize\|10v1\|DR815118_T1 | 5230 | 626 | 85.11 | glotblastn |
| 1972 | LAB555 | rice\|gb170\|OS07G36600 | 5231 | 626 | 82.7 | globlastp |
| 1973 | LAB557 | maize\|10v1\|DW763446_P1 | 5232 | 627 | 88.9 | globlastp |
| 1974 | LAB557 | cenchrus\|gb166\|EB660351_P1 | 5233 | 627 | 87.9 | globlastp |
| 1975 | LAB557 | foxtail_millet\|10v2\|SICRP036933_P1 | 5234 | 627 | 84.2 | globlastp |
| 1976 | LAB558 | wheat\|10v2\|CA485138_P1 | 628 | 628 | 100 | globlastp |
| 1977 | LAB558 | sugarcane\|10v1\|CA095563 | 5235 | 628 | 94.4 | globlastp |
| 1978 | LAB558 | sugarcane\|10v1\|CA164551 | 5236 | 628 | 86.5 | globlastp |
| 1979 | LAB558 | wheat\|gb164\|CA485138 | 5237 | 628 | 85.6 | globlastp |
| 1980 | LAB558 | foxtail_millet\|10v2\|FXTRMSLX00165513D1_P1 | 5238 | 628 | 81.3 | globlastp |
| 1981 | LAB558 | maize\|10v1\|T12703_T1 | 5239 | 628 | 81.11 | glotblastn |
| 1982 | LAB559 | switchgrass\|gb167\|FE618587 | 5240 | 629 | 86.6 | globlastp |
| 1983 | LAB559 | switchgrass\|gb167\|FE639055 | 5240 | 629 | 86.6 | globlastp |
| 1984 | LAB559 | switchgrass\|gb167\|DN140832 | 5241 | 629 | 84.4 | globlastp |
| 1985 | LAB559 | maize\|10v1\|T12669_T1 | 5242 | 629 | 83.43 | glotblastn |
| 1986 | LAB562 | sugarcane\|10v1\|CA119066 | 5243 | 631 | 93.14 | glotblastn |
| 1987 | LAB562 | maize\|10v1\|AW498265_P1 | 5244 | 631 | 88.6 | globlastp |
| 1988 | LAB562 | foxtail_millet\|10v2\|SICRP039885_P1 | 5245 | 631 | 83.3 | globlastp |
| 1989 | LAB562 | switchgrass\|gb167\|DN140951 | 5246 | 631 | 81.4 | globlastp |
| 1990 | LAB563 | maize\|10v1\|BM078441_T1 | 5247 | 632 | 87.54 | glotblastn |
| 1991 | LAB565 | sugarcane\|10v1\|BQ534218 | 5248 | 634 | 97.4 | globlastp |
| 1992 | LAB565 | maize\|10v1\|AW282334_P1 | 5249 | 634 | 95.5 | globlastp |
| 1993 | LAB565 | switchgrass\|gb167\|FE635197 | 5250 | 634 | 94.04 | glotblastn |
| 1994 | LAB565 | millet\|10v1\|EVO454PM054050_P1 | 5251 | 634 | 93.8 | globlastp |
| 1995 | LAB565 | brachypodium\|09v1\|DV488261_P1 | 5252 | 634 | 89.2 | globlastp |
| 1996 | LAB565 | wheat\|10v2\|BE406949_P1 | 5253 | 634 | 88.9 | globlastp |
| 1997 | LAB565 | barley\|10v1\|AV834874 | 5254 | 634 | 88.6 | globlastp |
| 1998 | LAB565 | barley\|10v2\|AV834874_P1 | 5254 | 634 | 88.6 | globlastp |
| 1999 | LAB565 | wheat\|gb164\|BE406949 | 5255 | 634 | 88 | globlastp |
| 2000 | LAB565 | rice\|gb170\|OS01G59340 | 5256 | 634 | 83.2 | globlastp |
| 2001 | LAB566 | maize\|10v1\|AI861110_P1 | 5257 | 635 | 91.3 | globlastp |
| 2002 | LAB566 | maize\|10v1\|CD944442_P1 | 5258 | 635 | 90.5 | globlastp |
| 2003 | LAB566 | foxtail_millet\|10v2\|SICRP012043_P1 | 5259 | 635 | 87.6 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2004 | LAB566 | switchgrass\|gb167\|FL712493 | 5260 | 635 | 86.2 | globlastp |
| 2005 | LAB567 | sugarcane\|10v1\|CA077157 | 5261 | 636 | 93.7 | globlastp |
| 2006 | LAB567 | maize\|10v1\|AI622304_P1 | 5262 | 636 | 93 | globlastp |
| 2007 | LAB567 | maize\|10v1\|AI833772_P1 | 5263 | 636 | 92.3 | globlastp |
| 2008 | LAB567 | foxtail_millet\|10v2\|OXEC611943T1_P1 | 5264 | 636 | 91.9 | globlastp |
| 2009 | LAB567 | maize\|10v1\|EC278197_T1 | 5265 | 636 | 88.25 | glotblastn |
| 2010 | LAB567 | brachypodium\|09v1\|GT777731_P1 | 5266 | 636 | 85.9 | globlastp |
| 2011 | LAB567 | barley\|10v2\|BF259857_P1 | 5267 | 636 | 80.9 | globlastp |
| 2012 | LAB568 | sugarcane\|10v1\|CA065386 | 5268 | 637 | 94.93 | glotblastn |
| 2013 | LAB568 | maize\|10v1\|AW585298_P1 | 5269 | 637 | 91.5 | globlastp |
| 2014 | LAB568 | millet\|10v1\|EVO454PM011979_P1 | 5270 | 637 | 90.5 | globlastp |
| 2015 | LAB568 | switchgrass\|gb167\|FL719093 | 5271 | 637 | 89.3 | globlastp |
| 2016 | LAB568 | switchgrass\|gb167\|FL754140 | 5272 | 637 | 89 | globlastp |
| 2017 | LAB568 | rice\|gb170\|OS02G55560 | 5273 | 637 | 83.2 | globlastp |
| 2018 | LAB568 | maize\|10v1\|CD944838_T1 | 5274 | 637 | 82.74 | glotblastn |
| 2019 | LAB568 | wheat\|10v2\|BE419521_P1 | 5275 | 637 | 82.4 | globlastp |
| 2020 | LAB568 | wheat\|gb164\|BE419521 | 5276 | 637 | 82.1 | globlastp |
| 2021 | LAB568 | wheat\|10v2\|BG314080_P1 | 5277 | 637 | 81.3 | globlastp |
| 2022 | LAB568 | pseudoroegneria\|gb167\|FF349424 | 5278 | 637 | 80.7 | globlastp |
| 2023 | LAB568 | barley\|10v1\|BE413450 | 5279 | 637 | 80.4 | globlastp |
| 2024 | LAB568 | barley\|10v2\|BE413450_P1 | 5279 | 637 | 80.4 | globlastp |
| 2025 | LAB568 | brachypodium\|09v1\|DV473446_P1 | 5280 | 637 | 80.4 | globlastp |
| 2026 | LAB568 | wheat\|10v2\|AW448860_P1 | 5281 | 637 | 80.4 | globlastp |
| 2027 | LAB568 | wheat\|gb164\|AW448860 | 5281 | 637 | 80.4 | globlastp |
| 2028 | LAB569 | sugarcane\|10v1\|CA107253 | 5282 | 638 | 83.9 | globlastp |
| 2029 | LAB569 | maize\|10v1\|EE679050_P1 | 5283 | 638 | 83 | globlastp |
| 2030 | LAB570 | maize\|10v1\|AI676923_P1 | 5284 | 639 | 95 | globlastp |
| 2031 | LAB570 | switchgrass\|gb167\|DN150136 | 5285 | 639 | 92.9 | globlastp |
| 2032 | LAB570 | foxtail_millet\|10v2\|SICRP010671_T1 | 5286 | 639 | 90.34 | glotblastn |
| 2033 | LAB570 | wheat\|10v2\|BE516024_P1 | 5287 | 639 | 88.2 | globlastp |
| 2034 | LAB570 | wheat\|gb164\|AL817730 | 5288 | 639 | 87.8 | globlastp |
| 2035 | LAB570 | wheat\|10v2\|BE604716_P1 | 5289 | 639 | 87.8 | globlastp |
| 2036 | LAB570 | wheat\|gb164\|BE604716 | 5289 | 639 | 87.8 | globlastp |
| 2037 | LAB570 | brachypodium\|09v1\|SRR031795S0012358_P1 | 5290 | 639 | 87.4 | globlastp |
| 2038 | LAB570 | pseudoroegneria\|gb167\|FF342241 | 5291 | 639 | 87.4 | globlastp |
| 2039 | LAB570 | wheat\|gb164\|BE516024 | 5292 | 639 | 87 | globlastp |
| 2040 | LAB570 | barley\|10v2\|BE193616_P1 | 5293 | 639 | 87 | globlastp |
| 2041 | LAB570 | rice\|gb170\|OS05G49440 | 5294 | 639 | 86.6 | globlastp |
| 2042 | LAB570 | oat\|10v2\|GO581296_P1 | 5295 | 639 | 83.7 | globlastp |
| 2043 | LAB570 | barley\|10v1\|BE193616 | 5296 | 639 | 80.3 | globlastp |
| 2044 | LAB571 | sugarcane\|10v1\|BQ529691 | 5297 | 640 | 88.6 | globlastp |
| 2045 | LAB571 | switchgrass\|gb167\|DN144539 | 5298 | 640 | 80.4 | globlastp |
| 2046 | LAB571 | foxtail_millet\|10v2\|OXFXTSLX00006504D1T1_T1 | 5299 | 640 | 80.2 | glotblastn |
| 2047 | LAB573 | millet\|10v1\|PMSLX0001111D1_P1 | 5300 | 642 | 89.9 | globlastp |
| 2048 | LAB576 | sugarcane\|10v1\|CA095103 | 5301 | 644 | 85.18 | glotblastn |
| 2049 | LAB576 | foxtail_millet\|10v2\|GT090909_P1 | 5302 | 644 | 80.9 | globlastp |
| 2050 | LAB576 | switchgrass\|gb167\|DN142739 | 5303 | 644 | 80.5 | globlastp |
| 2051 | LAB576 | switchgrass\|gb167\|DN141674 | 5304 | 644 | 80 | globlastp |
| 2052 | LAB578 | maize\|10v1\|AI677408_P1 | 5305 | 646 | 88.7 | globlastp |
| 2053 | LAB578 | foxtail_millet\|10v2\|SICRP012138_P1 | 5306 | 646 | 81 | globlastp |
| 2054 | LAB581 | maize\|10v1\|AI668332_P1 | 5307 | 647 | 86.9 | globlastp |
| 2055 | LAB584 | sugarcane\|10v1\|CA142851 | 5308 | 649 | 94 | globlastp |
| 2056 | LAB584 | maize\|10v1\|T12691_P1 | 5309 | 649 | 90.5 | globlastp |
| 2057 | LAB584 | foxtail_millet\|10v2\|SICRP025297_P1 | 5310 | 649 | 85.9 | globlastp |
| 2058 | LAB584 | switchgrass\|gb167\|DN142641 | 5311 | 649 | 85.4 | globlastp |
| 2059 | LAB584 | switchgrass\|gb167\|FE627211 | 5312 | 649 | 83.9 | globlastp |
| 2060 | LAB587 | sorghum\|09v1\|EB725401 | 5313 | 652 | 98.7 | globlastp |
| 2061 | LAB587 | sugarcane\|10v1\|AA269170 | 5314 | 652 | 90.7 | globlastp |
| 2062 | LAB587 | maize\|10v1\|AI637037_P1 | 5315 | 652 | 86.8 | globlastp |
| 2063 | LAB587 | switchgrass\|gb167\|DN144784 | 5316 | 652 | 86.8 | globlastp |
| 2064 | LAB587 | switchgrass\|gb167\|DN140682 | 5317 | 652 | 85.7 | globlastp |
| 2065 | LAB588 | maize\|10v1\|BE128869_P1 | 5318 | 653 | 94.4 | globlastp |
| 2066 | LAB588 | foxtail_millet\|10v2\|SICRP005596_P1 | 5319 | 653 | 92.3 | globlastp |
| 2067 | LAB588 | rice\|gb170\|OS05G33820 | 5320 | 653 | 91.2 | globlastp |
| 2068 | LAB588 | oat\|10v2\|GR327662_P1 | 5321 | 653 | 89.4 | globlastp |
| 2069 | LAB588 | brachypodium\|09v1\|GT769376_P1 | 5322 | 653 | 89 | globlastp |
| 2070 | LAB588 | wheat\|10v2\|BE425144_P1 | 5323 | 653 | 88.4 | globlastp |
| 2071 | LAB588 | switchgrass\|gb167\|FE599072 | 5324 | 653 | 85.7 | globlastp |
| 2072 | LAB589 | maize\|10v1\|AI979476_P1 | 5325 | 654 | 89.2 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2073 | LAB589 | switchgrass\|gb167\|FL700661 | 5326 | 654 | 89.2 | globlastp |
| 2074 | LAB589 | foxtail_millet\|10v2\|SICRP022116_T1 | 5327 | 654 | 87.13 | glotblastn |
| 2075 | LAB590 | wheat\|gb164\|CA484817 | 655 | 655 | 100 | globlastp |
| 2076 | LAB590 | sugarcane\|10v1\|CA120642 | 5328 | 655 | 90.4 | globlastp |
| 2077 | LAB593 | maize\|10v1\|BM378514_P1 | 5329 | 658 | 87.6 | globlastp |
| 2078 | LAB593 | switchgrass\|gb167\|DN148058 | 5330 | 658 | 82.7 | globlastp |
| 2079 | LAB595 | switchgrass\|gb167\|FE648493 | 5331 | 660 | 88.8 | globlastp |
| 2080 | LAB595 | brachypodium\|09v1\|DV486094_P1 | 5332 | 660 | 85.7 | globlastp |
| 2081 | LAB597 | sorghum\|09v1\|SB10G029610 | 5333 | 662 | 89.3 | globlastp |
| 2082 | LAB597 | sorghum\|09v1\|SB10G029620 | 5334 | 662 | 88.9 | globlastp |
| 2083 | LAB598 | artemisia\|10v1\|EY078876_P1 | 5335 | 663 | 84.2 | globlastp |
| 2084 | LAB598 | centaurea\|gb166\|EL932912_P1 | 5336 | 663 | 84.2 | globlastp |
| 2085 | LAB598 | sunflower\|10v1\|DY943263 | 5337 | 663 | 84.1 | globlastp |
| 2086 | LAB598 | sunflower\|10v1\|DY945300 | 5338 | 663 | 83.9 | globlastp |
| 2087 | LAB598 | safflower\|gb162\|EL399866 | 5339 | 663 | 83.6 | globlastp |
| 2088 | LAB598 | cynara\|gb167\|GE585276_T1 | 5340 | 663 | 82.4 | glotblastn |
| 2089 | LAB598 | sunflower\|10v1\|CD857638 | 5341 | 663 | 82.1 | globlastp |
| 2090 | LAB598 | sunflower\|10v1\|CD857543 | 5342 | 663 | 81.8 | globlastp |
| 2091 | LAB598 | cichorium\|gb171\|DT211326_P1 | 5343 | 663 | 81.2 | globlastp |
| 2092 | LAB598 | lettuce\|10v1\|DW047090_P1 | 5344 | 663 | 81.2 | globlastp |
| 2093 | LAB598 | sunflower\|10v1\|DY906863 | 5345 | 663 | 81.2 | globlastp |
| 2094 | LAB598 | dandelion\|10v1\|DR399732_P1 | 5346 | 663 | 80.7 | globlastp |
| 2095 | LAB598 | dandelion\|10v1\|DR399004_P1 | 5347 | 663 | 80.4 | globlastp |
| 2096 | LAB598 | sunflower\|10v1\|DY933256 | 5348 | 663 | 80.4 | globlastp |
| 2097 | LAB598 | grape\|gb160\|CD012486_P1 | 5349 | 663 | 80.1 | globlastp |
| 2098 | LAB598 | sunflower\|10v1\|DY928566_T1 | 5350 | 663 | 80 | glotblastn |
| 2099 | LAB600 | sunflower\|10v1\|BQ975539 | 5351 | 665 | 95 | globlastp |
| 2100 | LAB600 | parthenium\|10v1\|GW777541_P1 | 5352 | 665 | 92 | globlastp |
| 2101 | LAB600 | sunflower\|10v1\|DY958546 | 5353 | 665 | 91.9 | globlastp |
| 2102 | LAB600 | dandelion\|10v1\|GO667032_P1 | 5354 | 665 | 86.6 | globlastp |
| 2103 | LAB600 | lettuce\|10v1\|DW109552_P1 | 5355 | 665 | 86.5 | globlastp |
| 2104 | LAB600 | arnica\|11v1\|SRR099034X251424_P1 | 5356 | 665 | 85.9 | globlastp |
| 2105 | LAB600 | cynara\|gb167\|GE588096_P1 | 5357 | 665 | 85.3 | globlastp |
| 2106 | LAB600 | cynara\|gb167\|GE589173_P1 | 5358 | 665 | 84 | globlastp |
| 2107 | LAB600 | dandelion\|10v1\|DY834074_P1 | 5359 | 665 | 84 | globlastp |
| 2108 | LAB600 | lettuce\|10v1\|DW101199_P1 | 5360 | 665 | 84 | globlastp |
| 2109 | LAB600 | cynara\|gb167\|GE588098_P1 | 5361 | 665 | 83.4 | globlastp |
| 2110 | LAB600 | sunflower\|10v1\|Z29554 | 5362 | 665 | 83.2 | globlastp |
| 2111 | LAB600 | centaurea\|gb166\|EH785243_P1 | 5363 | 665 | 82.1 | globlastp |
| 2112 | LAB600 | safflower\|gb162\|EL409548 | 5364 | 665 | 81.9 | globlastp |
| 2113 | LAB600 | artemisia\|10v1\|GW330290_P1 | 5365 | 665 | 81.5 | globlastp |
| 2114 | LAB600 | grape\|gb160\|BM437006_P1 | 5366 | 665 | 80.6 | globlastp |
| 2115 | LAB602 | arnica\|11v1\|SRR099034X101129_P1 | 5367 | 667 | 99.3 | globlastp |
| 2116 | LAB602 | arnica\|11v1\|SRR099034X103059_P1 | 5367 | 667 | 99.3 | globlastp |
| 2117 | LAB602 | cynara\|gb167\|GE586879_P1 | 5367 | 667 | 99.3 | globlastp |
| 2118 | LAB602 | dandelion\|10v1\|DR401449_P1 | 5367 | 667 | 99.3 | globlastp |
| 2119 | LAB602 | gerbera\|09v1\|AJ752905_P1 | 5367 | 667 | 99.3 | globlastp |
| 2120 | LAB602 | lettuce\|10v1\|DW043856_P1 | 5367 | 667 | 99.3 | globlastp |
| 2121 | LAB602 | lettuce\|10v1\|DW049568_P1 | 5367 | 667 | 99.3 | globlastp |
| 2122 | LAB602 | lettuce\|10v1\|DW077871_P1 | 5367 | 667 | 99.3 | globlastp |
| 2123 | LAB602 | lettuce\|10v1\|DW111304_P1 | 5367 | 667 | 99.3 | globlastp |
| 2124 | LAB602 | safflower\|gb162\|EL403624 | 5367 | 667 | 99.3 | globlastp |
| 2125 | LAB602 | tragopogon\|10v1\|SRR020205S0200021 | 5367 | 667 | 99.3 | globlastp |
| 2126 | LAB602 | guizotia\|10v1\|GE569460_P1 | 5368 | 667 | 98.7 | globlastp |
| 2127 | LAB602 | cynara\|gb167\|GE594037_P1 | 5369 | 667 | 98.7 | globlastp |
| 2128 | LAB602 | dandelion\|10v1\|DR398829_P1 | 5370 | 667 | 98.7 | globlastp |
| 2129 | LAB602 | dandelion\|10v1\|DY816353_P1 | 5371 | 667 | 98.7 | globlastp |
| 2130 | LAB602 | gerbera\|09v1\|AJ753514_P1 | 5372 | 667 | 98.7 | globlastp |
| 2131 | LAB602 | senecio\|gb170\|DY658342 | 5373 | 667 | 98.7 | globlastp |
| 2132 | LAB602 | tragopogon\|10v1\|SRR020205S0048663 | 5374 | 667 | 98.7 | globlastp |
| 2133 | LAB602 | apple\|11v1\|CN444083_T1 | — | 667 | 98.69 | glotblastn |
| 2134 | LAB602 | platanus\|11v1\|SRR096786X180873XX1_T1 | 5375 | 667 | 98.04 | glotblastn |
| 2135 | LAB602 | chickpea\|09v2\|ES560400_P1 | 5376 | 667 | 97.4 | globlastp |
| 2136 | LAB602 | cowpea\|gb166\|FC457731_P1 | 5377 | 667 | 97.4 | globlastp |
| 2137 | LAB602 | cowpea\|gb166\|FC459664_P1 | 5378 | 667 | 97.4 | globlastp |
| 2138 | LAB602 | cowpea\|gb166\|FC460794_P1 | 5377 | 667 | 97.4 | globlastp |
| 2139 | LAB602 | cyamopsis\|10v1\|EG986584_P1 | 5379 | 667 | 97.4 | globlastp |
| 2140 | LAB602 | gerbera\|09v1\|AJ759910_P1 | 5380 | 667 | 97.4 | globlastp |
| 2141 | LAB602 | liquorice\|gb171\|ES346879_P1 | 5377 | 667 | 97.4 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2142 | LAB602 | liquorice\|gb171\|FS245060_P1 | 5381 | 667 | 97.4 | globlastp |
| 2143 | LAB602 | soybean\|gb168\|AW351284 | 5376 | 667 | 97.4 | globlastp |
| 2144 | LAB602 | pepper\|gb171\|BM062440_T1 | 5382 | 667 | 97.39 | glotblastn |
| 2145 | LAB602 | apple\|11v1\|AY190601_P1 | 5383 | 667 | 96.8 | globlastp |
| 2146 | LAB602 | apple\|11v1\|CN492322_P1 | 5383 | 667 | 96.8 | globlastp |
| 2147 | LAB602 | fagopyrum\|11v1\|SRR063689X10179_P1 | 5383 | 667 | 96.8 | globlastp |
| 2148 | LAB602 | fagopyrum\|11v1\|SRR063689X6598_P1 | 5383 | 667 | 96.8 | globlastp |
| 2149 | LAB602 | fagopyrum\|11v1\|SRR063703X100190_P1 | 5383 | 667 | 96.8 | globlastp |
| 2150 | LAB602 | fagopyrum\|11v1\|SRR063703X103216_P1 | 5383 | 667 | 96.8 | globlastp |
| 2151 | LAB602 | fagopyrum\|11v1\|SRR063703X104942_P1 | 5383 | 667 | 96.8 | globlastp |
| 2152 | LAB602 | trigonella\|11v1\|SRR066194X100255_P1 | 5384 | 667 | 96.8 | globlastp |
| 2153 | LAB602 | trigonella\|11v1\|SRR066194X104011_P1 | 5385 | 667 | 96.8 | globlastp |
| 2154 | LAB602 | tripterygium\|11v1\|SRR098677X103200_P1 | 5383 | 667 | 96.8 | globlastp |
| 2155 | LAB602 | vinca\|11v1\|SRR098690X111658_P1 | 5383 | 667 | 96.8 | globlastp |
| 2156 | LAB602 | vinca\|11v1\|SRR098690X115040_P1 | 5383 | 667 | 96.8 | globlastp |
| 2157 | LAB602 | wheat\|10v2\|BE493271_P1 | 5386 | 667 | 96.8 | globlastp |
| 2158 | LAB602 | wheat\|10v2\|CJ625754_P1 | 5386 | 667 | 96.8 | globlastp |
| 2159 | LAB602 | soybean\|11v1\|GLYMA15G13650_P1 | 5387 | 667 | 96.8 | globlastp |
| 2160 | LAB602 | apple\|gb171\|AY190601 | 5383 | 667 | 96.8 | globlastp |
| 2161 | LAB602 | apple\|gb171\|CN444073 | 5383 | 667 | 96.8 | globlastp |
| 2162 | LAB602 | apple\|11v1\|CN444073_P1 | 5383 | 667 | 96.8 | globlastp |
| 2163 | LAB602 | apple\|gb171\|CN897285 | 5383 | 667 | 96.8 | globlastp |
| 2164 | LAB602 | bean\|gb167\|CA898387_P1 | 5388 | 667 | 96.8 | globlastp |
| 2165 | LAB602 | bean\|gb167\|CA906736_P1 | 5389 | 667 | 96.8 | globlastp |
| 2166 | LAB602 | brachypodium\|09v1\|DV472756_P1 | 5386 | 667 | 96.8 | globlastp |
| 2167 | LAB602 | cenchrus\|gb166\|EB652878_P1 | 5390 | 667 | 96.8 | globlastp |
| 2168 | LAB602 | cenchrus\|gb166\|EB657468_P1 | 5391 | 667 | 96.8 | globlastp |
| 2169 | LAB602 | chickpea\|09v2\|GR395485_P1 | 5392 | 667 | 96.8 | globlastp |
| 2170 | LAB602 | cowpea\|gb166\|FC459832_P1 | 5393 | 667 | 96.8 | globlastp |
| 2171 | LAB602 | cyamopsis\|10v1\|EG988953_P1 | 5394 | 667 | 96.8 | globlastp |
| 2172 | LAB602 | eschscholzia\|10v1\|CD478095_P1 | 5395 | 667 | 96.8 | globlastp |
| 2173 | LAB602 | lotus\|09v1\|AI967562_P1 | 5396 | 667 | 96.8 | globlastp |
| 2174 | LAB602 | maize\|10v1\|T14781_P1 | 5397 | 667 | 96.8 | globlastp |
| 2175 | LAB602 | medicago\|09v1\|AA660748_P1 | 5384 | 667 | 96.8 | globlastp |
| 2176 | LAB602 | medicago\|09v1\|BE240803_P1 | 5385 | 667 | 96.8 | globlastp |
| 2177 | LAB602 | millet\|10v1\|CD726450_P1 | 5391 | 667 | 96.8 | globlastp |
| 2178 | LAB602 | millet\|10v1\|EVO454PM011519_P1 | 5390 | 667 | 96.8 | globlastp |
| 2179 | LAB602 | petunia\|gb171\|CV294101_P1 | 5383 | 667 | 96.8 | globlastp |
| 2180 | LAB602 | pigeonpea\|10v1\|GW359757_P1 | 5388 | 667 | 96.8 | globlastp |
| 2181 | LAB602 | rye\|gb164\|BE495935 | 5386 | 667 | 96.8 | globlastp |
| 2182 | LAB602 | soybean\|gb168\|AW348249 | 5398 | 667 | 96.8 | globlastp |
| 2183 | LAB602 | switchgrass\|gb167\|DN140955 | 5390 | 667 | 96.8 | globlastp |
| 2184 | LAB602 | switchgrass\|gb167\|DN151878 | 5390 | 667 | 96.8 | globlastp |
| 2185 | LAB602 | wheat\|gb164\|BE424129 | 5386 | 667 | 96.8 | globlastp |
| 2186 | LAB602 | wheat\|gb164\|BE490188 | 5386 | 667 | 96.8 | globlastp |
| 2187 | LAB602 | wheat\|gb164\|BF482446 | 5386 | 667 | 96.8 | globlastp |
| 2188 | LAB602 | wheat\|gb164\|BQ295000 | 5386 | 667 | 96.8 | globlastp |
| 2189 | LAB602 | wheat\|10v2\|BE428853_T1 | 5399 | 667 | 96.77 | glotblastn |
| 2190 | LAB602 | primula\|11v1\|SRR098679X101043_T1 | 5400 | 667 | 96.73 | glotblastn |
| 2191 | LAB602 | ipomoea_nil\|10v1\|BJ556796_T1 | 5401 | 667 | 96.73 | glotblastn |
| 2192 | LAB602 | trigonella\|11v1\|SRR066198X367563_P1 | 5402 | 667 | 96.7 | globlastp |
| 2193 | LAB602 | lettuce\|10v1\|DW044872_P1 | 5403 | 667 | 96.7 | globlastp |
| 2194 | LAB602 | lettuce\|10v1\|DW075291_P1 | 5403 | 667 | 96.7 | globlastp |
| 2195 | LAB602 | aristolochia\|10v1\|FD750605_P1 | 5404 | 667 | 96.2 | globlastp |
| 2196 | LAB602 | cacao\|10v1\|CA794311_P1 | 5404 | 667 | 96.2 | globlastp |
| 2197 | LAB602 | clementine\|11v1\|CB292771_P1 | 5404 | 667 | 96.2 | globlastp |
| 2198 | LAB602 | clementine\|11v1\|CD575689_P1 | 5405 | 667 | 96.2 | globlastp |
| 2199 | LAB602 | cucurbita\|11v1\|FG227034_P1 | 5406 | 667 | 96.2 | globlastp |
| 2200 | LAB602 | cucurbita\|11v1\|SRR091276X112334_P1 | 5406 | 667 | 96.2 | globlastp |
| 2201 | LAB602 | cucurbita\|11v1\|SRR091276X149515_P1 | 5406 | 667 | 96.2 | globlastp |
| 2202 | LAB602 | eucalyptus\|11v2\|EGCRP080588_P1 | 5404 | 667 | 96.2 | globlastp |
| 2203 | LAB602 | euonymus\|11v1\|SRR070038X100459_P1 | 5407 | 667 | 96.2 | globlastp |
| 2204 | LAB602 | euonymus\|11v1\|SRR070038X104839_P1 | 5408 | 667 | 96.2 | globlastp |
| 2205 | LAB602 | fagopyrum\|11v1\|SRR063689X102350_P1 | 5409 | 667 | 96.2 | globlastp |
| 2206 | LAB602 | fagopyrum\|11v1\|SRR063689X116296_P1 | 5408 | 667 | 96.2 | globlastp |
| 2207 | LAB602 | fagopyrum\|11v1\|SRR063689X119246_P1 | 5409 | 667 | 96.2 | globlastp |
| 2208 | LAB602 | fagopyrum\|11v1\|SRR063703X101060_P1 | 5410 | 667 | 96.2 | globlastp |
| 2209 | LAB602 | humulus\|11v1\|ES652407_P1 | 5411 | 667 | 96.2 | globlastp |
| 2210 | LAB602 | humulus\|11v1\|GD243116_P1 | 5411 | 667 | 96.2 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2211 | LAB602 | humulus\|11v1\|GD245281_P1 | 5411 | 667 | 96.2 | globlastp |
| 2212 | LAB602 | humulus\|11v1\|GD245687XX2_P1 | 5411 | 667 | 96.2 | globlastp |
| 2213 | LAB602 | humulus\|11v1\|GD246727_P1 | 5411 | 667 | 96.2 | globlastp |
| 2214 | LAB602 | momordica\|10v1\|SRR071315S0001758_P1 | 5406 | 667 | 96.2 | globlastp |
| 2215 | LAB602 | olea\|11v1\|SRR014463.10977_P1 | 5406 | 667 | 96.2 | globlastp |
| 2216 | LAB602 | olea\|11v1\|SRR014463.11296_P1 | 5406 | 667 | 96.2 | globlastp |
| 2217 | LAB602 | orange\|11v1\|CB292771_P1 | 5404 | 667 | 96.2 | globlastp |
| 2218 | LAB602 | phyla\|11v1\|SRR099037X104480_P1 | 5406 | 667 | 96.2 | globlastp |
| 2219 | LAB602 | platanus\|11v1\|SRR096786X105314_P1 | 5412 | 667 | 96.2 | globlastp |
| 2220 | LAB602 | primula\|11v1\|SRR098679X113360_P1 | 5413 | 667 | 96.2 | globlastp |
| 2221 | LAB602 | scabiosa\|11v1\|SRR063723X107008_P1 | 5414 | 667 | 96.2 | globlastp |
| 2222 | LAB602 | strawberry\|11v1\|CO378624_P1 | 5415 | 667 | 96.2 | globlastp |
| 2223 | LAB602 | vinca\|11v1\|SRR098690X104094_P1 | 5416 | 667 | 96.2 | globlastp |
| 2224 | LAB602 | vinca\|11v1\|SRR098690X109872_P1 | 5417 | 667 | 96.2 | globlastp |
| 2225 | LAB602 | vinca\|11v1\|SRR098690X13629_P1 | 5418 | 667 | 96.2 | globlastp |
| 2226 | LAB602 | antirrhinum\|gb166\|AJ560249_P1 | 5406 | 667 | 96.2 | globlastp |
| 2227 | LAB602 | cacao\|gb167\|CA794311 | 5404 | 667 | 96.2 | globlastp |
| 2228 | LAB602 | castorbean\|09v1\|CF981204_P1 | 5404 | 667 | 96.2 | globlastp |
| 2229 | LAB602 | citrus\|gb166\|CB292771_P1 | 5404 | 667 | 96.2 | globlastp |
| 2230 | LAB602 | coffea\|10v1\|DV664482_P1 | 5404 | 667 | 96.2 | globlastp |
| 2231 | LAB602 | cucumber\|09v1\|AY372537_P1 | 5406 | 667 | 96.2 | globlastp |
| 2232 | LAB602 | eggplant\|10v1\|FS000040_P1 | 5419 | 667 | 96.2 | globlastp |
| 2233 | LAB602 | eggplant\|10v1\|FS007526_P1 | 5404 | 667 | 96.2 | globlastp |
| 2234 | LAB602 | eucalyptus\|11v2\|CT980315_P1 | 5404 | 667 | 96.2 | globlastp |
| 2235 | LAB602 | eucalyptus\|gb166\|CT980315 | 5404 | 667 | 96.2 | globlastp |
| 2236 | LAB602 | ginseng\|10v1\|GR870839_P1 | 5404 | 667 | 96.2 | globlastp |
| 2237 | LAB602 | grape\|gb160\|BM437671_P1 | 5404 | 667 | 96.2 | globlastp |
| 2238 | LAB602 | grape\|gb160\|CB923389_P1 | 5412 | 667 | 96.2 | globlastp |
| 2239 | LAB602 | iceplant\|gb164\|BE036191_P1 | 5404 | 667 | 96.2 | globlastp |
| 2240 | LAB602 | ipomoea_batatas\|10v1\|EE877282_P1 | 5420 | 667 | 96.2 | globlastp |
| 2241 | LAB602 | kiwi\|gb166\|FG409843_P1 | 5404 | 667 | 96.2 | globlastp |
| 2242 | LAB602 | kiwi\|gb166\|FG413926_P1 | 5404 | 667 | 96.2 | globlastp |
| 2243 | LAB602 | kiwi\|gb166\|FG418277_P1 | 5404 | 667 | 96.2 | globlastp |
| 2244 | LAB602 | melon\|10v1\|DV632373_P1 | 5406 | 667 | 96.2 | globlastp |
| 2245 | LAB602 | nicotiana_benthamiana\|gb162\|CN655225_P1 | 5404 | 667 | 96.2 | globlastp |
| 2246 | LAB602 | oak\|10v1\|DN949883_P1 | 5421 | 667 | 96.2 | globlastp |
| 2247 | LAB602 | pepper\|gb171\|BM064038_P1 | 5406 | 667 | 96.2 | globlastp |
| 2248 | LAB602 | petunia\|gb171\|CV297016_P1 | 5406 | 667 | 96.2 | globlastp |
| 2249 | LAB602 | poplar\|10v1\|AI161896_P1 | 5404 | 667 | 96.2 | globlastp |
| 2250 | LAB602 | poplar\|10v1\|AI164490_P1 | 5404 | 667 | 96.2 | globlastp |
| 2251 | LAB602 | poplar\|10v1\|AI164872_P1 | 5404 | 667 | 96.2 | globlastp |
| 2252 | LAB602 | poplar\|10v1\|BU821971_P1 | 5404 | 667 | 96.2 | globlastp |
| 2253 | LAB602 | prunus\|10v1\|BU039800 | 5404 | 667 | 96.2 | globlastp |
| 2254 | LAB602 | prunus\|10v1\|CB820788 | 5404 | 667 | 96.2 | globlastp |
| 2255 | LAB602 | solanum_phureja\|09v1\|SPHBG123642 | 5404 | 667 | 96.2 | globlastp |
| 2256 | LAB602 | solanum_phureja\|09v1\|SPHBG713824 | 5404 | 667 | 96.2 | globlastp |
| 2257 | LAB602 | strawberry\|gb164\|CO378624 | 5415 | 667 | 96.2 | globlastp |
| 2258 | LAB602 | strawberry\|11v1\|DV438928_P1 | 5415 | 667 | 96.2 | globlastp |
| 2259 | LAB602 | strawberry\|gb164\|DV438928 | 5415 | 667 | 96.2 | globlastp |
| 2260 | LAB602 | tea\|10v1\|CV014107 | 5404 | 667 | 96.2 | globlastp |
| 2261 | LAB602 | tobacco\|gb162\|CV016127 | 5404 | 667 | 96.2 | globlastp |
| 2262 | LAB602 | tomato\|09v1\|BG123642 | 5404 | 667 | 96.2 | globlastp |
| 2263 | LAB602 | tomato\|10v1\|BG123642_P1 | 5404 | 667 | 96.2 | globlastp |
| 2264 | LAB602 | tomato\|09v1\|BG713824 | 5404 | 667 | 96.2 | globlastp |
| 2265 | LAB602 | tomato\|10v1\|BG713824_P1 | 5404 | 667 | 96.2 | globlastp |
| 2266 | LAB602 | eucalyptus\|11v2\|CB967549_P1 | 5404 | 667 | 96.2 | globlastp |
| 2267 | LAB602 | wheat\|10v2\|BQ607118_T1 | 5422 | 667 | 96.13 | glotblastn |
| 2268 | LAB602 | wheat\|10v2\|CA498608_T1 | 5422 | 667 | 96.13 | glotblastn |
| 2269 | LAB602 | barley\|10v2\|BF254401_P1 | 5423 | 667 | 96.1 | globlastp |
| 2270 | LAB602 | pteridium\|11v1\|GW574837_P1 | 5424 | 667 | 96.1 | globlastp |
| 2271 | LAB602 | pteridium\|11v1\|GW575021_P1 | 5424 | 667 | 96.1 | globlastp |
| 2272 | LAB602 | pteridium\|11v1\|SRR043594X102186_P1 | 5424 | 667 | 96.1 | globlastp |
| 2273 | LAB602 | wheat\|10v2\|BF291803_P1 | 5423 | 667 | 96.1 | globlastp |
| 2274 | LAB602 | wheat\|10v2\|CA611411_P1 | 5423 | 667 | 96.1 | globlastp |
| 2275 | LAB602 | cryptomeria\|gb166\|DC429734_P1 | 5425 | 667 | 96.1 | globlastp |
| 2276 | LAB602 | fern\|gb171\|BP911941_P1 | 5424 | 667 | 96.1 | globlastp |
| 2277 | LAB602 | ipomoea_nil\|10v1\|BJ556278_P1 | 5426 | 667 | 96.1 | globlastp |
| 2278 | LAB602 | lotus\|09v1\|AW164175_P1 | 5427 | 667 | 96.1 | globlastp |
| 2279 | LAB602 | maize\|10v1\|AI396270_P1 | 5428 | 667 | 96.1 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2280 | LAB602 | maize\|10v1\|X92422_P1 | 5429 | 667 | 96.1 | globlastp |
| 2281 | LAB602 | oat\|10v2\|GO587019_P1 | 5430 | 667 | 96.1 | globlastp |
| 2282 | LAB602 | peanut\|10v1\|CD037554_P1 | 5431 | 667 | 96.1 | globlastp |
| 2283 | LAB602 | peanut\|10v1\|CD038268_P1 | 5432 | 667 | 96.1 | globlastp |
| 2284 | LAB602 | peanut\|10v1\|EE123933_P1 | 5432 | 667 | 96.1 | globlastp |
| 2285 | LAB602 | pseudoroegneria\|gb167\|FF345063 | 5423 | 667 | 96.1 | globlastp |
| 2286 | LAB602 | rice\|gb170\|OS01G22490 | 5433 | 667 | 96.1 | globlastp |
| 2287 | LAB602 | rice\|gb170\|OS05G06770 | 5434 | 667 | 96.1 | globlastp |
| 2288 | LAB602 | sorghum\|09v1\|SB03G013260 | 5429 | 667 | 96.1 | globlastp |
| 2289 | LAB602 | sorghum\|09v1\|SB09G004630 | 5428 | 667 | 96.1 | globlastp |
| 2290 | LAB602 | soybean\|11v1\|GLYMA02G04090_P1 | 5435 | 667 | 96.1 | globlastp |
| 2291 | LAB602 | soybean\|gb168\|AI967562 | 5435 | 667 | 96.1 | globlastp |
| 2292 | LAB602 | soybean\|gb168\|BG662429 | 5436 | 667 | 96.1 | globlastp |
| 2293 | LAB602 | sugarcane\|10v1\|BQ534107 | 5428 | 667 | 96.1 | globlastp |
| 2294 | LAB602 | sugarcane\|10v1\|CA066254 | 5429 | 667 | 96.1 | globlastp |
| 2295 | LAB602 | switchgrass\|gb167\|FE606278 | 5437 | 667 | 96.1 | globlastp |
| 2296 | LAB602 | wheat\|gb164\|BE398245 | 5423 | 667 | 96.1 | globlastp |
| 2297 | LAB602 | wheat\|gb164\|BE399975 | 5423 | 667 | 96.1 | globlastp |
| 2298 | LAB602 | wheat\|gb164\|BE403924 | 5423 | 667 | 96.1 | globlastp |
| 2299 | LAB602 | wheat\|gb164\|BE406199 | 5423 | 667 | 96.1 | globlastp |
| 2300 | LAB602 | humulus\|11v1\|GD243297_T1 | 5438 | 667 | 96.08 | glotblastn |
| 2301 | LAB602 | arabidopsis_lyrata\|09v1\|JGIAL016135_T1 | 5439 | 667 | 96.08 | glotblastn |
| 2302 | LAB602 | arabidopsis\|10v1\|AT2G47115_T1 | 5440 | 667 | 96.08 | glotblastn |
| 2303 | LAB602 | amsonia\|11v1\|SRR098688X101887_P1 | 5441 | 667 | 95.5 | globlastp |
| 2304 | LAB602 | cacao\|10v1\|CA794857_P1 | 5442 | 667 | 95.5 | globlastp |
| 2305 | LAB602 | chelidonium\|11v1\|SRR084752X101333_P1 | 5443 | 667 | 95.5 | globlastp |
| 2306 | LAB602 | chelidonium\|11v1\|SRR084752X102180_P1 | 5443 | 667 | 95.5 | globlastp |
| 2307 | LAB602 | cucurbita\|11v1\|SRR091276X160918_P1 | 5444 | 667 | 95.5 | globlastp |
| 2308 | LAB602 | eucalyptus\|11v2\|CD669887_P1 | 5445 | 667 | 95.5 | globlastp |
| 2309 | LAB602 | eucalyptus\|11v2\|DRR000893X1294318_P1 | 5445 | 667 | 95.5 | globlastp |
| 2310 | LAB602 | eucalyptus\|11v2\|EGCRP111503_P1 | 5445 | 667 | 95.5 | globlastp |
| 2311 | LAB602 | eucalyptus\|11v2\|SRR001658X14358_P1 | 5445 | 667 | 95.5 | globlastp |
| 2312 | LAB602 | euonymus\|11v1\|SRR070038X105838_P1 | 5446 | 667 | 95.5 | globlastp |
| 2313 | LAB602 | euonymus\|11v1\|SRR070038X10653_P1 | 5446 | 667 | 95.5 | globlastp |
| 2314 | LAB602 | euonymus\|11v1\|SRR070038X108964_P1 | 5446 | 667 | 95.5 | globlastp |
| 2315 | LAB602 | euonymus\|11v1\|SRR070038X11552_P1 | 5446 | 667 | 95.5 | globlastp |
| 2316 | LAB602 | euonymus\|11v1\|SRR070038X148487_P1 | 5446 | 667 | 95.5 | globlastp |
| 2317 | LAB602 | euonymus\|11v1\|SRR070038X224901_P1 | 5446 | 667 | 95.5 | globlastp |
| 2318 | LAB602 | euphorbia\|11v1\|SRR098678X101552_P1 | 5447 | 667 | 95.5 | globlastp |
| 2319 | LAB602 | hevea\|10v1\|EC609547_P1 | 5448 | 667 | 95.5 | globlastp |
| 2320 | LAB602 | hevea\|10v1\|EF120638_P1 | 5449 | 667 | 95.5 | globlastp |
| 2321 | LAB602 | phyla\|11v1\|SRR099035X101574_P1 | 5450 | 667 | 95.5 | globlastp |
| 2322 | LAB602 | plantago\|11v1\|SRR066373X107182_P1 | 5447 | 667 | 95.5 | globlastp |
| 2323 | LAB602 | sequoia\|10v1\|SRR065044S0013765_P1 | 5451 | 667 | 95.5 | globlastp |
| 2324 | LAB602 | sequoia\|10v1\|SRR065044S0015240_P1 | 5451 | 667 | 95.5 | globlastp |
| 2325 | LAB602 | silene\|11v1\|GH294387XX1_P1 | 5452 | 667 | 95.5 | globlastp |
| 2326 | LAB602 | silene\|11v1\|SRR096785X115860_P1 | 5452 | 667 | 95.5 | globlastp |
| 2327 | LAB602 | tabernaemontana\|11v1\|SRR098689X104755_P1 | 5453 | 667 | 95.5 | globlastp |
| 2328 | LAB602 | tomato\|10v1\|BG124271_P1 | 5454 | 667 | 95.5 | globlastp |
| 2329 | LAB602 | tripterygium\|11v1\|SRR098677X100370_P1 | 5455 | 667 | 95.5 | globlastp |
| 2330 | LAB602 | tripterygium\|11v1\|SRR098677X125608_P1 | 5446 | 667 | 95.5 | globlastp |
| 2331 | LAB602 | wheat\|10v2\|BQ482865_P1 | 5456 | 667 | 95.5 | globlastp |
| 2332 | LAB602 | soybean\|11v1\|GLYMA09G02760_P1 | 5457 | 667 | 95.5 | globlastp |
| 2333 | LAB602 | banana\|10v1\|BBS3308T3_P1 | 5458 | 667 | 95.5 | globlastp |
| 2334 | LAB602 | barley\|10v1\|BF628062 | 5459 | 667 | 95.5 | globlastp |
| 2335 | LAB602 | barley\|10v2\|CB862713_P1 | 5459 | 667 | 95.5 | globlastp |
| 2336 | LAB602 | bruguiera\|gb166\|BP941058_P1 | 5447 | 667 | 95.5 | globlastp |
| 2337 | LAB602 | cassava\|09v1\|CK643178_P1 | 5460 | 667 | 95.5 | globlastp |
| 2338 | LAB602 | cassava\|09v1\|DV444787_P1 | 5461 | 667 | 95.5 | globlastp |
| 2339 | LAB602 | castorbean\|09v1\|T24225_P1 | 5462 | 667 | 95.5 | globlastp |
| 2340 | LAB602 | chestnut\|gb170\|SRR006295S0000870_P1 | 5463 | 667 | 95.5 | globlastp |
| 2341 | LAB602 | citrus\|gb166\|AU186287_P1 | 5464 | 667 | 95.5 | globlastp |
| 2342 | LAB602 | cotton\|10v1\|BE053295 | 5442 | 667 | 95.5 | globlastp |
| 2343 | LAB602 | cotton\|10v2\|BQ413933_P1 | 5442 | 667 | 95.5 | globlastp |
| 2344 | LAB602 | cotton\|10v1\|BE054036 | 5442 | 667 | 95.5 | globlastp |
| 2345 | LAB602 | cotton\|10v2\|BE054036_P1 | 5442 | 667 | 95.5 | globlastp |
| 2346 | LAB602 | cotton\|10v1\|BF268603 | 5442 | 667 | 95.5 | globlastp |
| 2347 | LAB602 | cotton\|10v2\|SRR032367S0246126_P1 | 5442 | 667 | 95.5 | globlastp |
| 2348 | LAB602 | cotton\|10v1\|BG440190XX1 | 5442 | 667 | 95.5 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2349 | LAB602 | cotton\|10v2\|DQ116441_P1 | 5442 | 667 | 95.5 | globlastp |
| 2350 | LAB602 | cryptomeria\|gb166\|AU299133_P1 | 5451 | 667 | 95.5 | globlastp |
| 2351 | LAB602 | cryptomeria\|gb166\|AU299467_P1 | 5451 | 667 | 95.5 | globlastp |
| 2352 | LAB602 | dandelion\|10v1\|DR399251_P1 | 5465 | 667 | 95.5 | globlastp |
| 2353 | LAB602 | eggplant\|10v1\|FS003523_P1 | 5466 | 667 | 95.5 | globlastp |
| 2354 | LAB602 | fescue\|gb161\|DT685677_P1 | 5467 | 667 | 95.5 | globlastp |
| 2355 | LAB602 | ginseng\|10v1\|CN847785_P1 | 5468 | 667 | 95.5 | globlastp |
| 2356 | LAB602 | grape\|gb160\|CA816031_P1 | 5469 | 667 | 95.5 | globlastp |
| 2357 | LAB602 | ipomoea_nil\|10v1\|BJ554287_P1 | 5470 | 667 | 95.5 | globlastp |
| 2358 | LAB602 | jatropha\|09v1\|GO247342_P1 | 5447 | 667 | 95.5 | globlastp |
| 2359 | LAB602 | kiwi\|gb166\|FG422731_P1 | 5471 | 667 | 95.5 | globlastp |
| 2360 | LAB602 | lolium\|10v1\|DT671313_P1 | 5472 | 667 | 95.5 | globlastp |
| 2361 | LAB602 | maize\|10v1\|AI770839_P1 | 5473 | 667 | 95.5 | globlastp |
| 2362 | LAB602 | melon\|10v1\|DV632514_P1 | 5474 | 667 | 95.5 | globlastp |
| 2363 | LAB602 | nicotiana_benthamiana\|gb162\|CN741626_P1 | 5462 | 667 | 95.5 | globlastp |
| 2364 | LAB602 | nicotiana_benthamiana\|gb162\|CN742316_P1 | 5475 | 667 | 95.5 | globlastp |
| 2365 | LAB602 | nuphar\|gb166\|CD476026_P1 | 5441 | 667 | 95.5 | globlastp |
| 2366 | LAB602 | oak\|10v1\|DB997430_P1 | 5463 | 667 | 95.5 | globlastp |
| 2367 | LAB602 | oat\|10v2\|GR357379_P1 | 5476 | 667 | 95.5 | globlastp |
| 2368 | LAB602 | oil_palm\|gb166\|CN599503_P1 | 5477 | 667 | 95.5 | globlastp |
| 2369 | LAB602 | oil_palm\|gb166\|EL681518_P1 | 5478 | 667 | 95.5 | globlastp |
| 2370 | LAB602 | pepper\|gb171\|CA515435_P1 | 5479 | 667 | 95.5 | globlastp |
| 2371 | LAB602 | poplar\|10v1\|AI161967_P1 | 5480 | 667 | 95.5 | globlastp |
| 2372 | LAB602 | poppy\|gb166\|FE967444_P1 | 5481 | 667 | 95.5 | globlastp |
| 2373 | LAB602 | rhizophora\|10v1\|SRR005793S0009285 | 5447 | 667 | 95.5 | globlastp |
| 2374 | LAB602 | solanum_phureja\|09v1\|SPHAJ235750 | 5454 | 667 | 95.5 | globlastp |
| 2375 | LAB602 | tobacco\|gb162\|BP192472 | 5462 | 667 | 95.5 | globlastp |
| 2376 | LAB602 | tobacco\|gb162\|CV015966 | 5462 | 667 | 95.5 | globlastp |
| 2377 | LAB602 | tobacco\|gb162\|CV020966 | 5462 | 667 | 95.5 | globlastp |
| 2378 | LAB602 | triphysaria\|10v1\|DR170494 | 5447 | 667 | 95.5 | globlastp |
| 2379 | LAB602 | brachypodium\|09v1\|DV473997_T1 | 5482 | 667 | 95.48 | glotblastn |
| 2380 | LAB602 | maize\|10v1\|AI714606_T1 | 5483 | 667 | 95.45 | glotblastn |
| 2381 | LAB602 | ceratodon\|10v1\|SRR074890S0021151_T1 | 5484 | 667 | 95.42 | glotblastn |
| 2382 | LAB602 | senecio\|gb170\|SRR006592S0003441_T1 | 5485 | 667 | 95.42 | glotblastn |
| 2383 | LAB602 | thalictrum\|11v1\|SRR096787X101210_T1 | 5486 | 667 | 95.42 | glotblastn |
| 2384 | LAB602 | medicago\|09v1\|LLBM779699_T1 | 5487 | 667 | 95.42 | glotblastn |
| 2385 | LAB602 | oak\|10v1\|SRR006309S0016808_T1 | 5488 | 667 | 95.42 | glotblastn |
| 2386 | LAB602 | oil_palm\|gb166\|EL693652_T1 | 5489 | 667 | 95.42 | glotblastn |
| 2387 | LAB602 | salvia\|10v1\|SRR014553S0012370 | 5490 | 667 | 95.4 | globlastp |
| 2388 | LAB602 | amsonia\|11v1\|SRR098688X102880_P1 | 5491 | 667 | 94.9 | globlastp |
| 2389 | LAB602 | catharanthus\|11v1\|SRR098691X104303_P1 | 5492 | 667 | 94.9 | globlastp |
| 2390 | LAB602 | cotton\|10v2\|CO077967_P1 | 5493 | 667 | 94.9 | globlastp |
| 2391 | LAB602 | distylium\|11v1\|SRR065077X143703_P1 | 5494 | 667 | 94.9 | globlastp |
| 2392 | LAB602 | euphorbia\|11v1\|BG485831_P1 | 5495 | 667 | 94.9 | globlastp |
| 2393 | LAB602 | euphorbia\|11v1\|BP957919_P1 | 5496 | 667 | 94.9 | globlastp |
| 2394 | LAB602 | euphorbia\|11v1\|DV112197_P1 | 5497 | 667 | 94.9 | globlastp |
| 2395 | LAB602 | plantago\|11v1\|SRR066373X100529_P1 | 5498 | 667 | 94.9 | globlastp |
| 2396 | LAB602 | platanus\|11v1\|SRR096786X102587_P1 | 5499 | 667 | 94.9 | globlastp |
| 2397 | LAB602 | platanus\|11v1\|SRR096786X107093_P1 | 5500 | 667 | 94.9 | globlastp |
| 2398 | LAB602 | platanus\|11v1\|SRR096786X114963_P1 | 5499 | 667 | 94.9 | globlastp |
| 2399 | LAB602 | silene\|11v1\|SRR096785X118284_P1 | 5501 | 667 | 94.9 | globlastp |
| 2400 | LAB602 | silene\|11v1\|SRR096785X413647_P1 | 5502 | 667 | 94.9 | globlastp |
| 2401 | LAB602 | tabernaemontana\|11v1\|SRR098689X129213_P1 | 5503 | 667 | 94.9 | globlastp |
| 2402 | LAB602 | taxus\|10v1\|SRR032523S0002193_P1 | 5504 | 667 | 94.9 | globlastp |
| 2403 | LAB602 | tripterygium\|11v1\|SRR098677X17664_P1 | 5505 | 667 | 94.9 | globlastp |
| 2404 | LAB602 | acacia\|10v1\|FS584828_P1 | 5506 | 667 | 94.9 | globlastp |
| 2405 | LAB602 | antirrhinum\|gb166\|AJ800322_P1 | 5507 | 667 | 94.9 | globlastp |
| 2406 | LAB602 | cassava\|09v1\|CK641483_P1 | 5508 | 667 | 94.9 | globlastp |
| 2407 | LAB602 | coffea\|10v1\|DV704507_P1 | 5509 | 667 | 94.9 | globlastp |
| 2408 | LAB602 | cotton\|10v1\|AI725978 | 5493 | 667 | 94.9 | globlastp |
| 2409 | LAB602 | cycas\|gb166\|CB090085_P1 | 5510 | 667 | 94.9 | globlastp |
| 2410 | LAB602 | nasturtium\|10v1\|GH165290_P1 | 5511 | 667 | 94.9 | globlastp |
| 2411 | LAB602 | nasturtium\|10v1\|SRR032558S0000663_P1 | 5511 | 667 | 94.9 | globlastp |
| 2412 | LAB602 | nasturtium\|10v1\|SRR032558S0001346_P1 | 5512 | 667 | 94.9 | globlastp |
| 2413 | LAB602 | nasturtium\|10v1\|SRR032558S0007518_P1 | 5511 | 667 | 94.9 | globlastp |
| 2414 | LAB602 | papaya\|gb165\|EX258281_P1 | 5513 | 667 | 94.9 | globlastp |
| 2415 | LAB602 | papaya\|gb165\|EX283904_P1 | 5514 | 667 | 94.9 | globlastp |
| 2416 | LAB602 | salvia\|10v1\|CV162838 | 5515 | 667 | 94.9 | globlastp |
| 2417 | LAB602 | spurge\|gb161\|BG485831 | 5495 | 667 | 94.9 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2418 | LAB602 | spurge\|gb161\|DV112197 | 5516 | 667 | 94.9 | globlastp |
| 2419 | LAB602 | tea\|10v1\|FE861302 | 5517 | 667 | 94.9 | globlastp |
| 2420 | LAB602 | tragopogon\|10v1\|SRR020205S0098470 | 5518 | 667 | 94.9 | globlastp |
| 2421 | LAB602 | catharanthus\|11v1\|EG561160_P1 | 5519 | 667 | 94.8 | globlastp |
| 2422 | LAB602 | acacia\|10v1\|FS586388_P1 | 5520 | 667 | 94.8 | globlastp |
| 2423 | LAB602 | catharanthus\|gb166\|EG561160 | 5519 | 667 | 94.8 | globlastp |
| 2424 | LAB602 | fescue\|gb161\|DT679843_P1 | 5521 | 667 | 94.8 | globlastp |
| 2425 | LAB602 | medicago\|09v1\|LLEX530597_P1 | 5522 | 667 | 94.8 | globlastp |
| 2426 | LAB602 | ceratodon\|10v1\|SRR074890S0001295_T1 | 5523 | 667 | 94.77 | glotblastn |
| 2427 | LAB602 | apple\|gb171\|CN444083 | 5524 | 667 | 94.3 | globlastp |
| 2428 | LAB602 | arnica\|11v1\|SRR099034X102574_T1 | — | 667 | 94.27 | glotblastn |
| 2429 | LAB602 | cephalotaxus\|11v1\|SRR064395X100007_P1 | 5525 | 667 | 94.2 | globlastp |
| 2430 | LAB602 | cephalotaxus\|11v1\|SRR064395X102492_P1 | 5526 | 667 | 94.2 | globlastp |
| 2431 | LAB602 | pseudotsuga\|10v1\|SRR065119S0020786_P1 | 5527 | 667 | 94.2 | globlastp |
| 2432 | LAB602 | sciadopitys\|10v1\|SRR065035S0017940_P1 | 5528 | 667 | 94.2 | globlastp |
| 2433 | LAB602 | zostera\|10v1\|AM766052_P1 | 5529 | 667 | 94.2 | globlastp |
| 2434 | LAB602 | amborella\|gb166\|CK757444_P1 | 5530 | 667 | 94.2 | globlastp |
| 2435 | LAB602 | aquilegia\|10v1\|DR916640 | 5531 | 667 | 94.2 | globlastp |
| 2436 | LAB602 | aquilegia\|10v2\|DR916640_P1 | 5531 | 667 | 94.2 | globlastp |
| 2437 | LAB602 | basilicum\|10v1\|DY339482_P1 | 5532 | 667 | 94.2 | globlastp |
| 2438 | LAB602 | beet\|gb162\|AW777209_P1 | 5533 | 667 | 94.2 | globlastp |
| 2439 | LAB602 | cassava\|09v1\|CK641688_P1 | 5534 | 667 | 94.2 | globlastp |
| 2440 | LAB602 | liriodendron\|gb166\|CK749688_P1 | 5535 | 667 | 94.2 | globlastp |
| 2441 | LAB602 | monkeyflower\|10v1\|DV206840_P1 | 5536 | 667 | 94.2 | globlastp |
| 2442 | LAB602 | physcomitrella\|10v1\|AW126950_P1 | 5537 | 667 | 94.2 | globlastp |
| 2443 | LAB602 | physcomitrella\|10v1\|AW145369_P1 | 5538 | 667 | 94.2 | globlastp |
| 2444 | LAB602 | physcomitrella\|10v1\|AW477249_P1 | 5539 | 667 | 94.2 | globlastp |
| 2445 | LAB602 | physcomitrella\|10v1\|AW561525_P1 | 5538 | 667 | 94.2 | globlastp |
| 2446 | LAB602 | rhizophora\|10v1\|SRR005792S0002148 | 5540 | 667 | 94.2 | globlastp |
| 2447 | LAB602 | rose\|10v1\|EC587604 | 5541 | 667 | 94.2 | globlastp |
| 2448 | LAB602 | spruce\|gb162\|CO218344 | 5542 | 667 | 94.2 | globlastp |
| 2449 | LAB602 | tamarix\|gb166\|EG966766 | 5543 | 667 | 94.2 | globlastp |
| 2450 | LAB602 | triphysaria\|10v1\|BE574745 | 5544 | 667 | 94.2 | globlastp |
| 2451 | LAB602 | strawberry\|11v1\|SRR034880S0003449_T1 | 5545 | 667 | 94.12 | glotblastn |
| 2452 | LAB602 | catharanthus\|gb166\|FD420365 | 5546 | 667 | 94.12 | glotblastn |
| 2453 | LAB602 | pea\|09v1\|GH719912 | 5547 | 667 | 94.12 | glotblastn |
| 2454 | LAB602 | fern\|gb171\|BP916930_P1 | 5548 | 667 | 94.1 | globlastp |
| 2455 | LAB602 | abies\|11v2\|SRR098676X104104_P1 | 5549 | 667 | 93.6 | globlastp |
| 2456 | LAB602 | cedrus\|11v1\|SRR065007X11847_P1 | 5550 | 667 | 93.6 | globlastp |
| 2457 | LAB602 | ceratodon\|10v1\|SRR074890S0010782_P1 | 5551 | 667 | 93.6 | globlastp |
| 2458 | LAB602 | ceratodon\|10v1\|SRR074890S0011592_P1 | 5551 | 667 | 93.6 | globlastp |
| 2459 | LAB602 | primula\|11v1\|SRR098679X103609_P1 | 5552 | 667 | 93.6 | globlastp |
| 2460 | LAB602 | sciadopitys\|10v1\|SRR065035S0006567_P1 | 5553 | 667 | 93.6 | globlastp |
| 2461 | LAB602 | arabidopsis_lyrata\|09v1\|JGIAL016134_P1 | 5554 | 667 | 93.6 | globlastp |
| 2462 | LAB602 | arabidopsis\|10v1\|AT2G47110_P1 | 5555 | 667 | 93.6 | globlastp |
| 2463 | LAB602 | artemisia\|10v1\|EY040185_P1 | 5556 | 667 | 93.6 | globlastp |
| 2464 | LAB602 | b_juncea\|10v2\|E6ANDIZ01A0POR_P1 | 5554 | 667 | 93.6 | globlastp |
| 2465 | LAB602 | b_juncea\|10v2\|E6ANDIZ01A4JJQ_P1 | 5557 | 667 | 93.6 | globlastp |
| 2466 | LAB602 | b_juncea\|10v2\|E6ANDIZ01A6HNA_P1 | 5557 | 667 | 93.6 | globlastp |
| 2467 | LAB602 | b_juncea\|10v2\|E6ANDIZ01A9AM7_P1 | 5557 | 667 | 93.6 | globlastp |
| 2468 | LAB602 | b_juncea\|10v2\|E6ANDIZ01AXRAH_P1 | 5557 | 667 | 93.6 | globlastp |
| 2469 | LAB602 | b_juncea\|10v2\|E6ANDIZ01BKQAD_P1 | 5557 | 667 | 93.6 | globlastp |
| 2470 | LAB602 | b_oleracea\|gb161\|DY026234_P1 | 5557 | 667 | 93.6 | globlastp |
| 2471 | LAB602 | b_oleracea\|gb161\|DY026360_P1 | 5554 | 667 | 93.6 | globlastp |
| 2472 | LAB602 | b_oleracea\|gb161\|DY027366_P1 | 5557 | 667 | 93.6 | globlastp |
| 2473 | LAB602 | b_oleracea\|gb161\|DY029055_P1 | 5557 | 667 | 93.6 | globlastp |
| 2474 | LAB602 | b_rapa\|gb162\|BQ790741_P1 | 5557 | 667 | 93.6 | globlastp |
| 2475 | LAB602 | b_rapa\|gb162\|CA992063_P1 | 5554 | 667 | 93.6 | globlastp |
| 2476 | LAB602 | b_rapa\|gb162\|CV433070_P1 | 5557 | 667 | 93.6 | globlastp |
| 2477 | LAB602 | b_rapa\|gb162\|CV544640_P1 | 5557 | 667 | 93.6 | globlastp |
| 2478 | LAB602 | b_rapa\|gb162\|CV545825_P1 | 5557 | 667 | 93.6 | globlastp |
| 2479 | LAB602 | b_rapa\|gb162\|CV650691_P1 | 5557 | 667 | 93.6 | globlastp |
| 2480 | LAB602 | canola\|10v1\|CD838543_P1 | 5557 | 667 | 93.6 | globlastp |
| 2481 | LAB602 | canola\|10v1\|CN726001_P1 | 5557 | 667 | 93.6 | globlastp |
| 2482 | LAB602 | canola\|10v1\|CN728835_P1 | 5557 | 667 | 93.6 | globlastp |
| 2483 | LAB602 | canola\|10v1\|CN729956_P1 | 5557 | 667 | 93.6 | globlastp |
| 2484 | LAB602 | canola\|10v1\|CN730007_P1 | 5557 | 667 | 93.6 | globlastp |
| 2485 | LAB602 | canola\|10v1\|CN730575_P1 | 5554 | 667 | 93.6 | globlastp |
| 2486 | LAB602 | canola\|10v1\|CX195100_P1 | 5554 | 667 | 93.6 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2487 | LAB602 | curcuma\|10v1\|DY388486_P1 | 5558 | 667 | 93.6 | globlastp |
| 2488 | LAB602 | liriodendron\|gb166\|CK761688_P1 | 5559 | 667 | 93.6 | globlastp |
| 2489 | LAB602 | monkeyflower\|10v1\|DV206070_P1 | 5560 | 667 | 93.6 | globlastp |
| 2490 | LAB602 | radish\|gb164\|EV538643 | 5557 | 667 | 93.6 | globlastp |
| 2491 | LAB602 | radish\|gb164\|EW732009 | 5557 | 667 | 93.6 | globlastp |
| 2492 | LAB602 | radish\|gb164\|EX908156 | 5557 | 667 | 93.6 | globlastp |
| 2493 | LAB602 | radish\|gb164\|EY894147 | 5557 | 667 | 93.6 | globlastp |
| 2494 | LAB602 | spruce\|gb162\|CO216137 | 5561 | 667 | 93.6 | globlastp |
| 2495 | LAB602 | triphysaria\|10v1\|SRR023500S0014909 | 5562 | 667 | 93.6 | globlastp |
| 2496 | LAB602 | zamia\|gb166\|DY031119 | 5563 | 667 | 93.6 | globlastp |
| 2497 | LAB602 | arnica\|11v1\|SRR099034X106809_P1 | 5564 | 667 | 93.5 | globlastp |
| 2498 | LAB602 | arnica\|11v1\|SRR099034X171072_P1 | 5564 | 667 | 93.5 | globlastp |
| 2499 | LAB602 | pseudotsuga\|10v1\|SRR065119S0009894_P1 | 5565 | 667 | 93.5 | globlastp |
| 2500 | LAB602 | spikemoss\|gb165\|DN838786 | 5566 | 667 | 93.5 | globlastp |
| 2501 | LAB602 | spikemoss\|gb165\|DN838801 | 5566 | 667 | 93.5 | globlastp |
| 2502 | LAB602 | pea\|11v1\|GH719912_T1 | 5567 | 667 | 93.46 | glotblastn |
| 2503 | LAB602 | artemisia\|10v1\|SRR019254S0125874_T1 | 5568 | 667 | 93.46 | glotblastn |
| 2504 | LAB602 | zostera\|10v1\|AM766352_P1 | 5569 | 667 | 93 | globlastp |
| 2505 | LAB602 | arabidopsis_lyrata\|09v1\|JGIAL019574_P1 | 5570 | 667 | 93 | globlastp |
| 2506 | LAB602 | arabidopsis\|10v1\|AT3G62250_P1 | 5571 | 667 | 93 | globlastp |
| 2507 | LAB602 | ginger\|gb164\|DY355153_P1 | 5572 | 667 | 93 | globlastp |
| 2508 | LAB602 | thellungiella\|gb167\|DN775984 | 5573 | 667 | 93 | globlastp |
| 2509 | LAB602 | thellungiella\|gb167\|EC599370 | 5574 | 667 | 93 | globlastp |
| 2510 | LAB602 | abies\|11v2\|SRR098676X106135_P1 | 5575 | 667 | 92.9 | globlastp |
| 2511 | LAB602 | centaurea\|gb166\|EH743542_P1 | 5576 | 667 | 92.9 | globlastp |
| 2512 | LAB602 | eucalyptus\|gb166\|CB967549 | 5577 | 667 | 92.9 | globlastp |
| 2513 | LAB602 | flax\|09v1\|EH792561_P1 | 5578 | 667 | 92.9 | globlastp |
| 2514 | LAB602 | marchantia\|gb166\|AU081635_P1 | 5579 | 667 | 92.9 | globlastp |
| 2515 | LAB602 | heritiera\|10v1\|SRR005795S0001612_P1 | 5580 | 667 | 92.8 | globlastp |
| 2516 | LAB602 | euphorbia\|11v1\|BP960568_P1 | 5581 | 667 | 92.5 | globlastp |
| 2517 | LAB602 | cleome_gynandra\|10v1\|SRR015532S0010484_P1 | 5582 | 667 | 92.4 | globlastp |
| 2518 | LAB602 | cleome_spinosa\|10v1\|SRR015531S0001493_P1 | 5583 | 667 | 92.4 | globlastp |
| 2519 | LAB602 | cleome_spinosa\|10v1\|SRR015531S0008847_P1 | 5583 | 667 | 92.4 | globlastp |
| 2520 | LAB602 | radish\|gb164\|FD537810 | 5584 | 667 | 92.4 | globlastp |
| 2521 | LAB602 | cedrus\|11v1\|SRR065007X119735_P1 | 5585 | 667 | 92.3 | globlastp |
| 2522 | LAB602 | maritime_pine\|10v1\|AL750482_P1 | 5586 | 667 | 92.3 | globlastp |
| 2523 | LAB602 | podocarpus\|10v1\|SRR065014S0003300_P1 | 5587 | 667 | 92.3 | globlastp |
| 2524 | LAB602 | podocarpus\|10v1\|SRR065014S0004643_P1 | 5588 | 667 | 92.3 | globlastp |
| 2525 | LAB602 | marchantia\|gb166\|C95757_P1 | 5589 | 667 | 92.3 | globlastp |
| 2526 | LAB602 | mesostigma\|gb166\|DN254301_P1 | 5590 | 667 | 92.2 | globlastp |
| 2527 | LAB602 | mesostigma\|gb166\|EC727302_P1 | 5590 | 667 | 92.2 | globlastp |
| 2528 | LAB602 | gnetum\|10v1\|SRR064399S0002632_T1 | 5591 | 667 | 92.16 | glotblastn |
| 2529 | LAB602 | cichorium\|gb171\|EH701995_P1 | 5592 | 667 | 91.8 | globlastp |
| 2530 | LAB602 | cynara\|gb167\|GE587660_P1 | 5593 | 667 | 91.8 | globlastp |
| 2531 | LAB602 | distylium\|11v1\|SRR065077X101267_P1 | 5594 | 667 | 91.7 | globlastp |
| 2532 | LAB602 | pine\|10v2\|AA556336_P1 | 5595 | 667 | 91.7 | globlastp |
| 2533 | LAB602 | cleome_gynandra\|10v1\|SRR015532S0001342_P1 | 5596 | 667 | 91.7 | globlastp |
| 2534 | LAB602 | jatropha\|09v1\|FM887421_P1 | 5597 | 667 | 91.7 | globlastp |
| 2535 | LAB602 | pine\|10v1\|AA556336 | 5595 | 667 | 91.7 | globlastp |
| 2536 | LAB602 | pine\|10v2\|AW042651_P1 | 5598 | 667 | 91.6 | globlastp |
| 2537 | LAB602 | pine\|10v1\|AW042651 | 5598 | 667 | 91.6 | globlastp |
| 2538 | LAB602 | maritime_pine\|10v1\|AL750841_P1 | 5599 | 667 | 91 | globlastp |
| 2539 | LAB602 | phyla\|11v1\|SRR099035X130164_P1 | 5600 | 667 | 91 | globlastp |
| 2540 | LAB602 | tripterygium\|11v1\|SRR098677X148008_P1 | 5601 | 667 | 91 | globlastp |
| 2541 | LAB602 | arabidopsis_lyrata\|09v1\|JGIAL002524_P1 | 5602 | 667 | 91 | globlastp |
| 2542 | LAB602 | radish\|gb164\|EV536630 | 5603 | 667 | 91 | globlastp |
| 2543 | LAB602 | foxtail_millet\|10v2\|OXFXTRMSLX00024112D1T1_T1 | 5604 | 667 | 90.91 | glotblastn |
| 2544 | LAB602 | taxus\|10v1\|SRR032523S0005735_P1 | 5605 | 667 | 90.5 | globlastp |
| 2545 | LAB602 | aquilegia\|10v2\|JGIAC020489_P1 | 5606 | 667 | 90.4 | globlastp |
| 2546 | LAB602 | b_juncea\|10v2\|E6ANDIZ01A2ST1_P1 | 5607 | 667 | 90.4 | globlastp |
| 2547 | LAB602 | b_rapa\|gb162\|CV434034_P1 | 5608 | 667 | 90.4 | globlastp |
| 2548 | LAB602 | b_rapa\|gb162\|EE524726_P1 | 5608 | 667 | 90.4 | globlastp |
| 2549 | LAB602 | b_rapa\|gb162\|ES932048_P1 | 5608 | 667 | 90.4 | globlastp |
| 2550 | LAB602 | canola\|10v1\|CD811669_P1 | 5608 | 667 | 90.4 | globlastp |
| 2551 | LAB602 | canola\|10v1\|CN731338_P1 | 5609 | 667 | 90.4 | globlastp |
| 2552 | LAB602 | canola\|10v1\|CX190625_P1 | 5608 | 667 | 90.4 | globlastp |
| 2553 | LAB602 | radish\|gb164\|EV537152 | 5607 | 667 | 90.4 | globlastp |
| 2554 | LAB602 | thellungiella\|gb167\|BY832714 | 5607 | 667 | 90.4 | globlastp |
| 2555 | LAB602 | ipomoea_batatas\|10v1\|BU692149_P1 | 5610 | 667 | 90.2 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
| --- | --- | --- | --- | --- | --- | --- |
| 2556 | LAB602 | gnetum\|10v1\|SRR064399S0011739_T1 | — | 667 | 90.2 | glotblastn |
| 2557 | LAB602 | antirrhinum\|gb166\|AJ787236_P1 | 5611 | 667 | 89.9 | globlastp |
| 2558 | LAB602 | arabidopsis\|10v1\|AT1G23410_P1 | 5612 | 667 | 89.7 | globlastp |
| 2559 | LAB602 | lettuce\|10v1\|DW044170_P1 | 5613 | 667 | 89.7 | globlastp |
| 2560 | LAB602 | lettuce\|10v1\|DW106136_P1 | 5613 | 667 | 89.7 | globlastp |
| 2561 | LAB602 | orobanche\|10v1\|SRR023189S0009766_P1 | 5614 | 667 | 89.7 | globlastp |
| 2562 | LAB602 | pteridium\|11v1\|SRR043594X213284_T1 | — | 667 | 89.54 | glotblastn |
| 2563 | LAB602 | clementine\|11v1\|AU186287_P1 | 5615 | 667 | 89.5 | globlastp |
| 2564 | LAB602 | orange\|11v1\|AU186287_P1 | 5615 | 667 | 89.5 | globlastp |
| 2565 | LAB602 | oil_palm\|gb166\|EL684927_P1 | 5616 | 667 | 89.4 | globlastp |
| 2566 | LAB602 | cichorium\|gb171\|EH703955_P1 | 5617 | 667 | 88.9 | globlastp |
| 2567 | LAB602 | zamia\|gb166\|DY032286 | 5618 | 667 | 88.5 | globlastp |
| 2568 | LAB602 | artemisia\|10v1\|SRR019254S0029127_P1 | 5619 | 667 | 88.2 | globlastp |
| 2569 | LAB602 | cleome_spinosa\|10v1\|SRR015531S0069759_P1 | 5620 | 667 | 87.9 | globlastp |
| 2570 | LAB602 | barley\|10v1\|BG367667 | 5621 | 667 | 86.5 | globlastp |
| 2571 | LAB602 | oat\|10v2\|GO583920_T1 | 5622 | 667 | 86.45 | glotblastn |
| 2572 | LAB602 | silene\|11v1\|SRR096785X204774_P1 | 5623 | 667 | 86.3 | globlastp |
| 2573 | LAB602 | pteridium\|11v1\|SRR043594X177381_P1 | 5624 | 667 | 86.1 | globlastp |
| 2574 | LAB602 | peanut\|10v1\|SRR042421S0049491_T1 | 5625 | 667 | 85.62 | glotblastn |
| 2575 | LAB602 | iceplant\|gb164\|BE033704_P1 | 5626 | 667 | 85.6 | globlastp |
| 2576 | LAB602 | cichorium\|gb171\|EH698789_P1 | 5627 | 667 | 85.5 | globlastp |
| 2577 | LAB602 | chestnut\|gb170\|SRR006295S0000948_P1 | 5628 | 667 | 85.3 | globlastp |
| 2578 | LAB602 | cowpea\|gb166\|FF394452_P1 | 5629 | 667 | 85.3 | globlastp |
| 2579 | LAB602 | olea\|11v1\|SRR014463.28119_T1 | 5630 | 667 | 85.26 | glotblastn |
| 2580 | LAB602 | sunflower\|10v1\|DY930683 | 5631 | 667 | 85.1 | globlastp |
| 2581 | LAB602 | oat\|10v2\|GR364608_P1 | 5632 | 667 | 85 | globlastp |
| 2582 | LAB602 | pine\|10v2\|DR742309_T1 | 5633 | 667 | 84.97 | glotblastn |
| 2583 | LAB602 | silene\|11v1\|SRR096785X81921_P1 | 5634 | 667 | 84.7 | globlastp |
| 2584 | LAB602 | b_juncea\|10v2\|E6ANDIZ01B4C6N_P1 | 5635 | 667 | 84.7 | globlastp |
| 2585 | LAB602 | silene\|11v1\|SRR096785X10598_P1 | 5636 | 667 | 83.9 | globlastp |
| 2586 | LAB602 | cacao\|gb167\|CA796921 | 5637 | 667 | 83.87 | glotblastn |
| 2587 | LAB602 | tamarix\|gb166\|EG972711 | 5638 | 667 | 83.7 | globlastp |
| 2588 | LAB602 | pine\|10v2\|GT244977_P1 | 5639 | 667 | 83.1 | globlastp |
| 2589 | LAB602 | wheat\|10v2\|BE429137_P1 | 5640 | 667 | 83.1 | globlastp |
| 2590 | LAB602 | wheat\|gb164\|BE429137 | 5640 | 667 | 83.1 | globlastp |
| 2591 | LAB602 | barley\|10v1\|AV910226 | 5641 | 667 | 83.01 | glotblastn |
| 2592 | LAB602 | cedrus\|11v1\|SRR065007X246813_P1 | 5642 | 667 | 83 | globlastp |
| 2593 | LAB602 | sesame\|10v1\|BU667722 | 5643 | 667 | 83 | globlastp |
| 2594 | LAB602 | bean\|gb167\|CV541173_P1 | 5644 | 667 | 82.4 | globlastp |
| 2595 | LAB602 | mesostigma\|gb166\|DN256009_P1 | 5645 | 667 | 82.4 | globlastp |
| 2596 | LAB602 | spruce\|gb162\|ES254877 | 5646 | 667 | 82.4 | globlastp |
| 2597 | LAB602 | wheat\|10v2\|GR302808_T1 | 5647 | 667 | 82.35 | glotblastn |
| 2598 | LAB602 | tobacco\|gb162\|CV016597_T1 | — | 667 | 82.35 | glotblastn |
| 2599 | LAB602 | foxtail_millet\|10v2\|SICRP005298_T1 | — | 667 | 81.94 | glotblastn |
| 2600 | LAB602 | humulus\|11v1\|EX517785_P1 | 5648 | 667 | 81.9 | globlastp |
| 2601 | LAB602 | oat\|10v2\|GR322530_P1 | 5649 | 667 | 81.9 | globlastp |
| 2602 | LAB602 | sugarcane\|10v1\|CA287175 | 5650 | 667 | 81.82 | glotblastn |
| 2603 | LAB602 | barley\|10v2\|BQ766668_P1 | 5651 | 667 | 81.8 | globlastp |
| 2604 | LAB602 | cotton\|10v2\|CD486028_P1 | 5652 | 667 | 81.8 | globlastp |
| 2605 | LAB602 | artemisia\|10v1\|EY038478_P1 | 5653 | 667 | 81.8 | globlastp |
| 2606 | LAB602 | barley\|10v1\|BI946962 | 5652 | 667 | 81.8 | globlastp |
| 2607 | LAB602 | barley\|10v2\|BI946962_P1 | 5652 | 667 | 81.8 | globlastp |
| 2608 | LAB602 | medicago\|09v1\|LLBF637347_P1 | 5654 | 667 | 81.8 | globlastp |
| 2609 | LAB602 | spruce\|gb162\|DR467861 | 5655 | 667 | 81.8 | globlastp |
| 2610 | LAB602 | sugarcane\|10v1\|CA265032 | 5654 | 667 | 81.8 | globlastp |
| 2611 | LAB602 | abies\|11v2\|SRR098076X31705_T1 | 5656 | 667 | 81.7 | glotblastn |
| 2612 | LAB602 | parthenium\|10v1\|GW777160_T1 | 5657 | 667 | 81.7 | glotblastn |
| 2613 | LAB602 | silene\|11v1\|SRR096785X435287_P1 | 5658 | 667 | 81.7 | globlastp |
| 2614 | LAB602 | bean\|gb167\|FE683406_T1 | 5659 | 667 | 81.7 | glotblastn |
| 2615 | LAB602 | cacao\|gb167\|CU470054 | 5660 | 667 | 81.7 | globlastp |
| 2616 | LAB602 | peanut\|10v1\|SRR042422S0196205_T1 | 5661 | 667 | 81.7 | glotblastn |
| 2617 | LAB602 | barley\|10v1\|BE454231 | 5662 | 667 | 81.5 | globlastp |
| 2618 | LAB602 | wheat\|gb164\|AL828311 | 5663 | 667 | 81.5 | globlastp |
| 2619 | LAB602 | pine\|10v2\|AW981923_P1 | 5664 | 667 | 81.4 | globlastp |
| 2620 | LAB602 | oak\|10v1\|FN720649_P1 | 5665 | 667 | 81.4 | globlastp |
| 2621 | LAB602 | oak\|10v1\|FN721702_P1 | 5666 | 667 | 81.4 | globlastp |
| 2622 | LAB602 | barley\|10v2\|CK565709_P1 | 5667 | 667 | 81.3 | globlastp |
| 2623 | LAB602 | wheat\|10v2\|CA682824_P1 | 5667 | 667 | 81.3 | globlastp |
| 2624 | LAB602 | wheat\|gb164\|CA682824 | 5667 | 667 | 81.3 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2625 | LAB602 | apple\|gb171\|EB121176 | 5668 | 667 | 81.2 | globlastp |
| 2626 | LAB602 | apple\|gb171\|EB123817 | 5669 | 667 | 81.2 | globlastp |
| 2627 | LAB602 | artemisia\|10v1\|SRR019550S0120861_P1 | 5668 | 667 | 81.2 | globlastp |
| 2628 | LAB602 | b_rapa\|gb162\|CV545268_P1 | 5670 | 667 | 81.2 | globlastp |
| 2629 | LAB602 | spruce\|gb162\|DR473698 | 5668 | 667 | 81.2 | globlastp |
| 2630 | LAB602 | spruce\|gb162\|DR559215 | 5671 | 667 | 81.2 | globlastp |
| 2631 | LAB602 | spruce\|gb162\|ES659919 | 5672 | 667 | 81.2 | globlastp |
| 2632 | LAB602 | pine\|10v2\|DR021348_T1 | 5673 | 667 | 81.17 | glotblastn |
| 2633 | LAB602 | brachypodium\|09v1\|SRR031796S0003447_T1 | 5674 | 667 | 81.17 | glotblastn |
| 2634 | LAB602 | wheat\|10v2\|CA616541_T1 | 5675 | 667 | 81.13 | glotblastn |
| 2635 | LAB602 | oak\|10v1\|SRR006307S0007125_T1 | 5676 | 667 | 81.05 | glotblastn |
| 2636 | LAB602 | podocarpus\|10v1\|SRR065014S0086919_P1 | 5677 | 667 | 81 | globlastp |
| 2637 | LAB602 | cacao\|gb167\|CA794857 | 5678 | 667 | 81 | globlastp |
| 2638 | LAB602 | citrus\|gb166\|CX301761_P1 | 5679 | 667 | 81 | globlastp |
| 2639 | LAB602 | oak\|10v1\|SRR039745S0052540_P1 | 5680 | 667 | 81 | globlastp |
| 2640 | LAB602 | spruce\|gb162\|EX307619 | 5681 | 667 | 81 | globlastp |
| 2641 | LAB602 | wheat\|10v2\|CJ829997_P1 | 5679 | 667 | 81 | globlastp |
| 2642 | LAB602 | wheat\|gb164\|CJ829997 | 5679 | 667 | 81 | globlastp |
| 2643 | LAB602 | ginger\|gb164\|DY367358_P1 | 5682 | 667 | 80.9 | globlastp |
| 2644 | LAB602 | cucurbita\|11v1\|SRR091276X263906_P1 | 5683 | 667 | 80.8 | globlastp |
| 2645 | LAB602 | basilicum\|10v1\|DY321572_P1 | 5684 | 667 | 80.8 | globlastp |
| 2646 | LAB602 | eucalyptus\|gb166\|CD669887 | 5685 | 667 | 80.65 | glotblastn |
| 2647 | LAB602 | oat\|10v2\|GR359479_P1 | 5686 | 667 | 80.6 | globlastp |
| 2648 | LAB602 | wheat\|10v2\|CK203973_T1 | 5687 | 667 | 80.52 | glotblastn |
| 2649 | LAB602 | wheat\|gb164\|CK203973 | 5688 | 667 | 80.52 | glotblastn |
| 2650 | LAB602 | humulus\|11v1\|EX515725_P1 | 5689 | 667 | 80.5 | globlastp |
| 2651 | LAB602 | humulus\|11v1\|EX517244_P1 | 5690 | 667 | 80.5 | globlastp |
| 2652 | LAB602 | pine\|10v2\|GT245733_P1 | 5691 | 667 | 80.5 | globlastp |
| 2653 | LAB602 | pine\|10v2\|SRR036960S0011291_P1 | 5692 | 667 | 80.5 | globlastp |
| 2654 | LAB602 | cephalotaxus\|11v1\|SRR064395X489207_T1 | 5693 | 667 | 80.39 | glotblastn |
| 2655 | LAB602 | humulus\|11v1\|EX521081_T1 | 5694 | 667 | 80.39 | glotblastn |
| 2656 | LAB602 | humulus\|11v1\|SRR098683X17744_T1 | 5694 | 667 | 80.39 | glotblastn |
| 2657 | LAB602 | phyla\|11v1\|SRR099035X59115_T1 | 5695 | 667 | 80.39 | glotblastn |
| 2658 | LAB602 | podocarpus\|10v1\|SRR065014S0004066_T1 | 5696 | 667 | 80.39 | glotblastn |
| 2659 | LAB602 | spruce\|gb162\|CO236643 | 5697 | 667 | 80.39 | glotblastn |
| 2660 | LAB602 | spruce\|gb162\|DR505138 | 5698 | 667 | 80.39 | glotblastn |
| 2661 | LAB602 | spruce\|gb162\|ES664620 | 5699 | 667 | 80.39 | glotblastn |
| 2662 | LAB602 | wheat\|gb164\|CD871653 | 5700 | 667 | 80.39 | glotblastn |
| 2663 | LAB602 | wheat\|gb164\|DR044809 | 5701 | 667 | 80.39 | glotblastn |
| 2664 | LAB602 | eschscholzia\|10v1\|SRR014116S0001723_P1 | 5702 | 667 | 80.1 | globlastp |
| 2665 | LAB602 | pea\|09v1\|EX568921 | 5703 | 667 | 80.1 | globlastp |
| 2666 | LAB603 | potato\|10v1\|BM113713_P1 | 5704 | 668 | 98.1 | globlastp |
| 2667 | LAB603 | solanum_phureja\|09v1\|SPHAF146691 | 5704 | 668 | 98.1 | globlastp |
| 2668 | LAB603 | solanum_phureja\|09v1\|SPHCRPSP021021 | 5705 | 668 | 91.36 | glotblastn |
| 2669 | LAB603 | pepper\|gb171\|GD095642_P1 | 5706 | 668 | 90.8 | globlastp |
| 2670 | LAB603 | solanum_phureja\|09v1\|SPHCRPSP031051 | 5707 | 668 | 88.86 | glotblastn |
| 2671 | LAB603 | solanum_phureja\|09v1\|SPHCK253070 | 5708 | 668 | 86.23 | glotblastn |
| 2672 | LAB603 | potato\|10v1\|BQ518978_P1 | 5709 | 668 | 84.1 | globlastp |
| 2673 | LAB603 | petunia\|gb171\|DY395314_P1 | 5710 | 668 | 84 | globlastp |
| 2674 | LAB603 | solanum_phureja\|09v1\|SPHBQ518978 | 5711 | 668 | 83 | globlastp |
| 2675 | LAB603 | tomato\|10v1\|CA525943_P1 | 5712 | 668 | 82.7 | globlastp |
| 2676 | LAB603 | tobacco\|gb162\|BQ842835 | 5713 | 668 | 82.7 | globlastp |
| 2677 | LAB603 | eggplant\|10v1\|FS041306_P1 | 5714 | 668 | 81.1 | globlastp |
| 2678 | LAB603 | solanum_phureja\|09v1\|SPHCRPSP011484 | 5715 | 668 | 81.1 | globlastp |
| 2679 | LAB603 | pepper\|gb171\|GD061000_P1 | 5716 | 668 | 80.6 | globlastp |
| 2680 | LAB604 | cotton\|10v2\|CO119718_P1 | 5717 | 669 | 97.3 | globlastp |
| 2681 | LAB604 | cotton\|10v1\|CO082929 | 5718 | 669 | 87.8 | globlastp |
| 2682 | LAB604 | cotton\|10v1\|DT554152 | 5719 | 669 | 86.6 | globlastp |
| 2683 | LAB604 | cotton\|10v2\|DT554152_P1 | 5719 | 669 | 86.6 | globlastp |
| 2684 | LAB604 | cotton\|10v2\|SRR032799S0145794_P1 | 5720 | 669 | 85.5 | globlastp |
| 2685 | LAB604 | citrus\|gb166\|CB417299_P1 | 5721 | 669 | 84 | globlastp |
| 2686 | LAB604 | orange\|11v1\|CB417299_P1 | 5722 | 669 | 83.8 | globlastp |
| 2687 | LAB604 | clementine\|11v1\|CB417299_P1 | 5723 | 669 | 83.6 | globlastp |
| 2688 | LAB604 | grape\|gb160\|CB007851_P1 | 5724 | 669 | 82.4 | globlastp |
| 2689 | LAB604 | peanut\|10v1\|ES703411_P1 | 5725 | 669 | 82.3 | globlastp |
| 2690 | LAB604 | cassava\|09v1\|FF536602_P1 | 5726 | 669 | 82 | globlastp |
| 2691 | LAB604 | nasturtium\|10v1\|GH161780_T1 | 5727 | 669 | 81.8 | glotblastn |
| 2692 | LAB604 | strawberry\|11v1\|SRR034860S0004098_P1 | 5728 | 669 | 81.7 | globlastp |
| 2693 | LAB604 | eucalyptus\|11v2\|CU402810_P1 | 5729 | 669 | 81.4 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2694 | LAB604 | eucalyptus|11v2|ES594789_P1 | 5730 | 669 | 81.4 | globlastp |
| 2695 | LAB604 | prunus|10v1|CN488877_P1 | 5731 | 669 | 81.3 | globlastp |
| 2696 | LAB604 | chestnut|gb170|SRR006295S0003033_P1 | 5732 | 669 | 80.9 | globlastp |
| 2697 | LAB604 | castorbean|09v1|EE260527_P1 | 5733 | 669 | 80.7 | globlastp |
| 2698 | LAB604 | castorbean|09v1|EE255345_P1 | 5734 | 669 | 80.6 | globlastp |
| 2699 | LAB604 | oak|10v1|CU656730_P1 | 5735 | 669 | 80.6 | globlastp |
| 2700 | LAB604 | vinca|11v1|SRR098690X108742_P1 | 5736 | 669 | 80.6 | globlastp |
| 2701 | LAB604 | pigeonpea|10v1|SRR054580S0015200_P1 | 5737 | 669 | 80.4 | globlastp |
| 2702 | LAB604 | soybean|11v1|GLYMA07G37100_P1 | 5738 | 669 | 80.3 | globlastp |
| 2703 | LAB604 | apple|11v1|CN488877_P1 | 5739 | 669 | 80.2 | globlastp |
| 2704 | LAB604 | cucumber|09v1|AA660131_P1 | 5740 | 669 | 80.2 | globlastp |
| 2705 | LAB604 | trigonella|11v1|SRR066194X189077_P1 | 5741 | 669 | 80.2 | globlastp |
| 2706 | LAB604 | catharanthus|11v1|EG554188_T1 | 5742 | 669 | 80.04 | glotblastn |
| 2707 | LAB604 | soybean|11v1|GLYMA17G03500_T1 | 5743 | 669 | 80.04 | glotblastn |
| 2708 | LAB605 | wheat|10v2|BE398424_P1 | 5744 | 670 | 94.1 | globlastp |
| 2709 | LAB605 | wheat|gb164|BE398424 | 5744 | 670 | 94.1 | globlastp |
| 2710 | LAB605 | wheat|10v2|BQ609536_P1 | 5745 | 670 | 93.7 | globlastp |
| 2711 | LAB605 | wheat|gb164|BQ609385 | 5745 | 670 | 93.7 | globlastp |
| 2712 | LAB605 | wheat|10v2|AW448219_P1 | 5746 | 670 | 93.3 | globlastp |
| 2713 | LAB605 | wheat|gb164|AW448219 | 5746 | 670 | 93.3 | globlastp |
| 2714 | LAB605 | oat|10v2|GR342616_P1 | 5747 | 670 | 85.9 | globlastp |
| 2715 | LAB605 | rice|gb170|OS06G44310 | 5748 | 670 | 85.5 | globlastp |
| 2716 | LAB605 | brachypodium|09v1|DV470492_P1 | 5749 | 670 | 84.4 | globlastp |
| 2717 | LAB605 | maize|10v1|BE639108_P1 | 5750 | 670 | 83.3 | globlastp |
| 2718 | LAB605 | switchgrass|gb167|FE612830 | 5751 | 670 | 82.6 | globlastp |
| 2719 | LAB605 | sorghum|09v1|SB10G025930 | 5752 | 670 | 82 | globlastp |
| 2720 | LAB605 | foxtail_millet|10v2|SICRP008165_P1 | 5753 | 670 | 81.5 | globlastp |
| 2721 | LAB608 | maize|10v1|AW330874_P1 | 5754 | 672 | 87.1 | globlastp |
| 2722 | LAB608 | wheat|10v2|CJ925970_T1 | 5755 | 672 | 80.53 | glotblastn |
| 2723 | LAB609 | sugarcane|10v1|BU103694 | 5756 | 673 | 98.2 | globlastp |
| 2724 | LAB609 | switchgrass|gb167|DN152126 | 5757 | 673 | 98.2 | globlastp |
| 2725 | LAB609 | sorghum|09v1|SB01G008730 | 5758 | 673 | 97.9 | globlastp |
| 2726 | LAB609 | switchgrass|gb167|DN151076 | 5759 | 673 | 97.6 | globlastp |
| 2727 | LAB609 | foxtail_millet|10v2|SICRP015451_P1 | 5760 | 673 | 96.3 | globlastp |
| 2728 | LAB609 | cynodon|10v1|ES292711_P1 | 5761 | 673 | 96 | globlastp |
| 2729 | LAB609 | fescue|gb161|DT675542_P1 | 5762 | 673 | 96 | globlastp |
| 2730 | LAB609 | leymus|gb166|CN466273_P1 | 5763 | 673 | 95.5 | globlastp |
| 2731 | LAB609 | rice|gb170|OS11G10480 | 5764 | 673 | 95.5 | globlastp |
| 2732 | LAB609 | barley|10v2|BF623109_P1 | 5765 | 673 | 95.3 | globlastp |
| 2733 | LAB609 | sugarcane|10v1|AA269289 | 5766 | 673 | 95.3 | globlastp |
| 2734 | LAB609 | wheat|gb164|BE398543 | 5767 | 673 | 95.3 | globlastp |
| 2735 | LAB609 | wheat|gb164|BE400569 | 5768 | 673 | 95.3 | globlastp |
| 2736 | LAB609 | wheat|10v2|BE400569_P1 | 5767 | 673 | 95.3 | globlastp |
| 2737 | LAB609 | oat|10v2|BE439362_P1 | 5769 | 673 | 94.7 | globlastp |
| 2738 | LAB609 | pseudoroegneria|gb167|FF342148 | 5770 | 673 | 94.5 | globlastp |
| 2739 | LAB609 | millet|10v1|EVO454PM121003_T1 | 5771 | 673 | 93.93 | glotblastn |
| 2740 | LAB609 | millet|10v1|GFXPENADH1AX1_T1 | 5772 | 673 | 93.93 | glotblastn |
| 2741 | LAB609 | barley|10v1|BF623109 | 5773 | 673 | 92.6 | globlastp |
| 2742 | LAB609 | oil_palm|gb166|CN599735_P1 | 5774 | 673 | 90.8 | globlastp |
| 2743 | LAB609 | switchgrass|gb167|FE597860 | 5775 | 673 | 89.2 | globlastp |
| 2744 | LAB609 | switchgrass|gb167|DN141781 | 5776 | 673 | 88.9 | globlastp |
| 2745 | LAB609 | aristolochia|10v1|SRR039083S0113579_P1 | 5777 | 673 | 87.9 | globlastp |
| 2746 | LAB609 | millet|10v1|EVO454PM003823_P1 | 5778 | 673 | 87.9 | globlastp |
| 2747 | LAB609 | amsonia|11v1|SRR098688X100805_P1 | 5779 | 673 | 87.4 | globlastp |
| 2748 | LAB609 | maize|10v1|AI372135_P1 | 5780 | 673 | 87.3 | globlastp |
| 2749 | LAB609 | clementine|11v1|CN190405_P1 | 5781 | 673 | 87.1 | globlastp |
| 2750 | LAB609 | citrus|gb166|CN190405_P1 | 5781 | 673 | 87.1 | globlastp |
| 2751 | LAB609 | foxtail_millet|10v2|EC611962_T1 | 5782 | 673 | 86.81 | glotblastn |
| 2752 | LAB609 | cotton|10v1|GHU53702 | 5783 | 673 | 86.81 | glotblastn |
| 2753 | LAB609 | cotton|10v2|GHU53702_T1 | 5783 | 673 | 86.81 | glotblastn |
| 2754 | LAB609 | catharanthus|11v1|AM232292_P1 | 5784 | 673 | 86.8 | globlastp |
| 2755 | LAB609 | cassava|09v1|DB934741_P1 | 5785 | 673 | 86.8 | globlastp |
| 2756 | LAB609 | sorghum|09v1|SB05G009350 | 5786 | 673 | 86.8 | globlastp |
| 2757 | LAB609 | sugarcane|10v1|BQ533066 | 5787 | 673 | 86.8 | globlastp |
| 2758 | LAB609 | eucalyptus|11v2|CD669466_P1 | 5788 | 673 | 86.6 | globlastp |
| 2759 | LAB609 | castorbean|09v1|EE259328_P1 | 5789 | 673 | 86.6 | globlastp |
| 2760 | LAB609 | cucumber|09v1|GD173965_P1 | 5790 | 673 | 86.6 | globlastp |
| 2761 | LAB609 | wheat|10v2|CJ625316_P1 | 5791 | 673 | 86.5 | globlastp |
| 2762 | LAB609 | wheat|10v2|BF473168_P1 | 5792 | 673 | 86.5 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2763 | LAB609 | wheat\|gb164\|BF473168 | 5792 | 673 | 86.5 | globlastp |
| 2764 | LAB609 | cacao\|10v1\|CA794234_P1 | 5793 | 673 | 86.3 | globlastp |
| 2765 | LAB609 | barley\|10v1\|BE413374 | 5794 | 673 | 86.3 | globlastp |
| 2766 | LAB609 | barley\|10v2\|BE413374_P1 | 5794 | 673 | 86.3 | globlastp |
| 2767 | LAB609 | cassava\|09v1\|DB930342_P1 | 5795 | 673 | 86.3 | globlastp |
| 2768 | LAB609 | ipomoea_batatas\|10v1\|BU690179_P1 | 5796 | 673 | 86.3 | globlastp |
| 2769 | LAB609 | oat\|10v2\|GO594032_P1 | 5797 | 673 | 86.3 | globlastp |
| 2770 | LAB609 | triphysaria\|10v1\|DR172481 | 5798 | 673 | 86.3 | globlastp |
| 2771 | LAB609 | eucalyptus\|11v2\|CB967555_P1 | 5799 | 673 | 86.1 | globlastp |
| 2772 | LAB609 | cacao\|gb167\|CA794234 | 5800 | 673 | 86.1 | globlastp |
| 2773 | LAB609 | castorbean\|09v1\|XM002526125_P1 | 5801 | 673 | 86.1 | globlastp |
| 2774 | LAB609 | chestnut\|gb170\|FK938826_P1 | 5802 | 673 | 86.1 | globlastp |
| 2775 | LAB609 | oak\|10v1\|CU640336_P1 | 5803 | 673 | 86.1 | globlastp |
| 2776 | LAB609 | oak\|10v1\|DN950200_P1 | 5804 | 673 | 86.1 | globlastp |
| 2777 | LAB609 | poplar\|10v1\|BI139240_P1 | 5805 | 673 | 86.1 | globlastp |
| 2778 | LAB609 | oak\|10v1\|CU657394_T1 | 5806 | 673 | 86.02 | glotblastn |
| 2779 | LAB609 | momordica\|10v1\|SRR071315S0000445_P1 | 5807 | 673 | 86 | globlastp |
| 2780 | LAB609 | wheat\|10v2\|CA608753_P1 | 5808 | 673 | 86 | globlastp |
| 2781 | LAB609 | apple\|11v1\|CN869391_P1 | 5809 | 673 | 86 | globlastp |
| 2782 | LAB609 | apple\|gb171\|CN860062 | 5809 | 673 | 86 | globlastp |
| 2783 | LAB609 | melon\|10v1\|AM733984_P1 | 5810 | 673 | 86 | globlastp |
| 2784 | LAB609 | avocado\|10v1\|CK765305_P1 | 5811 | 673 | 85.9 | globlastp |
| 2785 | LAB609 | oak\|10v1\|CU640135_P1 | 5812 | 673 | 85.9 | globlastp |
| 2786 | LAB609 | eucalyptus\|11v2\|DR409984_P1 | 5813 | 673 | 85.8 | globlastp |
| 2787 | LAB609 | citrus\|gb166\|CN186367_P1 | 5814 | 673 | 85.8 | globlastp |
| 2788 | LAB609 | monkeyflower\|10v1\|GRO18007_P1 | 5815 | 673 | 85.8 | globlastp |
| 2789 | LAB609 | salvia\|10v1\|GU218695 | 5816 | 673 | 85.8 | globlastp |
| 2790 | LAB609 | tobacco\|gb162\|BQ842831 | 5817 | 673 | 85.8 | globlastp |
| 2791 | LAB609 | catharanthus\|gb166\|AM232292 | 5818 | 673 | 85.75 | glotblastn |
| 2792 | LAB609 | wheat\|10v2\|AL826058_P1 | 5819 | 673 | 85.5 | globlastp |
| 2793 | LAB609 | brachypodium\|09v1\|DV470461_P1 | 5820 | 673 | 85.5 | globlastp |
| 2794 | LAB609 | cichorium\|gb171\|DT211329_P1 | 5821 | 673 | 85.5 | globlastp |
| 2795 | LAB609 | dandelion\|10v1\|DY819958_P1 | 5822 | 673 | 85.5 | globlastp |
| 2796 | LAB609 | lettuce\|10v1\|DW065673_P1 | 5823 | 673 | 85.5 | globlastp |
| 2797 | LAB609 | orobanche\|10v1\|SRR023189S0000616_P1 | 5824 | 673 | 85.5 | globlastp |
| 2798 | LAB609 | potato\|10v1\|POTADH1_P1 | 5825 | 673 | 85.5 | globlastp |
| 2799 | LAB609 | wheat\|10v2\|BE606901_P1 | 5826 | 673 | 85.5 | globlastp |
| 2800 | LAB609 | wheat\|gb164\|AL819149 | 5826 | 673 | 85.5 | globlastp |
| 2801 | LAB609 | wheat\|10v2\|BE429259_P1 | 5827 | 673 | 85.5 | globlastp |
| 2802 | LAB609 | wheat\|gb164\|BE429259 | 5827 | 673 | 85.5 | globlastp |
| 2803 | LAB609 | wheat\|gb164\|BG314561 | 5819 | 673 | 85.5 | globlastp |
| 2804 | LAB609 | wheat\|10v2\|BE517900_P1 | 5828 | 673 | 85.5 | globlastp |
| 2805 | LAB609 | wheat\|gb164\|BQ166030 | 5828 | 673 | 85.5 | globlastp |
| 2806 | LAB609 | monkeyflower\|10v1\|CV520551_P1 | 5829 | 673 | 85.4 | globlastp |
| 2807 | LAB609 | euonymus\|11v1\|SRR070038X101806_P1 | 5830 | 673 | 85.3 | globlastp |
| 2808 | LAB609 | phyla\|11v1\|SRR099035X151498_P1 | 5831 | 673 | 85.3 | globlastp |
| 2809 | LAB609 | coffea\|10v1\|DV667321_P1 | 5832 | 673 | 85.3 | globlastp |
| 2810 | LAB609 | solanum_phureja\|09v1\|SPHPOTADH1 | 5833 | 673 | 85.3 | globlastp |
| 2811 | LAB609 | soybean\|11v1\|GLYMA04G39190_P1 | 5834 | 673 | 85.3 | globlastp |
| 2812 | LAB609 | soybean\|gb168\|BI700424 | 5834 | 673 | 85.3 | globlastp |
| 2813 | LAB609 | sunflower\|10v1\|CF079398 | 5835 | 673 | 85.3 | globlastp |
| 2814 | LAB609 | tomato\|09v1\|POTADH1 | 5836 | 673 | 85.3 | globlastp |
| 2815 | LAB609 | tomato\|10v1\|TOMADH2A_P1 | 5836 | 673 | 85.3 | globlastp |
| 2816 | LAB609 | centaurea\|gb166\|EH728177_T1 | 5837 | 673 | 85.26 | glotblastn |
| 2817 | LAB609 | wheat\|10v2\|BF291642_P1 | 5838 | 673 | 85.2 | globlastp |
| 2818 | LAB609 | barley\|10v1\|BF622051 | 5839 | 673 | 85.2 | globlastp |
| 2819 | LAB609 | barley\|10v2\|BF622051_P1 | 5839 | 673 | 85.2 | globlastp |
| 2820 | LAB609 | wheat\|10v2\|BQ838149_P1 | 5840 | 673 | 85.2 | globlastp |
| 2821 | LAB609 | wheat\|gb164\|BQ838149 | 5840 | 673 | 85.2 | globlastp |
| 2822 | LAB609 | arnica\|11v1\|SRR099034X113375_P1 | 5841 | 673 | 85 | globlastp |
| 2823 | LAB609 | cacao\|10v1\|CGD0002283_P1 | 5842 | 673 | 85 | globlastp |
| 2824 | LAB609 | clementine\|11v1\|BQ624101_P1 | 5843 | 673 | 85 | globlastp |
| 2825 | LAB609 | eucalyptus\|11v2\|CD670122_P1 | 5844 | 673 | 85 | globlastp |
| 2826 | LAB609 | eucalyptus\|11v2\|SRR001659X115627_P1 | 5845 | 673 | 85 | globlastp |
| 2827 | LAB609 | wheat\|10v2\|CA612296_P1 | 5846 | 673 | 85 | globlastp |
| 2828 | LAB609 | banana\|10v1\|BBS1898T3_P1 | 5847 | 673 | 85 | globlastp |
| 2829 | LAB609 | beet\|gb162\|AW697786_P1 | 5848 | 673 | 85 | globlastp |
| 2830 | LAB609 | castorbean\|09v1\|EE256089_P1 | 5849 | 673 | 85 | globlastp |
| 2831 | LAB609 | citrus\|gb166\|BQ624101_P1 | 5843 | 673 | 85 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2832 | LAB609 | grape\|gb160\|AF194173_P1 | 5850 | 673 | 85 | globlastp |
| 2833 | LAB609 | kiwi\|gb166\|FG437209_P1 | 5851 | 673 | 85 | globlastp |
| 2834 | LAB609 | lettuce\|10v1\|DW070041_P1 | 5852 | 673 | 85 | globlastp |
| 2835 | LAB609 | leymus\|gb166\|EG388130_P1 | 5853 | 673 | 85 | globlastp |
| 2836 | LAB609 | oil_palm\|gb166\|EL930391_P1 | 5854 | 673 | 85 | globlastp |
| 2837 | LAB609 | poplar\|10v1\|AI161593_P1 | 5855 | 673 | 85 | globlastp |
| 2838 | LAB609 | poplar\|10v1\|BU820503_P1 | 5856 | 673 | 85 | globlastp |
| 2839 | LAB609 | strawberry\|gb164\|GFXX15588X1 | 5857 | 673 | 85 | globlastp |
| 2840 | LAB609 | sunflower\|10v1\|DY915903 | 5858 | 673 | 85 | globlastp |
| 2841 | LAB609 | cotton\|10v1\|GFXAF250207X1 | 5859 | 673 | 84.9 | globlastp |
| 2842 | LAB609 | cotton\|10v2\|GFXAF250207X1_P1 | 5859 | 673 | 84.9 | globlastp |
| 2843 | LAB609 | poppy\|gb166\|FE964358_T1 | 5860 | 673 | 84.74 | globlastn |
| 2844 | LAB609 | eucalyptus\|11v2\|SRR001660X106068_P1 | 5861 | 673 | 84.7 | globlastp |
| 2845 | LAB609 | silene\|11v1\|SRR096785X100510_P1 | 5862 | 673 | 84.7 | globlastp |
| 2846 | LAB609 | apple\|gb171\|CN882390 | 5863 | 673 | 84.7 | globlastp |
| 2847 | LAB609 | grape\|gb160\|AF195866_P1 | 5864 | 673 | 84.7 | globlastp |
| 2848 | LAB609 | kiwi\|gb166\|FG397179_P1 | 5865 | 673 | 84.7 | globlastp |
| 2849 | LAB609 | peanut\|10v1\|CX127912_T1 | 5866 | 673 | 84.7 | globlastn |
| 2850 | LAB609 | pepper\|gb171\|AB033369_P1 | 5867 | 673 | 84.7 | globlastp |
| 2851 | LAB609 | petunia\|gb171\|AY231366_P1 | 5868 | 673 | 84.7 | globlastp |
| 2852 | LAB609 | walnuts\|gb166\|CV195502 | 5869 | 673 | 84.7 | globlastp |
| 2853 | LAB609 | prunus\|10v1\|CN489977 | 5870 | 673 | 84.6 | globlastp |
| 2854 | LAB609 | thalictrum\|11v1\|SRR096787X10122_P1 | 5871 | 673 | 84.5 | globlastp |
| 2855 | LAB609 | dandelion\|10v1\|DY809954_P1 | 5872 | 673 | 84.5 | globlastp |
| 2856 | LAB609 | arnica\|11v1\|SRR099034X127557_T1 | 5873 | 673 | 84.43 | globlastn |
| 2857 | LAB609 | cucumber\|09v1\|DV633085_P1 | 5874 | 673 | 84.4 | globlastp |
| 2858 | LAB609 | eucalyptus\|11v2\|CT981526_P1 | 5875 | 673 | 84.2 | globlastp |
| 2859 | LAB609 | trigonella\|11v1\|SRR066194X101402_P1 | 5876 | 673 | 84.2 | globlastp |
| 2860 | LAB609 | vinca\|11v1\|SRR098690X167363_P1 | 5877 | 673 | 84.2 | globlastp |
| 2861 | LAB609 | petunia\|gb171\|AY231365_P1 | 5878 | 673 | 84.2 | globlastp |
| 2862 | LAB609 | prunus\|10v1\|BU046846 | 5879 | 673 | 84.2 | globlastp |
| 2863 | LAB609 | strawberry\|11v1\|DY670844_P1 | 5880 | 673 | 84.2 | globlastp |
| 2864 | LAB609 | pineapple\|10v1\|DT336103_T1 | 5881 | 673 | 84.17 | globlastn |
| 2865 | LAB609 | sunflower\|10v1\|CD853615 | 5882 | 673 | 84.17 | globlastn |
| 2866 | LAB609 | sunflower\|10v1\|CF092620 | 5883 | 673 | 84.17 | globlastn |
| 2867 | LAB609 | ipomoea_batatas\|10v1\|BU690164_P1 | 5884 | 673 | 84 | globlastp |
| 2868 | LAB609 | strawberry\|gb164\|DY670844 | 5885 | 673 | 83.91 | globlastn |
| 2869 | LAB609 | tobacco\|gb162\|X81853 | 5886 | 673 | 83.91 | globlastn |
| 2870 | LAB609 | thalictrum\|11v1\|SRR096787X10020_P1 | 5887 | 673 | 83.9 | globlastp |
| 2871 | LAB609 | strawberry\|11v1\|GFXX15588X1_P1 | 5888 | 673 | 83.9 | globlastp |
| 2872 | LAB609 | prunus\|10v1\|BU039903 | 5889 | 673 | 83.9 | globlastp |
| 2873 | LAB609 | tomato\|10v1\|CA523141_P1 | 5890 | 673 | 83.9 | globlastp |
| 2874 | LAB609 | cacao\|10v1\|CU540190_P1 | 5891 | 673 | 83.7 | globlastp |
| 2875 | LAB609 | humulus\|11v1\|GD244785_P1 | 5892 | 673 | 83.7 | globlastp |
| 2876 | LAB609 | zostera\|10v1\|AM768698_P1 | 5893 | 673 | 83.7 | globlastp |
| 2877 | LAB609 | apple\|11v1\|CN489977_T1 | 5894 | 673 | 83.64 | globlastn |
| 2878 | LAB609 | wheat\|gb164\|BE425208 | 5895 | 673 | 83.6 | globlastp |
| 2879 | LAB609 | wheat\|10v2\|BE425208_P1 | 5896 | 673 | 83.6 | globlastp |
| 2880 | LAB609 | wheat\|gb164\|BE499808 | 5896 | 673 | 83.6 | globlastp |
| 2881 | LAB609 | aquilegia\|10v2\|DR919648_P1 | 5897 | 673 | 83.6 | globlastp |
| 2882 | LAB609 | cacao\|10v1\|CA795317_P1 | 5898 | 673 | 83.4 | globlastp |
| 2883 | LAB609 | cotton\|10v2\|GHU49061_P1 | 5899 | 673 | 83.4 | globlastp |
| 2884 | LAB609 | trigonella\|11v1\|SRR066194X152471_P1 | 5900 | 673 | 83.4 | globlastp |
| 2885 | LAB609 | aquilegia\|10v1\|DR923555 | 5901 | 673 | 83.4 | globlastp |
| 2886 | LAB609 | aquilegia\|10v2\|DR923555_P1 | 5901 | 673 | 83.4 | globlastp |
| 2887 | LAB609 | cacao\|gb167\|CA795317 | 5898 | 673 | 83.4 | globlastp |
| 2888 | LAB609 | cacao\|gb167\|CU540190 | 5902 | 673 | 83.4 | globlastp |
| 2889 | LAB609 | cotton\|10v1\|GHU49061 | 5899 | 673 | 83.4 | globlastp |
| 2890 | LAB609 | poplar\|10v1\|BU817563_P1 | 5903 | 673 | 83.4 | globlastp |
| 2891 | LAB609 | rice\|gb170\|OS11G10520 | 5904 | 673 | 83.4 | globlastp |
| 2892 | LAB609 | solanum_phureja\|09v1\|SPHBQ118789 | 5905 | 673 | 83.4 | globlastp |
| 2893 | LAB609 | fagopyrum\|11v1\|SRR063689X105469_P1 | 5906 | 673 | 83.2 | globlastp |
| 2894 | LAB609 | fagopyrum\|11v1\|SRR063703X109911_P1 | 5907 | 673 | 83.2 | globlastp |
| 2895 | LAB609 | trigonella\|11v1\|SRR066194X109695_P1 | 5908 | 673 | 83.2 | globlastp |
| 2896 | LAB609 | trigonella\|11v1\|SRR066194X113832_P1 | 5909 | 673 | 83.2 | globlastp |
| 2897 | LAB609 | apple\|11v1\|CN866245_P1 | 5910 | 673 | 83.2 | globlastp |
| 2898 | LAB609 | cichorium\|gb171\|DT211140_P1 | 5911 | 673 | 83.2 | globlastp |
| 2899 | LAB609 | liriodendron\|gb166\|CK755441_P1 | 5912 | 673 | 83.2 | globlastp |
| 2900 | LAB609 | pea\|09v1\|GFXX06281X1 | 5913 | 673 | 83.2 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2901 | LAB609 | cowpea\|gb166\|FC457371_P1 | 5914 | 673 | 83.1 | globlastp |
| 2902 | LAB609 | aquilegia\|10v1\|DR919648 | 5915 | 673 | 83 | globlastp |
| 2903 | LAB609 | pea\|11v1\|GFXX06281X1_P1 | 5916 | 673 | 82.9 | globlastp |
| 2904 | LAB609 | lotus\|09v1\|AW719262_P1 | 5917 | 673 | 82.9 | globlastp |
| 2905 | LAB609 | medicago\|09v1\|AW329540_P1 | 5918 | 673 | 82.9 | globlastp |
| 2906 | LAB609 | pigeonpea\|10v1\|FJ914863_P1 | 5919 | 673 | 82.9 | globlastp |
| 2907 | LAB609 | bean\|gb167\|CV536688_P1 | 5920 | 673 | 82.6 | globlastp |
| 2908 | LAB609 | prunus\|10v1\|BU047659 | 5921 | 673 | 82.6 | globlastp |
| 2909 | LAB609 | soybean\|11v1\|GLYMA04G41990_P1 | 5922 | 673 | 82.6 | globlastp |
| 2910 | LAB609 | soybean\|11v1\|GLYMA06G12780_P1 | 5923 | 673 | 82.4 | globlastp |
| 2911 | LAB609 | soybean\|gb168\|AW685706 | 5924 | 673 | 82.4 | globlastp |
| 2912 | LAB609 | soybean\|gb168\|AW719956 | 5925 | 673 | 82.4 | globlastp |
| 2913 | LAB609 | cassava\|09v1\|CK650772_T1 | 5926 | 673 | 82.32 | glotblastn |
| 2914 | LAB609 | oak\|10v1\|CU639720_T1 | 5927 | 673 | 82.32 | glotblastn |
| 2915 | LAB609 | b_juncea\|10v2\|OXBJ1SLX00009719T1_P1 | 5928 | 673 | 82.3 | globlastp |
| 2916 | LAB609 | b_oleracea\|gb161\|GFXAB015508X1_P1 | 5929 | 673 | 82.3 | globlastp |
| 2917 | LAB609 | b_rapa\|gb162\|BG543078_P1 | 5928 | 673 | 82.3 | globlastp |
| 2918 | LAB609 | canola\|10v1\|CD813434_P1 | 5928 | 673 | 82.3 | globlastp |
| 2919 | LAB609 | canola\|10v1\|CN729315_P1 | 5930 | 673 | 82.3 | globlastp |
| 2920 | LAB609 | centaurea\|gb166\|EH711777_P1 | 5931 | 673 | 82.3 | globlastp |
| 2921 | LAB609 | cotton\|10v1\|GHU53703 | 5932 | 673 | 82.3 | globlastp |
| 2922 | LAB609 | sorghum\|09v1\|SB05G009360 | 5933 | 673 | 82.3 | globlastp |
| 2923 | LAB609 | grape\|gb160\|AF194175_P1 | 5934 | 673 | 82.2 | globlastp |
| 2924 | LAB609 | cotton\|10v2\|GHU53703_P1 | 5935 | 673 | 82.1 | globlastp |
| 2925 | LAB609 | coffea\|10v1\|DV694003_P1 | 5936 | 673 | 82.1 | globlastp |
| 2926 | LAB609 | medicago\|09v1\|AW684056_P1 | 5937 | 673 | 82.1 | globlastp |
| 2927 | LAB609 | sunflower\|10v1\|DY938201 | 5938 | 673 | 82.1 | globlastp |
| 2928 | LAB609 | thellungiella\|gb167\|BI698398 | 5939 | 673 | 82.1 | globlastp |
| 2929 | LAB609 | tomato\|09v1\|BQ118789 | 5940 | 673 | 82.1 | globlastp |
| 2930 | LAB609 | trigonella\|11v1\|SRR066194X166608_T1 | 5941 | 673 | 82.06 | glotblastn |
| 2931 | LAB609 | amsonia\|11v1\|SRR098688X107505_P1 | 5942 | 673 | 81.8 | globlastp |
| 2932 | LAB609 | cotton\|10v2\|GFXGHU53701X1_P1 | 5943 | 673 | 81.8 | globlastp |
| 2933 | LAB609 | peanut\|10v1\|GO324702_P1 | 5944 | 673 | 81.8 | globlastp |
| 2934 | LAB609 | chestnut\|gb170\|SRR006295S0002676_P1 | 5945 | 673 | 81.6 | globlastp |
| 2935 | LAB609 | monkeyflower\|10v1\|GO994620_T1 | 5946 | 673 | 81.53 | glotblastn |
| 2936 | LAB609 | arnica\|11v1\|SRR099034X100025_P1 | 5947 | 673 | 81.3 | globlastp |
| 2937 | LAB609 | apple\|11v1\|CN896285_P1 | 5948 | 673 | 81.3 | globlastp |
| 2938 | LAB609 | apple\|gb171\|CN896285 | 5949 | 673 | 81.3 | globlastp |
| 2939 | LAB609 | arabidopsis_lyrata\|09v1\|GFXAF110449X1_P1 | 5950 | 673 | 81.3 | globlastp |
| 2940 | LAB609 | arabidopsis\|10v1\|AT1G77120_P1 | 5951 | 673 | 81.3 | globlastp |
| 2941 | LAB609 | chestnut\|gb170\|SRR006295S0001419_P1 | 5952 | 673 | 81.3 | globlastp |
| 2942 | LAB609 | ginger\|gb164\|DY373183_P1 | 5953 | 673 | 81.3 | globlastp |
| 2943 | LAB609 | nasturtium\|10v1\|SRR032558S0023180_P1 | 5954 | 673 | 81.3 | globlastp |
| 2944 | LAB609 | oak\|10v1\|CU657498_P1 | 5955 | 673 | 81.3 | globlastp |
| 2945 | LAB609 | oak\|10v1\|FN699577_P1 | 5955 | 673 | 81.3 | globlastp |
| 2946 | LAB609 | cucurbita\|11v1\|SRR091276X169157_T1 | 5956 | 673 | 81.27 | glotblastn |
| 2947 | LAB609 | petunia\|gb171\|GFXX54106X1_T1 | 5957 | 673 | 81.15 | glotblastn |
| 2948 | LAB609 | oak\|10v1\|FN719394_P1 | 5958 | 673 | 81.1 | globlastp |
| 2949 | LAB609 | nasturtium\|10v1\|SRR032558S0000899_P1 | 5959 | 673 | 81 | globlastp |
| 2950 | LAB609 | nasturtium\|10v1\|SRR032558S0015177_P1 | 5960 | 673 | 81 | globlastp |
| 2951 | LAB609 | radish\|gb164\|EV546463 | 5961 | 673 | 81 | globlastp |
| 2952 | LAB609 | radish\|gb164\|EV574563 | 5962 | 673 | 81 | globlastp |
| 2953 | LAB609 | barley\|10v2\|AJ435819_P1 | 5963 | 673 | 81 | globlastp |
| 2954 | LAB609 | cucumber\|09v1\|AM720031_T1 | 5964 | 673 | 80.74 | glotblastn |
| 2955 | LAB609 | barley\|10v1\|AJ435819 | 5965 | 673 | 80.7 | globlastp |
| 2956 | LAB609 | lettuce\|10v1\|DW129586_P1 | 5966 | 673 | 80.7 | globlastp |
| 2957 | LAB609 | papaya\|gb165\|EX228052_P1 | 5967 | 673 | 80.7 | globlastp |
| 2958 | LAB609 | cotton\|10v2\|ES791562_T1 | 5968 | 673 | 80.63 | glotblastn |
| 2959 | LAB609 | pigeonpea\|10v1\|SRR054580S0007868_T1 | 5969 | 673 | 80.47 | glotblastn |
| 2960 | LAB609 | cassava\|09v1\|CK643842_P1 | 5970 | 673 | 80.3 | globlastp |
| 2961 | LAB609 | soybean\|11v1\|GLYMA14G27940_P1 | 5971 | 673 | 80.3 | globlastp |
| 2962 | LAB609 | soybean\|gb168\|CA901218 | 5971 | 673 | 80.3 | globlastp |
| 2963 | LAB609 | nicotiana_benthamiana\|gb162\|CK298723_T1 | 5972 | 673 | 80.21 | glotblastn |
| 2964 | LAB609 | cowpea\|gb166\|FC458812_P1 | 5973 | 673 | 80.2 | globlastp |
| 2965 | LAB609 | cassava\|09v1\|DB945793_T1 | 5974 | 673 | 80.05 | glotblastn |
| 2966 | LAB609 | eucalyptus\|11v2\|CD668817_P1 | 5975 | 673 | 80 | globlastp |
| 2967 | LAB610 | maize\|10v1\|AW928279_P1 | 5976 | 674 | 94.4 | globlastp |
| 2968 | LAB610 | foxtail_millet\|10v2\|EC613683_P1 | 5977 | 674 | 92.3 | globlastp |
| 2969 | LAB610 | rice\|gb170\|OS01G12710 | 5978 | 674 | 89.3 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Poly n. SEQ ID NO: | Hom. to Gene Name | Cluster name | Poly p. SEQ ID NO: | Hom. to SEQ ID NO: | % Glob. identity | Algor. |
|---|---|---|---|---|---|---|
| 2970 | LAB610 | brachypodium\|09v1\|DV476042_P1 | 5979 | 674 | 87.3 | globlastp |
| 2971 | LAB610 | wheat\|10v2\|CA660573_P1 | 5980 | 674 | 87.3 | globlastp |
| 2972 | LAB610 | oat\|10v2\|GO591380_P1 | 5981 | 674 | 86.5 | globlastp |
| 2973 | LAB610 | wheat\|10v2\|BE444200_P1 | 5982 | 674 | 86.3 | globlastp |
| 2974 | LAB610 | millet\|10v1\|EVO454PM004142_P1 | 5983 | 674 | 85.4 | globlastp |
| 2975 | LAB610 | wheat\|gb164\|CA660573 | 5984 | 674 | 83.4 | globlastp |
| 2976 | LAB610 | switchgrass\|gb167\|FL752061 | 5985 | 674 | 80.9 | globlastp |
| 2977 | LAB611 | maize\|10v1\|BG320744_P1 | 5986 | 675 | 93.4 | globlastp |
| 2978 | LAB611 | foxtail_millet\|10v2\|SICRP023336_P1 | 5987 | 675 | 91.2 | globlastp |
| 2979 | LAB611 | maize\|10v1\|BE056193_P1 | 5988 | 675 | 89.9 | globlastp |
| 2980 | LAB611 | switchgrass\|gb167\|FE605349 | 5989 | 675 | 89.7 | glotblastn |
| 2981 | LAB611 | wheat\|10v2\|CA612909_P1 | 5990 | 675 | 83.3 | globlastp |
| 2982 | LAB611 | rice\|gb170\|OS01G55240 | 5991 | 675 | 82.7 | globlastp |
| 2983 | LAB611 | wheat\|gb164\|CA612909 | 5992 | 675 | 82.7 | globlastp |
| 2984 | LAB611 | brachypodium\|09v1\|DV471502_P1 | 5993 | 675 | 81.6 | globlastp |
| 2985 | LAB611 | barley\|10v1\|BF629339 | 5994 | 675 | 81.2 | globlastp |
| 2986 | LAB392 | wheat\|10v2\|CA498814_T1 | 5995 | 678 | 96.45 | glotblastn |
| 2987 | LAB392 | wheat\|gb164\|CA498814 | 5996 | 678 | 96.45 | glotblastn |
| 2988 | LAB392 | wheat\|10v2\|BQ805314_T1 | 5997 | 678 | 86.62 | glotblastn |
| 2989 | LAB392 | wheat\|gb164\|BQ805314 | 5998 | 678 | 86.62 | glotblastn |
| 2990 | LAB392 | brachypodium\|09v1\|GT795112_T1 | 5999 | 678 | 86.52 | glotblastn |
| 2991 | LAB392 | oat\|10v2\|GO590484_T1 | 6000 | 678 | 85.11 | glotblastn |
| 2992 | LAB402 | wheat\|10v2\|CK192944_T1 | 6001 | 680 | 90.45 | glotblastn |
| 2993 | LAB402 | leymus\|gb166\|EG389195_P1 | 6002 | 680 | 88.3 | globlastp |
| 2994 | LAB402 | wheat\|gb164\|BE402264 | 6003 | 680 | 87.2 | glotblastn |
| 2995 | LAB404 | pseudoroegneria\|gb167\|FF360628 | 6004 | 681 | 95 | glotblastn |
| 2996 | LAB404 | wheat\|10v2\|CA600048_T1 | 6005 | 681 | 90 | glotblastn |
| 2997 | LAB408 | guizotia\|10v1\|GE562857_T1 | — | 683 | 86.78 | glotblastn |
| 2998 | LAB408 | tragopogon\|10v1\|SRR020205S0004009 | 6006 | 683 | 84.3 | glotblastn |
| 2999 | LAB408 | zinnia\|gb171\|AU306395 | 6007 | 683 | 81.3 | globlastp |
| 3000 | LAB412 | millet\|10v1\|CD725939_P1 | 6008 | 684 | 89.7 | globlastp |
| 3001 | LAB412 | strawberry\|11v1\|SRR034865S0007657_T1 | 6009 | 684 | 81.46 | glotblastn |
| 3002 | LAB412 | cotton\|10v1\|AI054917 | 6010 | 684 | 81.36 | glotblastn |
| 3003 | LAB412 | apple\|gb171\|CN580610 | 6011 | 684 | 81.04 | glotblastn |
| 3004 | LAB412 | cassava\|09v1\|DV457347_T1 | 6012 | 684 | 80.94 | glotblastn |
| 3005 | LAB412 | bean\|gb167\|CA900686_T1 | 6013 | 684 | 80.78 | glotblastn |
| 3006 | LAB412 | oak\|10v1\|FP033736_T1 | 6014 | 684 | 80.68 | glotblastn |
| 3007 | LAB412 | cowpea\|gb166\|FF395358_T1 | 6015 | 684 | 80.57 | glotblastn |
| 3008 | LAB412 | apple\|11v1\|CN580610_T1 | 6016 | 684 | 80.52 | glotblastn |
| 3009 | LAB412 | triphysaria\|10v1\|EY138184 | 6017 | 684 | 80.47 | glotblastn |
| 3010 | LAB412 | poplar\|10v1\|BU824078_T1 | 6018 | 684 | 80.41 | glotblastn |
| 3011 | LAB412 | eucalyptus\|11v2\|SRR001659X102183_T1 | 6019 | 684 | 80.37 | glotblastn |
| 3012 | LAB412 | prunus\|10v1\|BU039295 | 6020 | 684 | 80.31 | glotblastn |
| 3013 | LAB412 | tripterygium\|11v1\|SRR098677X123557_T1 | 6021 | 684 | 80.16 | glotblastn |
| 3014 | LAB413 | wheat\|10v2\|BG312812_T1 | 6022 | 685 | 89.66 | glotblastn |
| 3015 | LAB413 | wheat\|gb164\|BG312812 | 6023 | 685 | 89.24 | glotblastn |
| 3016 | LAB415 | maize\|10v1\|AW400074_P1 | 6024 | 686 | 83.9 | globlastp |
| 3017 | LAB415 | switchgrass\|gb167\|FL696023 | 6025 | 686 | 80.4 | globlastp |
| 3018 | LAB417 | wheat\|10v2\|CK197589_T1 | 6026 | 687 | 97.26 | glotblastn |
| 3019 | LAB417 | wheat\|gb164\|CK197589 | 6027 | 687 | 97.26 | glotblastn |
| 3020 | LAB417 | sugarcane\|10v1\|CA112098 | 6028 | 687 | 82.88 | glotblastn |
| 3021 | LAB417 | switchgrass\|gb167\|FE605174 | 6029 | 687 | 80.14 | glotblastn |
| 3022 | LAB418 | rice\|gb170\|OS01G69230 | 6030 | 688 | 84.28 | glotblastn |
| 3023 | LAB418 | sorghum\|09v1\|SB03G044110 | 6031 | 688 | 82.26 | glotblastn |
| 3024 | LAB418 | wheat\|10v2\|CA672172_P1 | 6032 | 688 | 81.1 | globlastp |
| 3025 | LAB419 | leymus\|gb166\|EG387716_T1 | 6033 | 689 | 93.53 | glotblastn |
| 3026 | LAB420 | wheat\|10v2\|BM135921_T1 | 6034 | 690 | 96.69 | glotblastn |
| 3027 | LAB420 | wheat\|gb164\|BM135921 | 6035 | 690 | 96.69 | glotblastn |
| 3028 | LAB420 | foxtail_millet\|10v2\|SICRP019584_T1 | 6036 | 690 | 86.76 | glotblastn |
| 3029 | LAB420 | millet\|10v1\|CD725540_T1 | 6037 | 690 | 86.76 | glotblastn |
| 3030 | LAB420 | sugarcane\|10v1\|BU103553 | 6038 | 690 | 86.21 | glotblastn |
| 3031 | LAB420 | switchgrass\|gb167\|DN142102 | 6039 | 690 | 80.1 | globlastp |
| 3032 | LAB422 | millet\|10v1\|EVO454PM021599_T1 | 6040 | 691 | 88.18 | glotblastn |
| 3033 | LAB422 | oat\|10v2\|GO585959_T1 | 6041 | 691 | 86.36 | glotblastn |
| 3034 | LAB422 | wheat\|10v2\|CD491271_T1 | 6042 | 691 | 86.36 | glotblastn |
| 3035 | LAB422 | wheat\|gb164\|CD491271 | 6042 | 691 | 86.36 | glotblastn |
| 3036 | LAB422 | sugarcane\|10v1\|CA098633 | 6043 | 691 | 82.73 | glotblastn |
| 3037 | LAB424 | wheat\|10v2\|BE497266_T1 | 6044 | 692 | 96.32 | glotblastn |
| 3038 | LAB424 | wheat\|gb164\|BE497266 | 6045 | 692 | 96.32 | glotblastn |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3039 | LAB424 | wheat\|10v2\|BE427658XX1_T1 | 6046 | 692 | 95.59 | glotblastn |
| 3040 | LAB424 | fescue\|gb161\|DT687290_P1 | 6047 | 692 | 86.1 | globlastp |
| 3041 | LAB424 | foxtail_millet\|10v2\|FXTRMSLX00591214D2_T1 | 6048 | 692 | 81.62 | glotblastn |
| 3042 | LAB434 | foxtail_millet\|10v2\|FXTRMSLX00496583D1_T1 | 6049 | 693 | 87.7 | glotblastn |
| 3043 | LAB434 | oat\|10v2\|GO590011_P1 | 6050 | 693 | 87.7 | globlastp |
| 3044 | LAB434 | foxtail_millet\|10v2\|SICRP001001_T1 | 6051 | 693 | 83.3 | glotblastn |
| 3045 | LAB435 | pseudoroegneria\|gb167\|FF341913 | 6052 | 694 | 97.56 | glotblastn |
| 3046 | LAB435 | sorghum\|09v1\|SB06G027430 | 6053 | 694 | 90.85 | glotblastn |
| 3047 | LAB435 | millet\|10v1\|PMSLX0027061_T1 | 6054 | 694 | 90.24 | glotblastn |
| 3048 | LAB435 | sugarcane\|10v1\|AY644468 | 6055 | 694 | 90.24 | glotblastn |
| 3049 | LAB435 | switchgrass\|gb167\|DN146308 | 6056 | 694 | 90.24 | glotblastn |
| 3050 | LAB435 | sorghum\|09v1\|SB06G027420 | 6057 | 694 | 89.63 | glotblastn |
| 3051 | LAB435 | maize\|10v1\|BM501472_T1 | 6058 | 694 | 89.02 | glotblastn |
| 3052 | LAB435 | maize\|10v1\|EU956419_T1 | 6059 | 694 | 89.02 | glotblastn |
| 3053 | LAB435 | rice\|gb170\|OS04G51160 | 6060 | 694 | 87.8 | glotblastn |
| 3054 | LAB435 | sugarcane\|10v1\|CA268825 | 6061 | 694 | 87.8 | glotblastn |
| 3055 | LAB435 | curcuma\|10v1\|DY388002_T1 | 6062 | 694 | 87.2 | glotblastn |
| 3056 | LAB435 | ginger\|gb164\|DY367503_T1 | 6063 | 694 | 86.59 | glotblastn |
| 3057 | LAB435 | foxtail_millet\|10v2\|SICRP004605_T1 | 6064 | 694 | 85.98 | glotblastn |
| 3058 | LAB435 | oat\|10v2\|GR313158_T1 | 6065 | 694 | 85.37 | glotblastn |
| 3059 | LAB435 | wheat\|10v2\|BE213679_T1 | 6066 | 694 | 84.76 | glotblastn |
| 3060 | LAB435 | sugarcane\|10v1\|CA093607 | 6067 | 694 | 84.76 | glotblastn |
| 3061 | LAB435 | foxtail_millet\|10v2\|SICRP033556_T1 | 6068 | 694 | 84.15 | glotblastn |
| 3062 | LAB435 | maize\|10v1\|AY059646_T1 | 6069 | 694 | 84.15 | glotblastn |
| 3063 | LAB435 | maize\|10v1\|BG320849_T1 | 6070 | 694 | 84.15 | glotblastn |
| 3064 | LAB435 | sorghum\|09v1\|SB04G030820 | 6071 | 694 | 84.15 | glotblastn |
| 3065 | LAB435 | rice\|gb170\|OS04G51150 | 6072 | 694 | 83.54 | glotblastn |
| 3066 | LAB435 | sorghum\|09v1\|SB06G027410 | 6073 | 694 | 83.54 | glotblastn |
| 3067 | LAB435 | sugarcane\|10v1\|CA096024 | 6074 | 694 | 83.54 | glotblastn |
| 3068 | LAB435 | wheat\|10v2\|BE418863_T1 | 6075 | 694 | 83.54 | glotblastn |
| 3069 | LAB435 | wheat\|gb164\|BE213679 | 6076 | 694 | 83.54 | glotblastn |
| 3070 | LAB435 | brachypodium\|09v1\|DV470238_T1 | 6077 | 694 | 82.93 | glotblastn |
| 3071 | LAB435 | brachypodium\|09v1\|SRR031798S0045248_T1 | 6078 | 694 | 82.93 | glotblastn |
| 3072 | LAB435 | leymus\|gb166\|EG386864_T1 | 6079 | 694 | 82.93 | glotblastn |
| 3073 | LAB435 | oil_palm\|gb166\|ES323962_T1 | 6080 | 694 | 82.93 | glotblastn |
| 3074 | LAB435 | switchgrass\|gb167\|DN147908 | 6081 | 694 | 82.93 | glotblastn |
| 3075 | LAB435 | switchgrass\|gb167\|DN149750 | 6082 | 694 | 82.93 | glotblastn |
| 3076 | LAB435 | wheat\|10v2\|AF174004_T1 | 6083 | 694 | 82.93 | glotblastn |
| 3077 | LAB435 | wheat\|gb164\|AF174004 | 6084 | 694 | 82.93 | glotblastn |
| 3078 | LAB435 | barley\|10v1\|BF625585 | 6085 | 694 | 82.32 | glotblastn |
| 3079 | LAB435 | barley\|10v2\|BF625585_T1 | 6086 | 694 | 82.32 | glotblastn |
| 3080 | LAB435 | rice\|gb170\|OS02G47200 | 6087 | 694 | 82.32 | glotblastn |
| 3081 | LAB435 | fescue\|gb161\|DT697106_P1 | 6088 | 694 | 80 | globlastp |
| 3082 | LAB436 | wheat\|gb164\|BJ276274 | 6089 | 695 | 95.16 | glotblastn |
| 3083 | LAB436 | brachypodium\|09v1\|SRR031797S0108837_T1 | 6090 | 695 | 90.08 | glotblastn |
| 3084 | LAB436 | rice\|gb170\|OS08G31930 | 6091 | 695 | 80.17 | glotblastn |
| 3085 | LAB447 | wheat\|gb164\|BE404399 | 6092 | 696 | 96.27 | glotblastn |
| 3086 | LAB447 | pseudoroegneria\|gb167\|FF350756 | 6093 | 696 | 83.1 | globlastp |
| 3087 | LAB448 | wheat\|10v2\|CA676585_T1 | 6094 | 697 | 80.09 | glotblastn |
| 3088 | LAB451 | wheat\|gb164\|CA640871 | 6095 | 698 | 84.2 | globlastp |
| 3089 | LAB451 | brachypodium\|09v1\|TMPLBQ743665T1_T1 | 6096 | 698 | 81 | glotblastn |
| 3090 | LAB452 | wheat\|gb164\|CA610335 | 6097 | 699 | 98.68 | glotblastn |
| 3091 | LAB452 | wheat\|gb164\|CD873052 | 6098 | 699 | 97.4 | globlastp |
| 3092 | LAB452 | wheat\|10v2\|CD873052_P1 | 6099 | 699 | 94.9 | globlastp |
| 3093 | LAB452 | oat\|10v2\|GO594994_T1 | 6100 | 699 | 94.74 | glotblastn |
| 3094 | LAB452 | foxtail_millet\|10v2\|FXTRMSLX01589021D1_T1 | 6101 | 699 | 89.47 | glotblastn |
| 3095 | LAB452 | sorghum\|09v1\|SB06G025270 | 6102 | 699 | 89.47 | glotblastn |
| 3096 | LAB452 | switchgrass\|gb167\|FL712286 | 6103 | 699 | 88.16 | glotblastn |
| 3097 | LAB452 | maize\|10v1\|CD955425_T1 | 6104 | 699 | 86.84 | glotblastn |
| 3098 | LAB452 | rice\|gb170\|OS04G47380 | 6105 | 699 | 86.84 | glotblastn |
| 3099 | LAB452 | millet\|10v1\|EVO454PM084374_T1 | 6106 | 699 | 85.53 | glotblastn |
| 3100 | LAB452 | cucumber\|09v1\|AM714733_T1 | 6107 | 699 | 81.58 | glotblastn |
| 3101 | LAB452 | curcuma\|10v1\|DY393261_T1 | 6108 | 699 | 81.58 | glotblastn |
| 3102 | LAB452 | poplar\|10v1\|BU874435_T1 | 6109 | 699 | 81.58 | glotblastn |
| 3103 | LAB452 | cucurbita\|11v1\|SRR091276X363627_T1 | 6110 | 699 | 80.77 | glotblastn |
| 3104 | LAB452 | catharanthus\|11v1\|SRR098691X229742_T1 | 6111 | 699 | 80.26 | glotblastn |
| 3105 | LAB452 | apple\|11v1\|CN493534_T1 | 6112 | 699 | 80.26 | glotblastn |
| 3106 | LAB452 | apple\|gb171\|CN493534 | 6113 | 699 | 80.26 | glotblastn |
| 3107 | LAB452 | lettuce\|10v1\|DW061491_T1 | 6114 | 699 | 80.26 | glotblastn |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3108 | LAB452 | melon\|10v1\|AM714733_T1 | 6115 | 699 | 80.26 | glotblastn |
| 3109 | LAB452 | rhizophora\|10v1\|SRR005793S0008455 | 6116 | 699 | 80.26 | glotblastn |
| 3110 | LAB452 | sunflower\|10v1\|EE640820 | 6117 | 699 | 80.26 | glotblastn |
| 3111 | LAB454 | wheat\|10v2\|BI479706_T1 | 6118 | 700 | 97.53 | glotblastn |
| 3112 | LAB454 | wheat\|gb164\|BI479706 | 6119 | 700 | 97.53 | glotblastn |
| 3113 | LAB454 | lolium\|10v1\|AU250123_T1 | 6120 | 700 | 96.3 | glotblastn |
| 3114 | LAB454 | brachypodium\|09v1\|DV478408_T1 | 6121 | 700 | 94.44 | glotblastn |
| 3115 | LAB454 | oat\|10v2\|GR314325_T1 | 6122 | 700 | 94.44 | glotblastn |
| 3116 | LAB454 | foxtail_millet\|10v2\|SICRP001826_T1 | 6123 | 700 | 88.96 | glotblastn |
| 3117 | LAB454 | millet\|10v1\|CD726524_T1 | 6124 | 700 | 87.8 | glotblastn |
| 3118 | LAB454 | pseudoroegneria\|gb167\|FF357127 | 6125 | 700 | 86.4 | globlastp |
| 3119 | LAB454 | switchgrass\|gb167\|FL703687 | 6126 | 700 | 83.44 | glotblastn |
| 3120 | LAB454 | maize\|10v1\|AI834423_T1 | 6127 | 700 | 81.93 | glotblastn |
| 3121 | LAB455 | pseudoroegneria\|gb167\|FF340783 | 6128 | 701 | 98.93 | glotblastn |
| 3122 | LAB455 | foxtail_millet\|10v2\|FXTRMSLX00457345D1_T1 | 6129 | 701 | 90.37 | glotblastn |
| 3123 | LAB455 | amsonia\|11v1\|SRR098688X11403_T1 | 6130 | 701 | 86.7 | glotblastn |
| 3124 | LAB455 | banana\|10v1\|ES433537_T1 | 6131 | 701 | 86.7 | glotblastn |
| 3125 | LAB455 | vinca\|11v1\|SRR098690X102884_T1 | 6132 | 701 | 85.64 | glotblastn |
| 3126 | LAB455 | tobacco\|gb162\|DV159878 | 6133 | 701 | 85.64 | glotblastn |
| 3127 | LAB455 | cacao\|10v1\|CU476207_T1 | 6134 | 701 | 85.11 | glotblastn |
| 3128 | LAB455 | cotton\|10v1\|BF272334 | 6135 | 701 | 85.11 | glotblastn |
| 3129 | LAB455 | orobanche\|10v1\|SRR023189S0005660_T1 | 6136 | 701 | 85.11 | glotblastn |
| 3130 | LAB455 | prunus\|10v1\|BU044033 | 6137 | 701 | 85.11 | glotblastn |
| 3131 | LAB455 | plantago\|11v1\|SRR066373X119928_T1 | 6138 | 701 | 84.57 | glotblastn |
| 3132 | LAB455 | platanus\|11v1\|SRR096786X128203_T1 | 6139 | 701 | 84.57 | glotblastn |
| 3133 | LAB455 | tabernaemontana\|11v1\|SRR098689X108953_T1 | 6140 | 701 | 84.57 | glotblastn |
| 3134 | LAB455 | strawberry\|11v1\|DY672071_T1 | 6141 | 701 | 84.57 | glotblastn |
| 3135 | LAB455 | strawberry\|gb164\|DY672071 | 6141 | 701 | 84.57 | glotblastn |
| 3136 | LAB455 | arabidopsis\|10v1\|AT3G51840_T1 | 6142 | 701 | 84.49 | glotblastn |
| 3137 | LAB455 | orange\|11v1\|CF420016_T1 | 6143 | 701 | 84.04 | glotblastn |
| 3138 | LAB455 | curcuma\|10v1\|DY394728_T1 | 6144 | 701 | 84.04 | glotblastn |
| 3139 | LAB455 | grape\|gb160\|BM436375_T1 | 6145 | 701 | 84.04 | glotblastn |
| 3140 | LAB455 | petunia\|gb171\|CV293390_T1 | 6146 | 701 | 84.04 | glotblastn |
| 3141 | LAB455 | aquilegia\|10v2\|DR924061_T1 | 6147 | 701 | 84.04 | glotblastn |
| 3142 | LAB455 | aquilegia\|10v1\|DR924061 | 6148 | 701 | 84 | globlastp |
| 3143 | LAB455 | cenchrus\|gb166\|EB658031_P1 | 6149 | 701 | 84 | globlastp |
| 3144 | LAB455 | b_juncea\|10v2\|E6ANDIZ02IJ7XV_T1 | 6150 | 701 | 83.96 | glotblastn |
| 3145 | LAB455 | phyla\|11v1\|SRR099035X130548_T1 | 6151 | 701 | 83.51 | glotblastn |
| 3146 | LAB455 | apple\|gb171\|CN873441 | 6152 | 701 | 83.51 | glotblastn |
| 3147 | LAB455 | b_oleracea\|gb161\|AM385387_T1 | 6153 | 701 | 83.51 | glotblastn |
| 3148 | LAB455 | citrus\|gb166\|CN190835_T1 | 6154 | 701 | 83.51 | glotblastn |
| 3149 | LAB455 | monkeyflower\|10v1\|CV519778_T1 | 6155 | 701 | 83.51 | glotblastn |
| 3150 | LAB455 | papaya\|gb165\|EX241287_T1 | 6156 | 701 | 83.51 | glotblastn |
| 3151 | LAB455 | fagopyrum\|11v1\|SRR063689X107698_P1 | 6157 | 701 | 83.5 | globlastp |
| 3152 | LAB455 | arnica\|11v1\|SRR099034X104301_T1 | 6158 | 701 | 83.42 | glotblastn |
| 3153 | LAB455 | silene\|11v1\|SRR096785X105839_T1 | 6159 | 701 | 83.42 | glotblastn |
| 3154 | LAB455 | arabidopsis_lyrata\|09v1\|JGIAL018392_T1 | 6160 | 701 | 83.42 | glotblastn |
| 3155 | LAB455 | oil_palm\|gb166\|ES370691_P1 | 6161 | 701 | 83.1 | globlastp |
| 3156 | LAB455 | b_rapa\|gb162\|BG543379_T1 | 6162 | 701 | 82.98 | glotblastn |
| 3157 | LAB455 | cacao\|gb167\|CU476207 | 6163 | 701 | 82.98 | glotblastn |
| 3158 | LAB455 | canola\|10v1\|CD817598_T1 | 6164 | 701 | 82.98 | glotblastn |
| 3159 | LAB455 | canola\|10v1\|CD823781_T1 | 6165 | 701 | 82.98 | glotblastn |
| 3160 | LAB455 | pepper\|gb171\|CA516989_T1 | 6166 | 701 | 82.98 | glotblastn |
| 3161 | LAB455 | solanum_phureja\|09v1\|SPHBG125696 | 6167 | 701 | 82.98 | glotblastn |
| 3162 | LAB455 | amaranthus\|10v1\|SRR039411S0018492_T1 | 6168 | 701 | 82.89 | glotblastn |
| 3163 | LAB455 | chelidonium\|11v1\|SRR084752X101861_T1 | 6169 | 701 | 82.89 | glotblastn |
| 3164 | LAB455 | cassava\|09v1\|DV451030_T1 | 6170 | 701 | 82.45 | glotblastn |
| 3165 | LAB455 | castorbean\|09v1\|GE632339_T1 | 6171 | 701 | 82.45 | glotblastn |
| 3166 | LAB455 | radish\|gb164\|EV531397 | 6172 | 701 | 82.45 | glotblastn |
| 3167 | LAB455 | primula\|11v1\|SRR098679X147729_T1 | 6173 | 701 | 82.35 | glotblastn |
| 3168 | LAB455 | ipomoea_ni1\|10v1\|BJ574546_P1 | 6174 | 701 | 82.3 | globlastp |
| 3169 | LAB455 | cynara\|gb167\|GE580645_T1 | 6175 | 701 | 82.01 | glotblastn |
| 3170 | LAB455 | tomato\|10v1\|BG125696_T1 | 6176 | 701 | 81.91 | glotblastn |
| 3171 | LAB455 | melon\|10v1\|DV634699_T1 | 6177 | 701 | 81.91 | glotblastn |
| 3172 | LAB455 | poplar\|10v1\|BI121071_T1 | 6178 | 701 | 81.91 | glotblastn |
| 3173 | LAB455 | tomato\|09v1\|BG125696 | 6179 | 701 | 81.91 | glotblastn |
| 3174 | LAB455 | tragopogon\|10v1\|SRR020205S0018736 | 6180 | 701 | 81.68 | glotblastn |
| 3175 | LAB455 | triphysaria\|10v1\|SRR023500S0107504 | 6181 | 701 | 81.4 | globlastp |
| 3176 | LAB455 | eucalyptus\|11v2\|CU401703_T1 | 6182 | 701 | 81.38 | glotblastn |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3177 | LAB455 | euonymus\|11v1\|SRR070038X104719_T1 | 6183 | 701 | 81.38 | glotblastn |
| 3178 | LAB455 | tripterygium\|11v1\|SRR098677X11979_T1 | 6184 | 701 | 81.38 | glotblastn |
| 3179 | LAB455 | cucumber\|09v1\|C0995743_T1 | 6185 | 701 | 81.38 | glotblastn |
| 3180 | LAB455 | nasturtium\|10v1\|AY600434_T1 | 6186 | 701 | 81.38 | glotblastn |
| 3181 | LAB455 | solanum_phureja\|09v1\|SPHBG626820 | 6187 | 701 | 81.38 | glotblastn |
| 3182 | LAB455 | tomato\|09v1\|BG626820 | 6188 | 701 | 81.38 | glotblastn |
| 3183 | LAB455 | tomato\|10v1\|BG626820_T1 | 6188 | 701 | 81.38 | glotblastn |
| 3184 | LAB455 | wheat\|gb164\|CA712613 | 6189 | 701 | 81.3 | globlastp |
| 3185 | LAB455 | cichorium\|gb171\|EH676184_T1 | 6190 | 701 | 81.28 | glotblastn |
| 3186 | LAB455 | cowpea\|gb166\|FF388357_T1 | 6191 | 701 | 81.28 | glotblastn |
| 3187 | LAB455 | lettuce\|10v1\|DW060670_T1 | 6192 | 701 | 81.28 | glotblastn |
| 3188 | LAB455 | pigeonpea\|10v1\|SRR054580S0014262_T1 | 6193 | 701 | 81.28 | glotblastn |
| 3189 | LAB455 | soybean\|11v1\|GLYMA03G07540_T1 | 6194 | 701 | 81.28 | glotblastn |
| 3190 | LAB455 | soybean\|gb168\|AW719757 | 6194 | 701 | 81.28 | glotblastn |
| 3191 | LAB455 | soybean\|11v1\|GLYMA18G43240_T1 | 6195 | 701 | 81.28 | glotblastn |
| 3192 | LAB455 | soybean\|gb168\|BE322144 | 6196 | 701 | 81.28 | glotblastn |
| 3193 | LAB455 | cucurbita\|11v1\|SRR091276X101434_T1 | 6197 | 701 | 80.85 | glotblastn |
| 3194 | LAB455 | euphorbia\|11v1\|DV124910_T1 | 6198 | 701 | 80.85 | glotblastn |
| 3195 | LAB455 | zostera\|10v1\|SRR057351S0100351_T1 | 6199 | 701 | 80.85 | glotblastn |
| 3196 | LAB455 | artemisia\|10v1\|EY037729_T1 | 6200 | 701 | 80.85 | glotblastn |
| 3197 | LAB455 | chestnut\|gb170\|SRR006295S0021149_T1 | 6201 | 701 | 80.85 | glotblastn |
| 3198 | LAB455 | poplar\|10v1\|BI126002_T1 | 6202 | 701 | 80.85 | glotblastn |
| 3199 | LAB455 | radish\|gb164\|EV526089 | 6203 | 701 | 80.85 | glotblastn |
| 3200 | LAB455 | ceratodon\|10v1\|SRR074890S0059059_T1 | 6204 | 701 | 80.75 | glotblastn |
| 3201 | LAB455 | centaurea\|gb166\|EL933435_T1 | 6205 | 701 | 80.75 | glotblastn |
| 3202 | LAB455 | cephalotaxus\|11v1\|SRR064395X114642_T1 | 6206 | 701 | 80.53 | glotblastn |
| 3203 | LAB455 | sciadopitys\|10v1\|SRR065035S0000457_T1 | 6207 | 701 | 80.53 | glotblastn |
| 3204 | LAB455 | thalictrum\|11v1\|SRR096787X187102_T1 | 6208 | 701 | 80.32 | glotblastn |
| 3205 | LAB455 | b_rapa\|gb162\|L38172_T1 | 6209 | 701 | 80.32 | glotblastn |
| 3206 | LAB455 | canola\|10v1\|CD816329_T1 | 6210 | 701 | 80.32 | glotblastn |
| 3207 | LAB455 | canola\|10v1\|CD824759_T1 | 6209 | 701 | 80.32 | glotblastn |
| 3208 | LAB455 | potato\|10v1\|BQ514667_T1 | 6211 | 701 | 80.32 | glotblastn |
| 3209 | LAB455 | pepper\|gb171\|GD085194_P1 | 6212 | 701 | 80.3 | globlastp |
| 3210 | LAB455 | medicago\|09v1\|LLBE322144_T1 | 6213 | 701 | 80.21 | glotblastn |
| 3211 | LAB456 | wheat\|gb164\|BE405251 | 6214 | 702 | 83.7 | globlastp |
| 3212 | LAB459 | wheat\|10v2\|BE415422_P1 | 6215 | 703 | 83.6 | globlastp |
| 3213 | LAB459 | oak\|10v1\|DN950247_T1 | 6216 | 703 | 81.82 | glotblastn |
| 3214 | LAB459 | barley\|10v2\|BE438175_P1 | 6217 | 703 | 81.8 | globlastp |
| 3215 | LAB459 | lotus\|09v1\|AW719933_T1 | 6218 | 703 | 81.6 | glotblastn |
| 3216 | LAB459 | castorbean\|09v1\|EG658829_T1 | 6219 | 703 | 81.17 | glotblastn |
| 3217 | LAB459 | citrus\|gb166\|CB291343_T1 | 6220 | 703 | 80.95 | glotblastn |
| 3218 | LAB459 | papaya\|gb165\|EX249229_T1 | 6221 | 703 | 80.95 | glotblastn |
| 3219 | LAB459 | clementine\|11v1\|CB291343_T1 | 6222 | 703 | 80.74 | glotblastn |
| 3220 | LAB459 | euonymus\|11v1\|SRR070038X18006_T1 | 6223 | 703 | 80.74 | glotblastn |
| 3221 | LAB459 | orange\|11v1\|CB291343_T1 | 6222 | 703 | 80.74 | glotblastn |
| 3222 | LAB459 | soybean\|11v1\|GLYMA07G18570_T1 | 6224 | 703 | 80.74 | glotblastn |
| 3223 | LAB459 | soybean\|11v1\|GLYMA18G43460_T1 | 6225 | 703 | 80.74 | glotblastn |
| 3224 | LAB459 | cowpea\|gb166\|FC461603_T1 | 6226 | 703 | 80.74 | glotblastn |
| 3225 | LAB459 | ipomoea_batatas\|10v1\|BU690286_T1 | 6227 | 703 | 80.74 | glotblastn |
| 3226 | LAB459 | aquilegia\|10v2\|CRPAC032462_T1 | 6228 | 703 | 80.52 | glotblastn |
| 3227 | LAB459 | chestnut\|gb170\|FK868412_T1 | 6229 | 703 | 80.52 | glotblastn |
| 3228 | LAB459 | pigeonpea\|10v1\|GR466187_T1 | 6230 | 703 | 80.52 | glotblastn |
| 3229 | LAB459 | soybean\|11v1\|GLYMA01G29190_T1 | 6231 | 703 | 80.52 | glotblastn |
| 3230 | LAB459 | soybean\|gb168\|CA901821 | 6231 | 703 | 80.52 | glotblastn |
| 3231 | LAB459 | amsonia\|11v1\|SRR098688X193108_T1 | 6232 | 703 | 80.3 | glotblastn |
| 3232 | LAB459 | apple\|11v1\|CO066327_T1 | 6233 | 703 | 80.09 | glotblastn |
| 3233 | LAB459 | cotton\|10v2\|CO091554_T1 | 6234 | 703 | 80.09 | glotblastn |
| 3234 | LAB461 | wheat\|gb164\|CN011023 | 6235 | 704 | 96.71 | glotblastn |
| 3235 | LAB461 | wheat\|gb164\|BG262395 | 6236 | 704 | 96.05 | glotblastn |
| 3236 | LAB461 | oat\|10v2\|CN819886_T1 | 6237 | 704 | 92.76 | glotblastn |
| 3237 | LAB461 | millet\|10v1\|EVO454PM010706_T1 | 6238 | 704 | 90.79 | glotblastn |
| 3238 | LAB461 | leymus\|gb166\|EG401791_P1 | 6239 | 704 | 89.6 | globlastp |
| 3239 | LAB461 | foxtail_millet\|10v2\|FXTRMSLX00851320D2_T1 | 6240 | 704 | 88.16 | glotblastn |
| 3240 | LAB461 | sugarcane\|10v1\|CA078220 | 6241 | 704 | 86.84 | glotblastn |
| 3241 | LAB461 | cenchrus\|gb166\|EB655636_T1 | 6242 | 704 | 85.53 | glotblastn |
| 3242 | LAB461 | maize\|10v1\|AW163846_T1 | 6243 | 704 | 82.89 | glotblastn |
| 3243 | LAB461 | lolium\|10v1\|DT669608_P1 | 6244 | 704 | 81.9 | globlastp |
| 3244 | LAB462 | brachypodium\|09v1\|GT792505_P1 | 6245 | 705 | 83.6 | globlastp |
| 3245 | LAB463 | wheat\|gb164\|BE429980 | 6246 | 706 | 83.82 | glotblastn |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3246 | LAB464 | sugarcane\|10v1\|CA089151 | 6247 | 707 | 96.35 | glotblastn |
| 3247 | LAB464 | cassava\|09v1\|DV447845_T1 | 6248 | 707 | 85.71 | glotblastn |
| 3248 | LAB464 | aquilegia\|10v2\|DR927596_T1 | 6249 | 707 | 85.41 | glotblastn |
| 3249 | LAB464 | strawberry\|11v1\|EX671144_T1 | 6250 | 707 | 85.41 | glotblastn |
| 3250 | LAB464 | oak\|10v1\|FP034127_T1 | 6251 | 707 | 85.41 | glotblastn |
| 3251 | LAB464 | castorbean\|09v1\|XM002532058_T1 | 6252 | 707 | 85.11 | glotblastn |
| 3252 | LAB464 | cowpea\|gb166\|FF394905_T1 | 6253 | 707 | 85.11 | glotblastn |
| 3253 | LAB464 | chestnut\|gb170\|SRR006295S0012601_P1 | 6254 | 707 | 84.9 | globlastp |
| 3254 | LAB464 | apple\|11v1\|CN494888_T1 | 6255 | 707 | 84.8 | glotblastn |
| 3255 | LAB464 | nasturtium\|10v1\|SRR032558S0253186_T1 | 6256 | 707 | 84.8 | glotblastn |
| 3256 | LAB464 | soybean\|gb168\|AW350145 | 6257 | 707 | 84.8 | glotblastn |
| 3257 | LAB464 | aristolochia\|10v1\|FD763617_T1 | 6258 | 707 | 84.5 | glotblastn |
| 3258 | LAB464 | brachypodium\|09v1\|GT768019_T1 | 6259 | 707 | 84.5 | glotblastn |
| 3259 | LAB464 | cotton\|10v1\|BF274939 | 6260 | 707 | 84.5 | glotblastn |
| 3260 | LAB464 | pigeonpea\|10v1\|SRR054580S0001884_T1 | 6261 | 707 | 84.5 | glotblastn |
| 3261 | LAB464 | prunus\|10v1\|CN888983 | 6262 | 707 | 84.5 | glotblastn |
| 3262 | LAB464 | silene\|11v1\|SRR096785X107475_T1 | 6263 | 707 | 84.19 | glotblastn |
| 3263 | LAB464 | soybean\|11v1\|GLYMA01G29470_T1 | 6264 | 707 | 84.19 | glotblastn |
| 3264 | LAB464 | poplar\|10v1\|BI138453_T1 | 6265 | 707 | 84.19 | glotblastn |
| 3265 | LAB464 | spurge\|gb161\|DV127087 | 6266 | 707 | 84.19 | glotblastn |
| 3266 | LAB464 | arnica\|11v1\|SRR099034X109003_T1 | 6267 | 707 | 83.89 | glotblastn |
| 3267 | LAB464 | cotton\|10v2\|BF274939_T1 | 6268 | 707 | 83.89 | glotblastn |
| 3268 | LAB464 | cotton\|10v2\|DT465721_T1 | 6269 | 707 | 83.89 | glotblastn |
| 3269 | LAB464 | euphorbia\|11v1\|DV127087_T1 | 6270 | 707 | 83.89 | glotblastn |
| 3270 | LAB464 | trigonella\|11v1\|SRR066194X60645_T1 | 6271 | 707 | 83.89 | glotblastn |
| 3271 | LAB464 | wheat\|10v2\|BE404344_T1 | 6272 | 707 | 83.89 | glotblastn |
| 3272 | LAB464 | cotton\|10v2\|BM359748_T1 | 6273 | 707 | 83.89 | glotblastn |
| 3273 | LAB464 | cassava\|09v1\|DR086195_T1 | 6274 | 707 | 83.89 | glotblastn |
| 3274 | LAB464 | peanut\|10v1\|GO341557_T1 | 6275 | 707 | 83.89 | glotblastn |
| 3275 | LAB464 | rice\|gb170\|OS05G28180 | 6276 | 707 | 83.89 | glotblastn |
| 3276 | LAB464 | soybean\|11v1\|GLYMA03G07460_T1 | 6277 | 707 | 83.89 | glotblastn |
| 3277 | LAB464 | soybean\|gb168\|AF068127 | 6278 | 707 | 83.89 | glotblastn |
| 3278 | LAB464 | tomato\|09v1\|AW617132 | 6279 | 707 | 83.89 | glotblastn |
| 3279 | LAB464 | tomato\|10v1\|AW617132_T1 | 6279 | 707 | 83.89 | glotblastn |
| 3280 | LAB464 | wheat\|gb164\|BE404344 | 6280 | 707 | 83.89 | glotblastn |
| 3281 | LAB464 | poplar\|10v1\|BI128752_T1 | 6281 | 707 | 83.59 | glotblastn |
| 3282 | LAB464 | solanum_phureja\|09v1\|SPHAW617132 | 6282 | 707 | 83.59 | glotblastn |
| 3283 | LAB464 | millet\|10v1\|CD725941_T1 | 6283 | 707 | 83.33 | glotblastn |
| 3284 | LAB464 | cacao\|10v1\|CU482878_T1 | 6284 | 707 | 83.28 | glotblastn |
| 3285 | LAB464 | cichorium\|gb171\|EH688551_T1 | 6285 | 707 | 83.28 | glotblastn |
| 3286 | LAB464 | coffea\|10v1\|DV665252_T1 | 6286 | 707 | 83.28 | glotblastn |
| 3287 | LAB464 | cotton\|10v1\|AI055232 | 6287 | 707 | 83.28 | glotblastn |
| 3288 | LAB464 | cotton\|10v2\|AI055232_T1 | 6288 | 707 | 83.28 | glotblastn |
| 3289 | LAB464 | cucumber\|09v1\|CK754648_T1 | 6289 | 707 | 83.28 | glotblastn |
| 3290 | LAB464 | medicago\|09v1\|AW256344_T1 | 6290 | 707 | 83.28 | glotblastn |
| 3291 | LAB464 | melon\|10v1\|DV633001_T1 | 6291 | 707 | 83.28 | glotblastn |
| 3292 | LAB464 | monkeyflower\|10v1\|MGJGI004088_T1 | 6292 | 707 | 83.18 | glotblastn |
| 3293 | LAB464 | monkeyflower\|10v1\|GR117575_T1 | 6293 | 707 | 83.03 | glotblastn |
| 3294 | LAB464 | barley\|10v1\|BI948901 | 6294 | 707 | 82.98 | glotblastn |
| 3295 | LAB464 | barley\|10v2\|BI948901_T1 | 6294 | 707 | 82.98 | glotblastn |
| 3296 | LAB464 | potato\|10v1\|BE923677_T1 | 6295 | 707 | 82.98 | glotblastn |
| 3297 | LAB464 | centaurea\|gb166\|EH726020_P1 | 6296 | 707 | 82.9 | globlastp |
| 3298 | LAB464 | clementine\|11v1\|CX078011_T1 | 6297 | 707 | 82.88 | glotblastn |
| 3299 | LAB464 | zostera\|10v1\|SRR057351S0014137_T1 | 6298 | 707 | 82.83 | glotblastn |
| 3300 | LAB464 | switchgrass\|gb167\|FL696618 | 6299 | 707 | 82.73 | glotblastn |
| 3301 | LAB464 | aquilegia\|10v2\|DT757204_T1 | 6300 | 707 | 82.67 | glotblastn |
| 3302 | LAB464 | cichorium\|gb171\|EL345034_T1 | 6301 | 707 | 82.67 | glotblastn |
| 3303 | LAB464 | eucalyptus\|11v2\|ES591696_T1 | 6302 | 707 | 82.67 | glotblastn |
| 3304 | LAB464 | sunflower\|10v1\|DY936265 | 6303 | 707 | 82.67 | glotblastn |
| 3305 | LAB464 | citrus\|gb166\|CX078011_T1 | 6304 | 707 | 82.58 | glotblastn |
| 3306 | LAB464 | maize\|10v1\|AI891201_T1 | 6305 | 707 | 82.42 | glotblastn |
| 3307 | LAB464 | tabernaemontana\|11v1\|SRR098689X107115_T1 | 6306 | 707 | 82.37 | glotblastn |
| 3308 | LAB464 | canola\|10v1\|EG020771_T1 | 6307 | 707 | 82.37 | glotblastn |
| 3309 | LAB464 | sorghum\|09v1\|SB09G016850 | 6308 | 707 | 82.18 | glotblastn |
| 3310 | LAB464 | arabidopsis_lyrata\|09v1\|JGIAL015050_T1 | 6309 | 707 | 82.07 | glotblastn |
| 3311 | LAB464 | arabidopsis\|10v1\|AT2G38280_T1 | 6310 | 707 | 82.07 | glotblastn |
| 3312 | LAB464 | b_rapa\|gb162\|CO750284_T1 | 6311 | 707 | 82.07 | glotblastn |
| 3313 | LAB464 | triphysaria\|10v1\|EX986780 | 6312 | 707 | 82.07 | glotblastn |
| 3314 | LAB464 | cucurbita\|11v1\|SRR091276X131999_T1 | 6313 | 707 | 81.76 | glotblastn |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3315 | LAB464 | lettuce\|10v1\|DW073960_T1 | 6314 | 707 | 81.52 | glotblastn |
| 3316 | LAB464 | distylium\|11v1\|SRR065077X112208_T1 | 6315 | 707 | 81.16 | glotblastn |
| 3317 | LAB464 | radish\|gb164\|EV566112 | 6316 | 707 | 81.14 | glotblastn |
| 3318 | LAB464 | conyza\|10v1\|SRR035294S0001019_T1 | 6317 | 707 | 80.85 | glotblastn |
| 3319 | LAB464 | vinca\|11v1\|SRR098690X11116_T1 | 6318 | 707 | 80.85 | glotblastn |
| 3320 | LAB464 | cenchrus\|gb166\|EB657609_P1 | 6319 | 707 | 80.4 | globlastp |
| 3321 | LAB464 | pseudotsuga\|10v1\|SRR065119S0012036_T1 | 6320 | 707 | 80.24 | glotblastn |
| 3322 | LAB466 | wheat\|10v2\|BE416031_T1 | 6321 | 709 | 84.83 | glotblastn |
| 3323 | LAB466 | wheat\|10v2\|BQ161248_T1 | 6322 | 709 | 83.37 | glotblastn |
| 3324 | LAB466 | wheat\|10v2\|BF292726_T1 | 6323 | 709 | 83.08 | glotblastn |
| 3325 | LAB466 | wheat\|gb164\|CA676437 | 6324 | 709 | 80.3 | globlastp |
| 3326 | LAB467 | wheat\|10v2\|CA631582_T1 | 6325 | 710 | 91 | glotblastn |
| 3327 | LAB467 | wheat\|gb164\|CA631582 | 6326 | 710 | 80 | glotblastn |
| 3328 | LAB468 | oat\|10v2\|GR315539_T1 | 6327 | 711 | 92.13 | glotblastn |
| 3329 | LAB469 | wheat\|10v2\|BE515797_T1 | 6328 | 712 | 96.3 | glotblastn |
| 3330 | LAB469 | wheat\|gb164\|BE515797 | 6329 | 712 | 96.3 | glotblastn |
| 3331 | LAB469 | wheat\|gb164\|CD923975 | 6330 | 712 | 82.35 | glotblastn |
| 3332 | LAB469 | wheat\|gb164\|CD927217 | 6331 | 712 | 81.62 | glotblastn |
| 3333 | LAB469 | wheat\|10v2\|CD923975_T1 | 6332 | 712 | 81.62 | glotblastn |
| 3334 | LAB469 | barley\|10v2\|AV910568_T1 | 6333 | 712 | 80.88 | glotblastn |
| 3335 | LAB470 | wheat\|10v2\|CO349003_T1 | 6334 | 713 | 100 | glotblastn |
| 3336 | LAB470 | pseudoroegneria\|gb167\|FF351387 | 6335 | 713 | 100 | glotblastn |
| 3337 | LAB470 | rice\|gb170\|OS01G63910 | 6336 | 713 | 100 | glotblastn |
| 3338 | LAB470 | rice\|gb170\|OS07G27140 | 6337 | 713 | 100 | glotblastn |
| 3339 | LAB470 | wheat\|10v2\|BE429490_T1 | 6338 | 713 | 100 | glotblastn |
| 3340 | LAB470 | wheat\|gb164\|CA738308 | 6339 | 713 | 100 | glotblastn |
| 3341 | LAB470 | brachypodium\|09v1\|SRR031795S0051897_T1 | 6340 | 713 | 96 | glotblastn |
| 3342 | LAB470 | rice\|gb170\|OS02G20440 | 6341 | 713 | 96 | glotblastn |
| 3343 | LAB470 | sorghum\|09v1\|SB03G040430 | 6342 | 713 | 96 | glotblastn |
| 3344 | LAB470 | sugarcane\|10v1\|CA148810 | 6343 | 713 | 96 | glotblastn |
| 3345 | LAB470 | aquilegia\|10v2\|JGIAC026979_T1 | 6344 | 713 | 92 | glotblastn |
| 3346 | LAB470 | foxtail_millet\|10v2\|SICRP001563_T1 | 6345 | 713 | 92 | glotblastn |
| 3347 | LAB470 | maize\|10v1\|BE122981_T1 | 6346 | 713 | 92 | glotblastn |
| 3348 | LAB470 | maize\|10v1\|BE238468_T1 | 6347 | 713 | 92 | glotblastn |
| 3349 | LAB470 | oat\|10v2\|GO598071_T1 | 6348 | 713 | 92 | glotblastn |
| 3350 | LAB470 | switchgrass\|gb167\|FL732117 | 6349 | 713 | 92 | glotblastn |
| 3351 | LAB470 | switchgrass\|gb167\|FL761976 | 6350 | 713 | 92 | glotblastn |
| 3352 | LAB470 | apple\|11v1\|CN916684_T1 | 6351 | 713 | 92 | glotblastn |
| 3353 | LAB470 | cacao\|10v1\|CU572264_T1 | 6352 | 713 | 88 | glotblastn |
| 3354 | LAB470 | clementine\|11v1\|CB610536_T1 | 6353 | 713 | 88 | glotblastn |
| 3355 | LAB470 | cotton\|10v2\|SRR032367S0482624_T1 | 6354 | 713 | 88 | glotblastn |
| 3356 | LAB470 | eucalyptus\|11v2\|DRR000893X1065623_T1 | 6355 | 713 | 88 | glotblastn |
| 3357 | LAB470 | eucalyptus\|11v2\|SRR001661X319455_T1 | 6356 | 713 | 88 | glotblastn |
| 3358 | LAB470 | orange\|11v1\|CB610536_T1 | 6357 | 713 | 88 | glotblastn |
| 3359 | LAB470 | silene\|11v1\|SRR096785X220918_T1 | 6358 | 713 | 88 | glotblastn |
| 3360 | LAB470 | strawberry\|11v1\|SRR034839S0004911_T1 | 6359 | 713 | 88 | glotblastn |
| 3361 | LAB470 | tripterygium\|11v1\|SRR098677X101338_T1 | 6360 | 713 | 88 | glotblastn |
| 3362 | LAB470 | apple\|gb171\|CO052812 | 6361 | 713 | 88 | glotblastn |
| 3363 | LAB470 | arabidopsis_lyrata\|09v1\|JGIAL002054_T1 | 6362 | 713 | 88 | glotblastn |
| 3364 | LAB470 | arabidopsis\|10v1\|AT1G19485_T1 | 6363 | 713 | 88 | glotblastn |
| 3365 | LAB470 | artemisia\|10v1\|EY078945_T1 | 6364 | 713 | 88 | glotblastn |
| 3366 | LAB470 | b_juncea\|10v2\|BJ1SLX00165118D1_T1 | 6365 | 713 | 88 | glotblastn |
| 3367 | LAB470 | cotton\|10v1\|SRR032367S0029610 | 6366 | 713 | 88 | glotblastn |
| 3368 | LAB470 | lettuce\|10v1\|BQ873726_T1 | 6367 | 713 | 88 | glotblastn |
| 3369 | LAB470 | millet\|10v1\|EVO454PM031664_T1 | 6368 | 713 | 88 | glotblastn |
| 3370 | LAB470 | wheat\|gb164\|BJ267232 | 6369 | 713 | 88 | glotblastn |
| 3371 | LAB470 | beet\|gb162\|BQ593934_T1 | — | 713 | 88 | glotblastn |
| 3372 | LAB470 | aristolochia\|10v1\|SRR039082S0261653_T1 | 6370 | 713 | 84 | glotblastn |
| 3373 | LAB470 | euonymus\|11v1\|SRR070038X393092_T1 | 6371 | 713 | 84 | glotblastn |
| 3374 | LAB470 | olea\|11v1\|SRR014463.2164_T1 | 6372 | 713 | 84 | glotblastn |
| 3375 | LAB470 | strawberry\|11v1\|DY670846_T1 | 6373 | 713 | 84 | glotblastn |
| 3376 | LAB470 | tomato\|10v1\|AW623105_T1 | 6374 | 713 | 84 | glotblastn |
| 3377 | LAB470 | barley\|10v1\|BG417746 | 6375 | 713 | 84 | glotblastn |
| 3378 | LAB470 | barley\|10v2\|BG417746_T1 | 6376 | 713 | 84 | glotblastn |
| 3379 | LAB470 | canola\|10v1\|EE507557_T1 | 6377 | 713 | 84 | glotblastn |
| 3380 | LAB470 | canola\|10v1\|EE561082_T1 | 6378 | 713 | 84 | glotblastn |
| 3381 | LAB470 | poplar\|10v1\|CV240140_T1 | 6379 | 713 | 84 | glotblastn |
| 3382 | LAB470 | prunus\|10v1\|PPA024767M | 6380 | 713 | 84 | glotblastn |
| 3383 | LAB470 | solanum_phureja\|09v1\|SPHAW623105 | 6381 | 713 | 84 | glotblastn |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3384 | LAB470 | tomato\|09v1\|AW623105 | 6382 | 713 | 84 | glotblastn |
| 3385 | LAB470 | cucurbita\|11v1\|SRR091276X289484_T1 | — | 713 | 84 | glotblastn |
| 3386 | LAB470 | thellungiella\|gb167\|BY828779 | — | 713 | 84 | glotblastn |
| 3387 | LAB470 | arnica\|11v1\|SRR099034X113601_T1 | 6383 | 713 | 80 | glotblastn |
| 3388 | LAB470 | cephalotaxus\|11v1\|SRR064395X148406_T1 | 6384 | 713 | 80 | glotblastn |
| 3389 | LAB470 | maritime_pine\|10v1\|SRR073317S0371549_T1 | 6385 | 713 | 80 | glotblastn |
| 3390 | LAB470 | pine\|10v2\|AW736889_T1 | 6386 | 713 | 80 | glotblastn |
| 3391 | LAB470 | podocarpus\|10v1\|SRR065014S0073069_T1 | 6387 | 713 | 80 | glotblastn |
| 3392 | LAB470 | pseudotsuga\|10v1\|SRR065119S0134257_T1 | 6388 | 713 | 80 | glotblastn |
| 3393 | LAB470 | sciadopitys\|10v1\|SRR065035S0021901_T1 | 6389 | 713 | 80 | glotblastn |
| 3394 | LAB470 | artemisia\|10v1\|EY112125_T1 | 6390 | 713 | 80 | glotblastn |
| 3395 | LAB470 | cassava\|09v1\|DV446170_T1 | 6391 | 713 | 80 | glotblastn |
| 3396 | LAB470 | castorbean\|09v1\|XM002528689_T1 | 6392 | 713 | 80 | glotblastn |
| 3397 | LAB470 | castorbean\|09v1\|XM002533499_T1 | 6393 | 713 | 80 | glotblastn |
| 3398 | LAB470 | centaurea\|gb166\|EH774203_T1 | 6394 | 713 | 80 | glotblastn |
| 3399 | LAB470 | chestnut\|gb170\|SRR006299S0007598_T1 | 6395 | 713 | 80 | glotblastn |
| 3400 | LAB470 | cryptomeria\|gb166\|BY910004_T1 | 6396 | 713 | 80 | glotblastn |
| 3401 | LAB470 | monkeyflower\|10v1\|GR033018_T1 | 6397 | 713 | 80 | glotblastn |
| 3402 | LAB470 | nasturtium\|10v1\|SRR032558S0031366_T1 | 6398 | 713 | 80 | glotblastn |
| 3403 | LAB470 | oak\|10v1\|FP039546_T1 | 6399 | 713 | 80 | glotblastn |
| 3404 | LAB470 | pigeonpea\|10v1\|SRR054580S0052632_T1 | 6400 | 713 | 80 | glotblastn |
| 3405 | LAB470 | pine\|10v1\|GT238421 | 6401 | 713 | 80 | glotblastn |
| 3406 | LAB470 | rhizophora\|10v1\|SRR005793S0065110 | 6402 | 713 | 80 | glotblastn |
| 3407 | LAB470 | spruce\|gb162\|CO225305 | 6403 | 713 | 80 | glotblastn |
| 3408 | LAB470 | liquorice\|gb171\|FS249434_T1 | — | 713 | 80 | glotblastn |
| 3409 | LAB472 | wheat\|gb164\|CA659853 | 6404 | 715 | 97.73 | glotblastn |
| 3410 | LAB472 | sugarcane\|10v1\|CA071924 | 6405 | 715 | 89 | glotblastn |
| 3411 | LAB472 | switchgrass\|gb167\|FL694689 | 6406 | 715 | 87.7 | glotblastn |
| 3412 | LAB472 | millet\|10v1\|EVO454PM039485_T1 | 6407 | 715 | 87.38 | glotblastn |
| 3413 | LAB473 | wheat\|gb164\|BE418766 | 6408 | 716 | 93.92 | glotblastn |
| 3414 | LAB473 | wheat\|10v2\|CJ541752_T1 | 6409 | 716 | 93.24 | glotblastn |
| 3415 | LAB473 | oat\|10v2\|GR316482_T1 | 6410 | 716 | 80.54 | glotblastn |
| 3416 | LAB474 | wheat\|gb164\|BE404260 | 6411 | 717 | 91.74 | glotblastn |
| 3417 | LAB476 | oat\|10v2\|CN818400_T1 | 6412 | 719 | 88.79 | glotblastn |
| 3418 | LAB476 | sugarcane\|10v1\|CA163724 | 6413 | 719 | 88.03 | glotblastn |
| 3419 | LAB476 | millet\|10v1\|EVO454PM142024_T1 | 6414 | 719 | 87.93 | glotblastn |
| 3420 | LAB476 | wheat\|gb164\|CA484304 | 6415 | 719 | 85.47 | glotblastn |
| 3421 | LAB476 | maize\|10v1\|AI677335_T1 | 6416 | 719 | 85.34 | glotblastn |
| 3422 | LAB476 | switchgrass\|gb167\|DN150355 | 6417 | 719 | 83.5 | globlastp |
| 3423 | LAB477 | sugarcane\|10v1\|BU102701 | 6418 | 720 | 83.33 | glotblastn |
| 3424 | LAB477 | foxtail_millet\|10v2\|FXTRMSLX04795620D1_T1 | 6419 | 720 | 81.58 | glotblastn |
| 3425 | LAB477 | cenchrus\|gb166\|EB653350_T1 | 6420 | 720 | 80.7 | glotblastn |
| 3426 | LAB477 | millet\|10v1\|EVO454PM020507_T1 | 6421 | 720 | 80.7 | glotblastn |
| 3427 | LAB477 | switchgrass\|gb167\|FL820217 | 6422 | 720 | 80.7 | glotblastn |
| 3428 | LAB488 | cacao\|10v1\|CGD0019017_T1 | 6423 | 723 | 87.31 | glotblastn |
| 3429 | LAB488 | poplar\|10v1\|BI131443_T1 | 6424 | 723 | 86.79 | glotblastn |
| 3430 | LAB488 | soybean\|gb168\|SB2GWP034850 | 6425 | 723 | 85.23 | glotblastn |
| 3431 | LAB488 | prunus\|10v1\|DW344578 | 6426 | 723 | 85.01 | glotblastn |
| 3432 | LAB488 | iceplant\|gb164\|AW266788_T1 | 6427 | 723 | 84.72 | glotblastn |
| 3433 | LAB488 | arabidopsis_lyrata\|09v1\|JGIAL021221_T1 | 6428 | 723 | 84.2 | glotblastn |
| 3434 | LAB488 | arabidopsis\|10v1\|AT5G15250_T1 | 6429 | 723 | 84.06 | glotblastn |
| 3435 | LAB488 | castorbean\|09v1\|XM002531813_T1 | 6430 | 723 | 83.72 | glotblastn |
| 3436 | LAB488 | soybean\|11v1\|GLYMA09G37250_T1 | 6431 | 723 | 83.16 | glotblastn |
| 3437 | LAB488 | tobacco\|gb162\|EB429572 | 6432 | 723 | 82.9 | glotblastn |
| 3438 | LAB488 | aquilegia\|10v2\|JGIAC008370_T1 | 6433 | 723 | 82.64 | glotblastn |
| 3439 | LAB488 | sorghum\|09v1\|SB10G008130 | 6434 | 723 | 80.05 | glotblastn |
| 3440 | LAB489 | cotton\|10v2\|SRR032881S0713676_P1 | 6435 | 724 | 86.3 | globlastp |
| 3441 | LAB489 | cotton\|10v2\|SRR032877S0749979_P1 | 6436 | 724 | 86 | globlastp |
| 3442 | LAB489 | cotton\|10v1\|CO074517 | 6437 | 724 | 84.8 | globlastp |
| 3443 | LAB489 | cacao\|10v1\|CU473139_T1 | 6438 | 724 | 80.55 | glotblastn |
| 3444 | LAB493 | cotton\|10v2\|SRR032367S0761567_T1 | 6439 | 725 | 98.83 | glotblastn |
| 3445 | LAB503 | foxtail_millet\|10v2\|EC613093_T1 | 6440 | 726 | 87.88 | glotblastn |
| 3446 | LAB503 | maize\|10v1\|AI622418_T1 | 6441 | 726 | 87.88 | glotblastn |
| 3447 | LAB503 | wheat\|10v2\|CA486703_P1 | 6442 | 726 | 87.3 | globlastp |
| 3448 | LAB503 | switchgrass\|gb167\|FL690074 | 6443 | 726 | 86.9 | globlastp |
| 3449 | LAB503 | leymus\|gb166\|EG398353_T1 | 6444 | 726 | 85.61 | glotblastn |
| 3450 | LAB503 | momordica\|10v1\|EC612508_T1 | 6445 | 726 | 84.85 | glotblastn |
| 3450 | LAB503 | foxtail_millet\|09v1\|EC612508 | 6445 | 726 | 84.85 | glotblastn |
| 3451 | LAB503 | avocado\|10v1\|CO997108_T1 | 6446 | 726 | 84.85 | glotblastn |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3452 | LAB503 | pseudoroegneria\|gb167\|FF345206 | 6447 | 726 | 84.85 | glotblastn |
| 3453 | LAB503 | wheat\|gb164\|BQ295091 | 6448 | 726 | 84.85 | glotblastn |
| 3454 | LAB503 | cenchrus\|gb166\|EB652750_P1 | 6449 | 726 | 84.8 | globlastp |
| 3455 | LAB503 | olea\|11v1\|SRR014463.37108_P1 | 6450 | 726 | 84.1 | globlastp |
| 3456 | LAB503 | cryptomeria\|gb166\|BP174271_P1 | 6451 | 726 | 83.5 | globlastp |
| 3457 | LAB503 | amborella\|gb166\|FD426014_T1 | 6452 | 726 | 83.33 | glotblastn |
| 3458 | LAB503 | eucalyptus\|gb166\|CT983549 | 6453 | 726 | 83.33 | glotblastn |
| 3459 | LAB503 | pseudoroegneria\|gb167\|FF355997 | 6454 | 726 | 83.33 | glotblastn |
| 3460 | LAB503 | wheat\|gb164\|BE471126 | 6455 | 726 | 83.33 | glotblastn |
| 3461 | LAB503 | leymus\|gb166\|EG375861_T1 | 6456 | 726 | 82.58 | glotblastn |
| 3462 | LAB503 | rhizophora\|10v1\|SRR005793S0024899 | 6457 | 726 | 82.58 | glotblastn |
| 3463 | LAB503 | humulus\|11v1\|FG345974_P1 | 6458 | 726 | 82.3 | globlastp |
| 3464 | LAB503 | cenchrus\|gb166\|EB654579_P1 | 6459 | 726 | 82.3 | globlastp |
| 3465 | LAB503 | cucurbita\|11v1\|SRR091276X112950_T1 | 6460 | 726 | 81.82 | glotblastn |
| 3466 | LAB503 | primula\|11v1\|SRR098679X121412_T1 | 6461 | 726 | 81.82 | glotblastn |
| 3467 | LAB503 | basilicum\|10v1\|DY323306_T1 | 6462 | 726 | 81.82 | glotblastn |
| 3468 | LAB503 | basilicum\|10v1\|DY332588_T1 | 6463 | 726 | 81.82 | glotblastn |
| 3469 | LAB503 | lotus\|09v1\|LLBU494107_T1 | 6464 | 726 | 81.82 | glotblastn |
| 3470 | LAB503 | peanut\|10v1\|EL966834_T1 | 6465 | 726 | 81.82 | glotblastn |
| 3471 | LAB503 | rye\|gb164\|BE494481 | 6466 | 726 | 81.82 | glotblastn |
| 3472 | LAB503 | tamarix\|gb166\|EG968030 | 6467 | 726 | 81.82 | glotblastn |
| 3473 | LAB503 | curcuma\|10v1\|DY390948_T1 | 6468 | 726 | 81.54 | glotblastn |
| 3474 | LAB503 | papaya\|gb165\|EX258639_P1 | 6469 | 726 | 81.5 | globlastp |
| 3475 | LAB503 | chestnut\|gb170\|SRR006295S0001012_T1 | 6470 | 726 | 81.06 | glotblastn |
| 3476 | LAB503 | coffea\|10v1\|DV665201_T1 | 6471 | 726 | 81.06 | glotblastn |
| 3477 | LAB503 | orobanche\|10v1\|SRR023189S0028079_T1 | 6472 | 726 | 81.06 | glotblastn |
| 3478 | LAB503 | cotton\|10v2\|BG440616_T1 | 6473 | 726 | 80.3 | glotblastn |
| 3479 | LAB503 | fagopyrum\|11v1\|SRR063689X124456_T1 | 6474 | 726 | 80.3 | glotblastn |
| 3480 | LAB503 | parthenium\|10v1\|GW775914_T1 | 6475 | 726 | 80.3 | glotblastn |
| 3481 | LAB503 | pigeonpea\|10v1\|SRR054580S0011904_T1 | 6476 | 726 | 80.3 | glotblastn |
| 3482 | LAB503 | sunflower\|10v1\|CD847032 | 6477 | 726 | 80.3 | glotblastn |
| 3483 | LAB503 | cichorium\|gb171\|EH700569_P1 | 6478 | 726 | 80 | globlastp |
| 3484 | LAB503 | eggplant\|10v1\|FS082854_T1 | 6479 | 726 | 80 | glotblastn |
| 3485 | LAB503 | lolium\|10v1\|SRR029311S0018795_P1 | 6480 | 726 | 80 | globlastp |
| 3486 | LAB503 | pepper\|gb171\|AA840651_P1 | 6481 | 726 | 80 | globlastp |
| 3487 | LAB542 | switchgrass\|gb167\|FL837238 | 6482 | 728 | 80.77 | glotblastn |
| 3488 | LAB542 | switchgrass\|gb167\|FL899919 | 6483 | 728 | 80.69 | glotblastn |
| 3489 | LAB549 | sugarcane\|10v1\|CA067226 | 6484 | 729 | 91.96 | glotblastn |
| 3490 | LAB604 | cacao\|10v1\|CU499539_P1 | 6485 | 734 | 82.4 | globlastp |
| 3491 | LAB393 | brachypodium\|09v1\|SRR031798S0222973_P1 | 6486 | 735 | 84.7 | globlastp |
| 3492 | LAB397 | solanum_phureja\|09v1\|SPHAW934380 | 6487 | 737 | 90.7 | globlastp |
| 3493 | LAB397 | potato\|10v1\|BG599135_P1 | 6488 | 737 | 90.3 | globlastp |
| 3494 | LAB398 | eggplant\|10v1\|FS000450_P1 | 6489 | 738 | 83.8 | globlastp |
| 3495 | LAB404 | brachypodium\|09v1\|GT795383_P1 | 6490 | 741 | 80.5 | globlastp |
| 3496 | LAB405 | wheat\|gb164\|BE429023 | 6491 | 742 | 97.44 | glotblastn |
| 3497 | LAB405 | wheat\|10v2\|BE429023_P1 | 6492 | 742 | 96.6 | globlastp |
| 3498 | LAB405 | wheat\|10v2\|CA501450_P1 | 6493 | 742 | 95.8 | globlastp |
| 3499 | LAB405 | wheat\|gb164\|CA501450 | 6493 | 742 | 95.8 | globlastp |
| 3500 | LAB405 | wheat\|gb164\|BE428209 | 6494 | 742 | 95 | globlastp |
| 3501 | LAB405 | wheat\|10v2\|BE428209_P1 | 6494 | 742 | 95 | globlastp |
| 3502 | LAB405 | wheat\|gb164\|BE429785 | 6495 | 742 | 94 | globlastp |
| 3503 | LAB408 | lettuce\|10v1\|DW136409_P1 | 6496 | 744 | 88.4 | globlastp |
| 3504 | LAB408 | centaurea\|gb166\|EL932958_P1 | 6497 | 744 | 86.6 | globlastp |
| 3505 | LAB408 | artemisia\|10v1\|EY065772_P1 | 6498 | 744 | 86 | globlastp |
| 3506 | LAB408 | sunflower\|10v1\|CD848782_P1 | 6499 | 744 | 84.4 | globlastp |
| 3507 | LAB408 | vinca\|11v1\|SRR098679X123571_P1 | 6500 | 744 | 83.9 | globlastp |
| 3508 | LAB408 | euphorbia\|11v1\|SRR098678X108688_T1 | 6501 | 744 | 83.87 | glotblastn |
| 3509 | LAB408 | primula\|11v1\|SRR098679X104233_P1 | 6502 | 744 | 83.6 | globlastp |
| 3510 | LAB408 | cotton\|10v2\|AI055089_P1 | 6503 | 744 | 83.5 | globlastp |
| 3511 | LAB408 | strawberry\|11v1\|DY672590_P1 | 6504 | 744 | 83.4 | globlastp |
| 3512 | LAB408 | catharanthus\|11v1\|EG558870_P1 | 6505 | 744 | 83.3 | globlastp |
| 3513 | LAB408 | prunus\|10v1\|CB819363_P1 | 6506 | 744 | 83.3 | globlastp |
| 3514 | LAB408 | cynara\|gb167\|GE584589_P1 | 6507 | 744 | 83.3 | globlastp |
| 3515 | LAB408 | chestnut\|gb170\|SRR006295S0004890_P1 | 6508 | 744 | 83.1 | globlastp |
| 3516 | LAB408 | eucalyptus\|11v2\|CD669312_P1 | 6509 | 744 | 83.1 | globlastp |
| 3517 | LAB408 | nasturtium\|10v1\|SRR032558S0106767_P1 | 6510 | 744 | 83.1 | globlastp |
| 3518 | LAB408 | cacao\|10v1\|CF974368_P1 | 6511 | 744 | 82.9 | globlastp |
| 3519 | LAB408 | grape\|gb160\|BM437741_P1 | 6512 | 744 | 82.9 | globlastp |
| 3520 | LAB408 | apple\|11v1\|CN861129_P1 | 6513 | 744 | 82.8 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3521 | LAB408 | canola\|10v1\|AY642433_P1 | 6514 | 744 | 82.8 | globlastp |
| 3522 | LAB408 | humulus\|11v1\|EX519239_P1 | 6515 | 744 | 82.6 | globlastp |
| 3523 | LAB408 | b_rapa\|gb162\|AT000688_P1 | 6516 | 744 | 82.5 | globlastp |
| 3524 | LAB408 | kiwi\|gb166\|FG477785_P1 | 6517 | 744 | 82.5 | globlastp |
| 3525 | LAB408 | radish\|gb164\|EV538262_P1 | 6518 | 744 | 82.5 | globlastp |
| 3526 | LAB408 | citrus\|gb166\|CB322155_P1 | 6519 | 744 | 82.4 | globlastp |
| 3527 | LAB408 | clementine\|11v1\|CB322155_P1 | 6519 | 744 | 82.4 | globlastp |
| 3528 | LAB408 | oak\|10v1\|CU657582_P1 | 6520 | 744 | 82.4 | globlastp |
| 3529 | LAB408 | poplar\|10v1\|BI069708_P1 | 6521 | 744 | 82.4 | globlastp |
| 3530 | LAB408 | papaya\|gb165\|EX242432_P1 | 6522 | 744 | 82.3 | globlastp |
| 3531 | LAB408 | tobacco\|gb162\|TOBWIPK_P1 | 6523 | 744 | 82.1 | globlastp |
| 3532 | LAB408 | cucumber\|09v1\|AF529238_P1 | 6524 | 744 | 82 | globlastp |
| 3533 | LAB408 | oak\|10v1\|SRR039735S0083114_T1 | 6525 | 744 | 81.91 | glotblastn |
| 3534 | LAB408 | walnuts\|gb166\|CB304108_P1 | 6526 | 744 | 81.9 | globlastp |
| 3535 | LAB408 | melon\|10v1\|AM715719_P1 | 6527 | 744 | 81.7 | globlastp |
| 3536 | LAB408 | soybean\|11v1\|GLYMA11G15700_P1 | 6528 | 744 | 81.7 | globlastp |
| 3537 | LAB408 | soybean\|11v1\|GLYMA12G07770_P1 | 6529 | 744 | 81.7 | globlastp |
| 3538 | LAB408 | arabidopsis_lyrata\|09v1\|JGIAL017621_T1 | 6530 | 744 | 81.5 | glotblastn |
| 3539 | LAB408 | b_oleracea\|gb161\|AM058587_P1 | 6531 | 744 | 81.5 | globlastp |
| 3540 | LAB408 | potato\|10v1\|BG597996_P1 | 6532 | 744 | 81.5 | globlastp |
| 3541 | LAB408 | nicotiana_benthamiana\|gb162\|AB098729_P1 | 6533 | 744 | 81.4 | globlastp |
| 3542 | LAB408 | silene\|11v1\|SRR096785X119655_P1 | 6534 | 744 | 81.4 | globlastp |
| 3543 | LAB408 | solanum_phureja\|09v1\|SPHAI487449_P1 | 6535 | 744 | 81.2 | globlastp |
| 3544 | LAB408 | arabidopsis\|10v1\|AT3G45640_P1 | 6536 | 744 | 81 | globlastp |
| 3545 | LAB408 | tomato\|10v1\|AI487449_P1 | 6537 | 744 | 81 | globlastp |
| 3546 | LAB408 | peanut\|10v1\|GFXEU182580X1_P1 | 6538 | 744 | 80.9 | globlastp |
| 3547 | LAB408 | arnica\|11v1\|SRR099034X11397_P1 | 6539 | 744 | 80.6 | globlastp |
| 3548 | LAB408 | bean\|gb167\|BQ481787_P1 | 6540 | 744 | 80.6 | globlastp |
| 3549 | LAB408 | liquorice\|gb171\|FS241463_P1 | 6541 | 744 | 80.6 | globlastp |
| 3550 | LAB408 | apple\|11v1\|CN878512_P1 | 6542 | 744 | 80.5 | globlastp |
| 3551 | LAB408 | ipomoea_batatas\|10v1\|AF149424_P1 | 6543 | 744 | 80.4 | globlastp |
| 3552 | LAB408 | poplar\|10v1\|BU815867_P1 | 6544 | 744 | 80.4 | globlastp |
| 3553 | LAB408 | cassava\|09v1\|CK901347_T1 | 6545 | 744 | 80.38 | glotblastn |
| 3554 | LAB408 | cotton\|10v2\|AI727844_P1 | 6546 | 744 | 80.3 | globlastp |
| 3555 | LAB408 | platanus\|11v1\|SRR096786X16163_T1 | 6547 | 744 | 80.21 | glotblastn |
| 3556 | LAB408 | pea\|11v1\|AF153061XX1_P1 | 6548 | 744 | 80.1 | globlastp |
| 3557 | LAB412 | wheat\|10v2\|BE493219_P1 | 6549 | 746 | 97.5 | globlastp |
| 3558 | LAB412 | brachypodium\|09v1\|GT851905_P1 | 6550 | 746 | 90.9 | globlastp |
| 3559 | LAB412 | switchgrass\|gb167\|FE598680 | 6551 | 746 | 88.9 | globlastp |
| 3560 | LAB412 | rice\|gb170\|OS02G03540 | 6552 | 746 | 88.2 | globlastp |
| 3561 | LAB412 | sorghum\|09v1\|SB04G002280 | 6553 | 746 | 87.7 | globlastp |
| 3562 | LAB412 | maize\|10v1\|BM378884_P1 | 6554 | 746 | 86 | globlastp |
| 3563 | LAB418 | brachypodium\|09v1\|GT786818_P1 | 6555 | 747 | 88.6 | globlastp |
| 3564 | LAB418 | wheat\|gb164\|CA672172 | 6556 | 747 | 83.2 | globlastp |
| 3565 | LAB419 | wheat\|10v2\|BE405968_P1 | 6557 | 748 | 94.9 | globlastp |
| 3566 | LAB419 | brachypodium\|09v1\|DV481144_P1 | 6558 | 748 | 87.1 | globlastp |
| 3567 | LAB419 | rice\|gb170\|OS01G67370 | 6559 | 748 | 81.7 | globlastp |
| 3568 | LAB420 | brachypodium\|09v1\|DV474156_P1 | 6560 | 749 | 90.6 | globlastp |
| 3569 | LAB420 | sorghum\|09v1\|SB01G031520 | 6561 | 749 | 85.3 | globlastp |
| 3570 | LAB420 | rice\|gb170\|OS03G31550 | 6562 | 749 | 85.2 | globlastp |
| 3571 | LAB420 | maize\|10v1\|AI783333_P1 | 6563 | 749 | 84.7 | globlastp |
| 3572 | LAB424 | brachypodium\|09v1\|GT789507_P1 | 6564 | 750 | 87.7 | globlastp |
| 3573 | LAB424 | sorghum\|09v1\|SB02G042310 | 6565 | 750 | 83.8 | globlastp |
| 3574 | LAB424 | switchgrass\|gb167\|FE598283 | 6566 | 750 | 82.6 | globlastp |
| 3575 | LAB424 | millet\|10v1\|EVO454PM053809_P1 | 6567 | 750 | 82.1 | globlastp |
| 3576 | LAB424 | maize\|10v1\|AI901746_P1 | 6568 | 750 | 82.1 | globlastp |
| 3577 | LAB424 | rice\|gb170\|OS07G47250_P1 | 6569 | 750 | 81.8 | globlastp |
| 3578 | LAB427 | oat\|10v2\|BE439188_P1 | 6570 | 752 | 89.9 | globlastp |
| 3579 | LAB430 | leymus\|gb166\|EG375244_T1 | 6571 | 753 | 86.75 | glotblastn |
| 3580 | LAB430 | oat\|10v2\|GR322273_P1 | 6572 | 753 | 81.4 | globlastp |
| 3581 | LAB431 | barley\|10v1\|BQ757983 | 6573 | 754 | 96.7 | globlastp |
| 3582 | LAB431 | barley\|10v1\|BF626270 | 6574 | 754 | 87.6 | globlastp |
| 3583 | LAB431 | barley\|10v2\|BF626270_P1 | 6574 | 754 | 87.6 | globlastp |
| 3584 | LAB431 | leymus\|gb166\|EG390546_P1 | 6575 | 754 | 83.8 | globlastp |
| 3585 | LAB434 | wheat\|10v2\|BE400625_P1 | 6576 | 755 | 94.8 | globlastp |
| 3586 | LAB434 | brachypodium\|09v1\|DV489184_P1 | 6577 | 755 | 90.7 | globlastp |
| 3587 | LAB434 | sorghum\|09v1\|SB02G042770 | 6578 | 755 | 86.2 | globlastp |
| 3588 | LAB434 | maize\|10v1\|AA979949_P1 | 6579 | 755 | 85.9 | globlastp |
| 3589 | LAB434 | rice\|gb170\|AF074737 | 6580 | 755 | 85.2 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3590 | LAB434 | wheat\|gb164\|BM136624 | 6581 | 755 | 85 | globlastp |
| 3591 | LAB434 | switchgrass\|gb167\|FL721682 | 6582 | 755 | 83.3 | globlastp |
| 3592 | LAB440 | wheat\|10v2\|BE499788_P1 | 6583 | 758 | 84.7 | globlastp |
| 3593 | LAB444 | wheat\|10v2\|BE400713_P1 | 6584 | 760 | 93.3 | globlastp |
| 3594 | LAB444 | leymus\|gb166\|EG378620_P1 | 6585 | 760 | 92.9 | globlastp |
| 3595 | LAB444 | wheat\|gb164\|BE400713 | 6586 | 760 | 83.1 | globlastp |
| 3596 | LAB444 | oat\|10v2\|GO591479_P1 | 6587 | 760 | 82.5 | globlastp |
| 3597 | LAB444 | pseudoroegneria\|gb167\|FF340227_P1 | 6588 | 760 | 80.2 | globlastp |
| 3598 | LAB447 | wheat\|10v2\|BE404399_P1 | 6589 | 761 | 96.3 | globlastp |
| 3599 | LAB447 | brachypodium\|09v1\|GT765763_P1 | 6590 | 761 | 88.7 | globlastp |
| 3600 | LAB447 | rice\|gb170\|OS05G27870_P1 | 6591 | 761 | 82.3 | globlastp |
| 3601 | LAB450 | wheat\|10v2\|BQ839057_P1 | 6592 | 763 | 91.5 | globlastp |
| 3602 | LAB450 | wheat\|gb164\|BQ839057 | 6592 | 763 | 91.5 | globlastp |
| 3603 | LAB450 | pseudoroegneria\|gb167\|FF343342 | 6593 | 763 | 90.7 | globlastp |
| 3604 | LAB450 | wheat\|10v2\|BE419943_P1 | 6594 | 763 | 90.5 | globlastp |
| 3605 | LAB450 | wheat\|gb164\|BE419943 | 6594 | 763 | 90.5 | globlastp |
| 3606 | LAB450 | wheat\|10v2\|BE470642_P1 | 6595 | 763 | 87.7 | globlastp |
| 3607 | LAB450 | wheat\|gb164\|BE470642 | 6595 | 763 | 87.7 | globlastp |
| 3608 | LAB451 | wheat\|10v2\|BM136143_P1 | 6596 | 764 | 91.5 | globlastp |
| 3609 | LAB451 | wheat\|gb164\|BM136143 | 6597 | 764 | 89.8 | globlastp |
| 3610 | LAB452 | brachypodium\|09v1\|GT841409_P1 | 6598 | 765 | 84.8 | globlastp |
| 3611 | LAB453 | wheat\|10v2\|BG905551_P1 | 6599 | 766 | 93.3 | globlastp |
| 3612 | LAB454 | rice\|gb170\|OS11G42420 | 6600 | 767 | 83.9 | globlastp |
| 3613 | LAB454 | sorghum\|09v1\|SB05G025620 | 6601 | 767 | 81.1 | globlastp |
| 3614 | LAB457 | wheat\|10v2\|BE428570_P1 | 6602 | 769 | 88.2 | globlastp |
| 3615 | LAB457 | wheat\|gb164\|BE428570 | 6603 | 769 | 88.19 | glotblastn |
| 3616 | LAB457 | wheat\|gb164\|CK204043 | 6604 | 769 | 85.83 | glotblastn |
| 3617 | LAB457 | wheat\|gb164\|CA499752 | 6605 | 769 | 85.04 | glotblastn |
| 3618 | LAB457 | wheat\|10v2\|CA499752_P1 | 6606 | 769 | 85 | globlastp |
| 3619 | LAB459 | barley\|10v1\|BE438175 | 6607 | 770 | 93.4 | globlastp |
| 3620 | LAB459 | rice\|gb170\|OS01G06660 | 6608 | 770 | 91.3 | globlastp |
| 3621 | LAB459 | maize\|10v1\|AI948273_P1 | 6609 | 770 | 91.3 | globlastp |
| 3622 | LAB459 | brachypodium\|09v1\|SRR031797S0019797_P1 | 6610 | 770 | 90 | globlastp |
| 3623 | LAB459 | millet\|10v1\|CD725138_P1 | 6611 | 770 | 89.7 | globlastp |
| 3624 | LAB459 | sorghum\|09v1\|SB03G005240 | 6612 | 770 | 89.4 | globlastp |
| 3625 | LAB459 | sugarcane\|10v1\|CA096314 | 6613 | 770 | 89.4 | globlastp |
| 3626 | LAB459 | wheat\|gb164\|BE415422 | 6614 | 770 | 87 | globlastp |
| 3627 | LAB459 | eucalyptus\|11v2\|CT983705_T1 | 6615 | 770 | 81.1 | glotblastn |
| 3628 | LAB459 | eucalyptus\|11v2\|CD668339_T1 | 6616 | 770 | 80.9 | glotblastn |
| 3629 | LAB459 | silene\|11v1\|SRR096785X10449_P1 | 6617 | 770 | 80.4 | globlastp |
| 3630 | LAB459 | artemisia\|10v1\|EY110657_P1 | 6618 | 770 | 80.1 | globlastp |
| 3631 | LAB461 | wheat\|10v2\|BG262395_P1 | 6619 | 771 | 94.3 | globlastp |
| 3632 | LAB462 | wheat\|10v2\|CA625191_P1 | 6620 | 772 | 93.2 | globlastp |
| 3633 | LAB462 | oat\|10v2\|CN818009_P1 | 6621 | 772 | 90 | globlastp |
| 3634 | LAB463 | wheat\|10v2\|BE444041_P1 | 6622 | 773 | 93.3 | globlastp |
| 3635 | LAB463 | pseudoroegneria\|gb167\|FF346314 | 6623 | 773 | 92.7 | globlastp |
| 3636 | LAB463 | leymus\|gb166\|EG375938_P1 | 6624 | 773 | 91.5 | globlastp |
| 3637 | LAB463 | wheat\|gb164\|BE419176 | 6625 | 773 | 90.51 | glotblastn |
| 3638 | LAB463 | wheat\|10v2\|BE419176_P1 | 6626 | 773 | 90.4 | globlastp |
| 3639 | LAB463 | barley\|10v2\|AW982395_T1 | 6627 | 773 | 89.81 | glotblastn |
| 3640 | LAB465 | wheat\|10v2\|BQ842628_P1 | 6628 | 774 | 92.2 | globlastp |
| 3641 | LAB465 | wheat\|gb164\|BQ842628 | 6628 | 774 | 92.2 | globlastp |
| 3642 | LAB465 | wheat\|10v2\|BG905075_T1 | 6629 | 774 | 91.63 | glotblastn |
| 3643 | LAB465 | wheat\|gb164\|BG905075 | 6630 | 774 | 91.6 | globlastp |
| 3644 | LAB468 | brachypodium\|09v1\|GT844070_P1 | 6631 | 776 | 82.7 | globlastp |
| 3645 | LAB468 | rice\|gb170\|OS01G46760 | 6632 | 776 | 80.8 | globlastp |
| 3646 | LAB469 | brachypodium\|09v1\|DV473513_P1 | 6633 | 777 | 88.6 | globlastp |
| 3647 | LAB469 | brachypodium\|09v1\|GT815055_P1 | 6634 | 777 | 83.7 | globlastp |
| 3648 | LAB469 | rice\|gb170\|OS02G08360_P1 | 6635 | 777 | 81.8 | globlastp |
| 3649 | LAB469 | maize\|10v1\|AW062142_P1 | 6636 | 777 | 81.4 | globlastp |
| 3650 | LAB469 | maize\|10v1\|AW261228_P1 | 6637 | 777 | 80.7 | globlastp |
| 3651 | LAB472 | wheat\|10v2\|CF133994_P1 | 6638 | 779 | 98 | globlastp |
| 3652 | LAB472 | brachypodium\|09v1\|DV481113_P1 | 6639 | 779 | 93.6 | globlastp |
| 3653 | LAB472 | sorghum\|09v1\|SB09G004180 | 6640 | 779 | 89.1 | globlastp |
| 3654 | LAB472 | rice\|gb170\|OS05G06260 | 6641 | 779 | 88.5 | globlastp |
| 3655 | LAB472 | maize\|10v1\|AI461551_P1 | 6642 | 779 | 86.9 | globlastp |
| 3656 | LAB475 | wheat\|10v2\|BE428926_P1 | 6643 | 782 | 90.3 | globlastp |
| 3657 | LAB476 | wheat\|10v2\|BE419517_P1 | 6644 | 783 | 95.8 | globlastp |
| 3658 | LAB476 | pseudoroegneria\|gb167\|FF341581 | 6645 | 783 | 95.3 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3659 | LAB476 | wheat\|gb164\|BE419517 | 6646 | 783 | 91.4 | globlastp |
| 3660 | LAB476 | brachypodium\|09v1\|DV483732_P1 | 6647 | 783 | 87.7 | globlastp |
| 3661 | LAB476 | sorghum\|09v1\|SB01G045990 | 6648 | 783 | 81.9 | globlastp |
| 3662 | LAB476 | foxtail_millet\|10v2\|EC612221_P1 | 6649 | 783 | 81.8 | globlastp |
| 3663 | LAB476 | rice\|gb170\|OS03G07190 | 6650 | 783 | 80.7 | globlastp |
| 3664 | LAB477 | brachypodium\|09v1\|GT762943_P1 | 6651 | 784 | 94 | globlastp |
| 3665 | LAB477 | sorghum\|09v1\|SB06G022140 | 6652 | 784 | 89.1 | globlastp |
| 3666 | LAB477 | switchgrass\|gb167\|FL695135_P1 | 6653 | 784 | 88 | globlastp |
| 3667 | LAB477 | maize\|10v1\|BM500910_P1 | 6654 | 784 | 87.5 | globlastp |
| 3668 | LAB477 | wheat\|10v2\|BE414925_P1 | 6655 | 784 | 87.2 | globlastp |
| 3669 | LAB477 | wheat\|gb164\|BE414925 | 6656 | 784 | 86.7 | globlastp |
| 3670 | LAB477 | rice\|gb170\|OS04G42990 | 6657 | 784 | 86.3 | globlastp |
| 3671 | LAB478 | wheat\|10v2\|BE444075_P1 | 6658 | 785 | 96.8 | globlastp |
| 3672 | LAB478 | oat\|10v2\|GR332265_T1 | 6659 | 785 | 94.58 | glotblastn |
| 3673 | LAB478 | brachypodium\|09v1\|GT764009_P1 | 6660 | 785 | 92 | globlastp |
| 3674 | LAB478 | rice\|gb170\|OS04G56970_P1 | 6661 | 785 | 88.1 | globlastp |
| 3675 | LAB478 | sorghum\|09v1\|SB06G031950_P1 | 6662 | 785 | 87.8 | globlastp |
| 3676 | LAB478 | maize\|10v1\|AI734770_P1 | 6663 | 785 | 86.8 | globlastp |
| 3677 | LAB478 | switchgrass\|gb167\|FE621222_T1 | 6664 | 785 | 85.96 | glotblastn |
| 3678 | LAB478 | foxtail_millet\|10v2\|FXTRMSLX03523517D1_P1 | 6665 | 785 | 82.6 | globlastp |
| 3679 | LAB480 | cotton\|10v2\|AI728720_P1 | 6666 | 787 | 98.5 | globlastp |
| 3680 | LAB480 | cacao\|10v1\|CA795870_P1 | 6667 | 787 | 91.7 | globlastp |
| 3681 | LAB480 | cacao\|gb167\|CA795870 | 6668 | 787 | 91.1 | glotblastn |
| 3682 | LAB480 | citrus\|gb166\|CB291083_P1 | 6669 | 787 | 85.4 | globlastp |
| 3683 | LAB480 | oak\|10v1\|FP045794_P1 | 6670 | 787 | 85.2 | globlastp |
| 3684 | LAB480 | clementine\|11v1\|CB291083_P1 | 6671 | 787 | 85.1 | globlastp |
| 3685 | LAB480 | orange\|11v1\|CB291083_P1 | 6672 | 787 | 85.1 | globlastp |
| 3686 | LAB480 | chestnut\|gb170\|SRR006295S0007069_P1 | 6673 | 787 | 84.9 | globlastp |
| 3687 | LAB480 | cassava\|09v1\|JGICASSAVA1341VALIDM1_P1 | 6674 | 787 | 83.8 | globlastp |
| 3688 | LAB480 | apple\|gb171\|CN496678 | 6675 | 787 | 83.5 | globlastp |
| 3689 | LAB480 | cassava\|09v1\|DV448492_P1 | 6676 | 787 | 83.2 | globlastp |
| 3690 | LAB480 | poplar\|10v1\|AI163811_P1 | 6677 | 787 | 83.1 | globlastp |
| 3691 | LAB480 | tripterygium\|11v1\|SRR098677X101946_T1 | 6678 | 787 | 82.98 | glotblastn |
| 3692 | LAB480 | euonymus\|11v1\|SRR070038X137340_P1 | 6679 | 787 | 81.7 | globlastp |
| 3693 | LAB480 | euphorbia\|11v1\|DV131310_P1 | 6680 | 787 | 81.7 | globlastp |
| 3694 | LAB480 | prunus\|10v1\|BU047502 | 6681 | 787 | 81.3 | globlastp |
| 3695 | LAB480 | castorbean\|09v1\|EV523908_P1 | 6682 | 787 | 81.1 | globlastp |
| 3696 | LAB480 | grape\|gb160\|CF207600_P1 | 6683 | 787 | 81.1 | globlastp |
| 3697 | LAB480 | amsonia\|11v1\|SRR098688X10638_T1 | 6684 | 787 | 80.49 | glotblastn |
| 3698 | LAB481 | cotton\|10v2\|SRR032881S0193852_T1 | 6685 | 788 | 95.32 | glotblastn |
| 3699 | LAB481 | poplar\|10v1\|BI128619_P1 | 6686 | 788 | 93.8 | globlastp |
| 3700 | LAB481 | poplar\|10v1\|AI166334_P1 | 6687 | 788 | 93.5 | globlastp |
| 3701 | LAB481 | cassava\|09v1\|CK645953_P1 | 6688 | 788 | 93 | globlastp |
| 3702 | LAB481 | eucalyptus\|11v2\|CB967918_P1 | 6689 | 788 | 92.7 | globlastp |
| 3703 | LAB481 | potato\|10v1\|BE920690_P1 | 6690 | 788 | 92.7 | globlastp |
| 3704 | LAB481 | solanum_phureja\|09v1\|SPHAW931735 | 6690 | 788 | 92.7 | globlastp |
| 3705 | LAB481 | cucurbita\|11v1\|D86306_P1 | 6691 | 788 | 92.6 | globlastp |
| 3706 | LAB481 | hevea\|10v1\|AY514019_P1 | 6692 | 788 | 92.2 | globlastp |
| 3707 | LAB481 | tomato\|09v1\|AW931735 | 6693 | 788 | 92.1 | globlastp |
| 3708 | LAB481 | tomato\|10v1\|X77915_P1 | 6693 | 788 | 92.1 | globlastp |
| 3709 | LAB481 | euonymus\|11v1\|SRR070038X100765_P1 | 6694 | 788 | 91.8 | globlastp |
| 3710 | LAB481 | euonymus\|11v1\|SRR070038X103451_P1 | 6695 | 788 | 91.8 | globlastp |
| 3711 | LAB481 | nasturtium\|10v1\|GH169946_P1 | 6696 | 788 | 91.8 | globlastp |
| 3712 | LAB481 | catharanthus\|11v1\|EG562832_P1 | 6697 | 788 | 91.7 | globlastp |
| 3713 | LAB481 | tabernaemontana\|11v1\|SRR098689X100922_P1 | 6698 | 788 | 91.7 | globlastp |
| 3714 | LAB481 | apple\|11v1\|CN866548_P1 | 6699 | 788 | 91.7 | globlastp |
| 3715 | LAB481 | apple\|gb171\|CN866548 | 6699 | 788 | 91.7 | globlastp |
| 3716 | LAB481 | tripterygium\|11v1\|SRR098677X102173_P1 | 6700 | 788 | 91.5 | globlastp |
| 3717 | LAB481 | amsonia\|11v1\|SRR098688X101200_P1 | 6701 | 788 | 91.3 | globlastp |
| 3718 | LAB481 | lotus\|09v1\|CB828572_P1 | 6702 | 788 | 91.3 | globlastp |
| 3719 | LAB481 | tomato\|09v1\|CRPSP042519 | 6703 | 788 | 91.3 | globlastp |
| 3720 | LAB481 | tomato\|10v1\|X83730_P1 | 6703 | 788 | 91.3 | globlastp |
| 3721 | LAB481 | strawberry\|11v1\|DY675198_P1 | 6704 | 788 | 91 | globlastp |
| 3722 | LAB481 | aquilegia\|10v1\|DR915096 | 6705 | 788 | 91 | globlastp |
| 3723 | LAB481 | aquilegia\|10v2\|DR915096_P1 | 6705 | 788 | 91 | globlastp |
| 3724 | LAB481 | vinca\|11v1\|SRR098690X103527_P1 | 6706 | 788 | 90.9 | globlastp |
| 3725 | LAB481 | vinca\|11v1\|SRR098690X101528_P1 | 6707 | 788 | 90.6 | globlastp |
| 3726 | LAB481 | cleome_gynandra\|10v1\|SRR015532S0002808_P1 | 6708 | 788 | 90.5 | globlastp |
| 3727 | LAB481 | prunus\|10v1\|AF367446 | 6709 | 788 | 90.4 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3728 | LAB481 | catharanthus\|11v1\|AM232527_P1 | 6710 | 788 | 90.3 | globlastp |
| 3729 | LAB481 | tobacco\|gb162\|X77915 | 6711 | 788 | 90.3 | globlastp |
| 3730 | LAB481 | vinca\|11v1\|SRR098690X100903_P1 | 6712 | 788 | 90.1 | globlastp |
| 3731 | LAB481 | grape\|gb160\|AJ430532_P1 | 6713 | 788 | 90.1 | globlastp |
| 3732 | LAB481 | strawberry\|11v1\|DV439486_P1 | 6714 | 788 | 89.6 | globlastp |
| 3733 | LAB481 | phyla\|11v1\|SRR099035X106705_T1 | 6715 | 788 | 89.58 | glotblastn |
| 3734 | LAB481 | arnica\|11v1\|SRR099034X100943_P1 | 6716 | 788 | 89.5 | globlastp |
| 3735 | LAB481 | arnica\|11v1\|SRR099034X105519_P1 | 6717 | 788 | 89.5 | globlastp |
| 3736 | LAB481 | sunflower\|10v1\|DY907402 | 6718 | 788 | 89.5 | globlastp |
| 3737 | LAB481 | podocarpus\|10v1\|SRR065014S0001072_P1 | 6719 | 788 | 89.4 | globlastp |
| 3738 | LAB481 | maritime_pine\|10v1\|BX250893_P1 | 6720 | 788 | 89.2 | globlastp |
| 3739 | LAB481 | lettuce\|10v1\|DW046372_P1 | 6721 | 788 | 89.1 | globlastp |
| 3740 | LAB481 | sequoia\|10v1\|SRR065044S0001396_P1 | 6722 | 788 | 89 | globlastp |
| 3741 | LAB481 | dandelion\|10v1\|DR401740_P1 | 6723 | 788 | 88.7 | globlastp |
| 3742 | LAB481 | arnica\|11v1\|SRR099034X10370_P1 | 6724 | 788 | 88.4 | globlastp |
| 3743 | LAB481 | cacao\|10v1\|CU472030_P1 | 6725 | 788 | 88.4 | globlastp |
| 3744 | LAB481 | pseudotsuga\|10v1\|SRR065119S0001864_P1 | 6726 | 788 | 88.2 | globlastp |
| 3745 | LAB481 | silene\|11v1\|SRR096785X104108_P1 | 6727 | 788 | 88.2 | globlastp |
| 3746 | LAB481 | sorghum\|09v1\|SB10G005250 | 6728 | 788 | 88.1 | globlastp |
| 3747 | LAB481 | canola\|10v1\|BG732268_P1 | 6729 | 788 | 87.9 | globlastp |
| 3748 | LAB481 | sciadopitys\|10v1\|SRR065035S0003774_P1 | 6730 | 788 | 87.8 | globlastp |
| 3749 | LAB481 | sorghum\|09v1\|SB10G009875 | 6731 | 788 | 87.8 | globlastp |
| 3750 | LAB481 | cedrus\|11v1\|SRR065007X101716_P1 | 6732 | 788 | 87.7 | globlastp |
| 3751 | LAB481 | rice\|gb170\|OS06G08080 | 6733 | 788 | 87.3 | globlastp |
| 3752 | LAB481 | barley\|10v1\|AV835352 | 6734 | 788 | 87.3 | globlastp |
| 3753 | LAB481 | barley\|10v2\|AV835352_P1 | 6734 | 788 | 87.3 | globlastp |
| 3754 | LAB481 | abies\|11v2\|SRR098676X101054_P1 | 6735 | 788 | 87 | globlastp |
| 3755 | LAB481 | wheat\|10v2\|BF292352_T1 | 6736 | 788 | 86.88 | glotblastn |
| 3756 | LAB481 | wheat\|10v2\|BG607929_P1 | 6737 | 788 | 86.8 | globlastp |
| 3757 | LAB481 | wheat\|gb164\|BE400182 | 6738 | 788 | 86.8 | globlastp |
| 3758 | LAB481 | strawberry\|gb164\|DV439486 | 6739 | 788 | 86.6 | globlastp |
| 3759 | LAB481 | wheat\|gb164\|BE398174 | 6740 | 788 | 86.6 | globlastp |
| 3760 | LAB481 | rice\|gb170\|OS02G55890 | 6741 | 788 | 86.5 | globlastp |
| 3761 | LAB481 | wheat\|10v2\|BE412210XX1_P1 | 6742 | 788 | 86.5 | globlastp |
| 3762 | LAB481 | oat\|10v2\|CN820675_T1 | 6743 | 788 | 86.49 | glotblastn |
| 3763 | LAB481 | brachypodium\|09v1\|DV472048_P1 | 6744 | 788 | 86.4 | globlastp |
| 3764 | LAB481 | wheat\|10v2\|BQ240996_T1 | 6745 | 788 | 85.84 | glotblastn |
| 3765 | LAB481 | switchgrass\|gb167\|DN145335 | 6746 | 788 | 85.3 | globlastp |
| 3766 | LAB481 | switchgrass\|gb167\|DN145951 | 6747 | 788 | 85.3 | globlastp |
| 3767 | LAB481 | sugarcane\|10v1\|AA842737 | 6748 | 788 | 85.1 | globlastp |
| 3768 | LAB481 | sequoia\|10v1\|SRR065044S0453679_T1 | 6749 | 788 | 84.97 | glotblastn |
| 3769 | LAB481 | sciadopitys\|10v1\|SRR065035S0001861_P1 | 6750 | 788 | 84.9 | globlastp |
| 3770 | LAB481 | pine\|10v2\|BX250893_P1 | 6751 | 788 | 84.7 | globlastp |
| 3771 | LAB481 | spruce\|gb162\|CO216462 | 6752 | 788 | 84.5 | globlastp |
| 3772 | LAB481 | foxtail_millet\|10v2\|OXFXTRMSLX00016694D1T1_P1 | 6753 | 788 | 84.3 | globlastp |
| 3773 | LAB481 | castorbean\|09v1\|EG657212_T1 | 6754 | 788 | 84.29 | glotblastn |
| 3774 | LAB481 | abies\|11v2\|SRR098676X100882_P1 | 6755 | 788 | 84.2 | globlastp |
| 3775 | LAB481 | cephalotaxus\|11v1\|SRR064395X102391_P1 | 6756 | 788 | 84.2 | globlastp |
| 3776 | LAB481 | apple\|11v1\|MDP0000704251_P1 | 6757 | 788 | 83.9 | globlastp |
| 3777 | LAB481 | maritime_pine\|10v1\|BX249640_P1 | 6758 | 788 | 83.9 | globlastp |
| 3778 | LAB481 | pine\|10v2\|AW225748_P1 | 6759 | 788 | 83.8 | globlastp |
| 3779 | LAB481 | pseudotsuga\|10v1\|SRR065119S0003664_P1 | 6760 | 788 | 83.7 | globlastp |
| 3780 | LAB481 | apple\|gb171\|CN492973 | 6761 | 788 | 83.7 | globlastp |
| 3781 | LAB481 | cedrus\|11v1\|SRR065007X100223_P1 | 6762 | 788 | 83.5 | globlastp |
| 3782 | LAB481 | apple\|gb171\|CN870880 | 6763 | 788 | 83.3 | globlastp |
| 3783 | LAB481 | cotton\|10v2\|DN757608_T1 | 6764 | 788 | 83.25 | glotblastn |
| 3784 | LAB481 | solanum_phureja\|09v1\|SPHDB682229 | 6765 | 788 | 82.7 | globlastp |
| 3785 | LAB481 | apple\|11v1\|CN862184_P1 | 6766 | 788 | 82.7 | globlastp |
| 3786 | LAB481 | sorghum\|09v1\|SB04G036230 | 6767 | 788 | 82.1 | globlastp |
| 3787 | LAB481 | tomato\|09v1\|DB682229 | 6768 | 788 | 81.9 | globlastp |
| 3788 | LAB481 | tomato\|10v1\|DB682229_P1 | 6768 | 788 | 81.9 | globlastp |
| 3789 | LAB481 | euphorbia\|11v1\|DV126163_P1 | 6769 | 788 | 81.7 | globlastp |
| 3790 | LAB481 | cleome_spinosa\|10v1\|SRR015531S0000969_P1 | 6770 | 788 | 81.6 | globlastp |
| 3791 | LAB481 | apple\|11v1\|CN488670_P1 | 6771 | 788 | 81.5 | globlastp |
| 3792 | LAB481 | phyla\|11v1\|SRR099035X100905_P1 | 6772 | 788 | 80.8 | globlastp |
| 3793 | LAB481 | millet\|10v1\|EVO454PM009646_P1 | 6773 | 788 | 80.6 | globlastp |
| 3794 | LAB481 | platanus\|11v1\|SRR096786X105494_P1 | 6774 | 788 | 80.2 | globlastp |
| 3795 | LAB481 | cephalotaxus\|11v1\|SRR064395X100073_P1 | 6775 | 788 | 80 | globlastp |
| 3796 | LAB484 | grape\|gb160\|CB002316_P1 | 6776 | 790 | 82 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3797 | LAB484 | clementine\|11v1\|CX644739_P1 | 6777 | 790 | 81.6 | globlastp |
| 3798 | LAB484 | citrus\|gb166\|CX644739_P1 | 6777 | 790 | 81.6 | globlastp |
| 3799 | LAB484 | lotus\|09v1\|LLGO019841_T1 | 6778 | 790 | 80.95 | glotblastn |
| 3800 | LAB484 | medicago\|09v1\|BE942500_T1 | 6779 | 790 | 80.95 | glotblastn |
| 3801 | LAB484 | peanut\|10v1\|GO263617_T1 | 6780 | 790 | 80.95 | glotblastn |
| 3802 | LAB484 | orange\|11v1\|CX644739_P1 | 6781 | 790 | 80.5 | globlastp |
| 3803 | LAB484 | nasturtium\|10v1\|SRR032558S0099872_P1 | 6782 | 790 | 80.4 | globlastp |
| 3804 | LAB486 | cacao\|10v1\|CA797717_P1 | 6783 | 791 | 83.3 | globlastp |
| 3805 | LAB486 | cotton\|10v2\|BE052371_P1 | 6784 | 791 | 80.6 | globlastp |
| 3806 | LAB488 | soybean\|11v1\|GLYMA18G49440_P1 | 6785 | 793 | 82.6 | globlastp |
| 3807 | LAB488 | soybean\|gb168\|EV272648 | 6786 | 793 | 82.6 | globlastp |
| 3808 | LAB488 | clementine\|11v1\|CX305104_P1 | 6787 | 793 | 82.3 | globlastp |
| 3809 | LAB488 | orange\|11v1\|CX305104_P1 | 6788 | 793 | 81.9 | globlastp |
| 3810 | LAB488 | tomato\|09v1\|AI781626 | 6789 | 793 | 81.3 | globlastp |
| 3811 | LAB488 | eucalyptus\|11v2\|DRR000893X1430783_P1 | 6790 | 793 | 80.4 | globlastp |
| 3812 | LAB488 | solanum_phureja\|09v1\|SPHAI781626 | 6791 | 793 | 80.3 | globlastp |
| 3813 | LAB488 | cassava\|09v1\|DB928048_P1 | 6792 | 793 | 80.2 | globlastp |
| 3814 | LAB488 | strawberry\|11v1\|CO379433_P1 | 6793 | 793 | 80.1 | globlastp |
| 3815 | LAB488 | cucumber\|09v1\|GD174944_P1 | 6794 | 793 | 80.1 | globlastp |
| 3816 | LAB491 | cacao\|gb167\|CA798335 | 6795 | 796 | 89.3 | globlastp |
| 3817 | LAB491 | cacao\|10v1\|CA798335_P1 | 6796 | 796 | 82.8 | globlastp |
| 3818 | LAB495 | cotton\|10v2\|DW499556_P1 | 6797 | 800 | 93.6 | globlastp |
| 3819 | LAB496 | cacao\|10v1\|CU491321_P1 | 6798 | 801 | 86.8 | globlastp |
| 3820 | LAB496 | cacao\|gb167\|CU491321 | 6799 | 801 | 86.2 | globlastp |
| 3821 | LAB496 | heritiera\|10v1\|SRR005795S0037933_P1 | 6800 | 801 | 85.5 | globlastp |
| 3822 | LAB499 | castorbean\|09v1\|GFXZ32849X1_P1 | 6801 | 803 | 89 | globlastp |
| 3823 | LAB499 | nasturtium\|10v1\|SRR032558S0006268_P1 | 6802 | 803 | 88.8 | globlastp |
| 3824 | LAB499 | clementine\|11v1\|AF095521_P1 | 6803 | 803 | 88.7 | globlastp |
| 3825 | LAB499 | orange\|11v1\|AF095521_P1 | 6803 | 803 | 88.7 | globlastp |
| 3826 | LAB499 | citrus\|gb166\|AF095521_P1 | 6803 | 803 | 88.7 | globlastp |
| 3827 | LAB499 | poplar\|10v1\|AI166580_P1 | 6804 | 803 | 88.7 | globlastp |
| 3828 | LAB499 | grape\|gb160\|CB348013_P1 | 6805 | 803 | 87.3 | globlastp |
| 3829 | LAB499 | silene\|11v1\|SRR096785X101535_P1 | 6806 | 803 | 87.1 | globlastp |
| 3830 | LAB499 | strawberry\|11v1\|DY666990_P1 | 6807 | 803 | 87.1 | globlastp |
| 3831 | LAB499 | kiwi\|gb166\|FG454195_P1 | 6808 | 803 | 87 | globlastp |
| 3832 | LAB499 | tobacco\|gb162\|EB444754 | 6809 | 803 | 86.85 | glotblastn |
| 3833 | LAB499 | tomato\|09v1\|BG125964 | 6810 | 803 | 86.7 | globlastp |
| 3834 | LAB499 | tomato\|10v1\|BG125964_P1 | 6810 | 803 | 86.7 | globlastp |
| 3835 | LAB499 | potato\|10v1\|BG590690_P1 | 6811 | 803 | 86.4 | globlastp |
| 3836 | LAB499 | potato\|10v1\|POTPFPA_P1 | 6812 | 803 | 86.4 | globlastp |
| 3837 | LAB499 | solanum_phureja\|09v1\|SPHBG125964 | 6813 | 803 | 86.4 | globlastp |
| 3838 | LAB499 | tomato\|09v1\|POTPFPA | 6814 | 803 | 86.4 | globlastp |
| 3839 | LAB499 | tomato\|10v1\|BG134696_P1 | 6814 | 803 | 86.4 | globlastp |
| 3840 | LAB499 | solanum_phureja\|09v1\|SPHPOTPFPA | 6815 | 803 | 86.2 | globlastp |
| 3841 | LAB499 | basilicum\|10v1\|DY321742_P1 | 6816 | 803 | 86.2 | globlastp |
| 3842 | LAB499 | olea\|11v1\|SRR014463.11379_T1 | 6817 | 803 | 86.04 | glotblastn |
| 3843 | LAB499 | catharanthus\|11v1\|AM232321_P1 | 6818 | 803 | 85.9 | globlastp |
| 3844 | LAB499 | plantago\|11v1\|SRR066373X102538_P1 | 6819 | 803 | 85.1 | globlastp |
| 3845 | LAB499 | monkeyflower\|10v1\|CV517216_P1 | 6820 | 803 | 85.1 | globlastp |
| 3846 | LAB499 | orobanche\|10v1\|SRR023189S0002658_P1 | 6821 | 803 | 85.1 | globlastp |
| 3847 | LAB499 | triphysaria\|10v1\|BM356932 | 6822 | 803 | 84.9 | globlastp |
| 3848 | LAB499 | aristolochia\|10v1\|SRR039082S0042529_P1 | 6823 | 803 | 84.7 | globlastp |
| 3849 | LAB499 | monkeyflower\|10v1\|DV210287_P1 | 6824 | 803 | 84.6 | globlastp |
| 3850 | LAB499 | plantago\|11v1\|SRR066373X110649_T1 | 6825 | 803 | 84.58 | glotblastn |
| 3851 | LAB499 | canola\|10v1\|DY024760_P1 | 6826 | 803 | 84.5 | globlastp |
| 3852 | LAB499 | canola\|10v1\|CB686162_P1 | 6827 | 803 | 84.3 | globlastp |
| 3853 | LAB499 | lettuce\|10v1\|DW061207_P1 | 6828 | 803 | 84.3 | globlastp |
| 3854 | LAB499 | cichorium\|gb171\|DT212842_P1 | 6829 | 803 | 84.1 | globlastp |
| 3855 | LAB499 | artemisia\|10v1\|EY037958_P1 | 6830 | 803 | 83.7 | globlastp |
| 3856 | LAB499 | fagopyrum\|11v1\|SRR063689X114715_P1 | 6831 | 803 | 83.6 | globlastp |
| 3857 | LAB499 | aquilegia\|10v1\|DR916997 | 6832 | 803 | 83.3 | globlastp |
| 3858 | LAB499 | aquilegia\|10v2\|DR916997_P1 | 6832 | 803 | 83.3 | globlastp |
| 3859 | LAB499 | sunflower\|10v1\|CD852541 | 6833 | 803 | 83.2 | globlastp |
| 3860 | LAB499 | arnica\|11v1\|SRR099034X100671_P1 | 6834 | 803 | 82.7 | globlastp |
| 3861 | LAB499 | strawberry\|gb164\|DY666990 | 6835 | 803 | 82.17 | glotblastn |
| 3862 | LAB499 | barley\|10v1\|BE422202 | 6836 | 803 | 80.7 | globlastp |
| 3863 | LAB499 | barley\|10v2\|BE422202_P1 | 6836 | 803 | 80.7 | globlastp |
| 3864 | LAB499 | wheat\|10v2\|BE400723_P1 | 6837 | 803 | 80.5 | globlastp |
| 3865 | LAB499 | wheat\|gb164\|BE400723 | 6838 | 803 | 80.5 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3866 | LAB502 | cotton\|10v2\|BQ413025_T1 | 6839 | 806 | 98.5 | glotblastn |
| 3867 | LAB502 | cotton\|10v2\|BQ404212_T1 | 6840 | 806 | 98.17 | glotblastn |
| 3868 | LAB502 | cacao\|10v1\|CU469892_P1 | 6841 | 806 | 94.5 | globlastp |
| 3869 | LAB502 | castorbean\|09v1\|EE256384_P1 | 6842 | 806 | 92.3 | globlastp |
| 3870 | LAB502 | melon\|10v1\|AM715460_P1 | 6843 | 806 | 91.8 | globlastp |
| 3871 | LAB502 | cucumber\|09v1\|DQ641093_P1 | 6844 | 806 | 91.7 | globlastp |
| 3872 | LAB502 | soybean\|11v1\|GLYMA13G39790_P1 | 6845 | 806 | 91.1 | globlastp |
| 3873 | LAB502 | soybean\|gb168\|BE248834 | 6845 | 806 | 91.1 | globlastp |
| 3874 | LAB502 | soybean\|gb168\|CD392220 | 6846 | 806 | 91.1 | globlastp |
| 3875 | LAB502 | chestnut\|gb170\|SRR006295S0002404_P1 | 6847 | 806 | 91 | globlastp |
| 3876 | LAB502 | oak\|10v1\|CU657045_P1 | 6848 | 806 | 90.7 | globlastp |
| 3877 | LAB502 | poplar\|10v1\|AB041505_P1 | 6849 | 806 | 90.5 | globlastp |
| 3878 | LAB502 | soybean\|11v1\|GLYMA11G20040_P1 | 6850 | 806 | 90.5 | globlastp |
| 3879 | LAB502 | soybean\|gb168\|AW208081 | 6850 | 806 | 90.5 | globlastp |
| 3880 | LAB502 | soybean\|gb168\|AW688008 | 6851 | 806 | 90.5 | globlastp |
| 3881 | LAB502 | tripterygium\|11v1\|SRR098677X110383_P1 | 6852 | 806 | 90.3 | globlastp |
| 3882 | LAB502 | clementine\|11v1\|CF830420_P1 | 6853 | 806 | 90.2 | globlastp |
| 3883 | LAB502 | orange\|11v1\|CF509989_P1 | 6854 | 806 | 90.2 | globlastp |
| 3884 | LAB502 | pigeonpea\|10v1\|SRR054580S0006137_P1 | 6855 | 806 | 90.1 | globlastp |
| 3885 | LAB502 | prunus\|10v1\|BU039875 | 6856 | 806 | 90.1 | globlastp |
| 3886 | LAB502 | aristolochia\|10v1\|FD749141_P1 | 6857 | 806 | 90 | globlastp |
| 3887 | LAB502 | citrus\|gb166\|CF509989_P1 | 6858 | 806 | 90 | globlastp |
| 3888 | LAB502 | medicago\|09v1\|MT454X038510_P1 | 6859 | 806 | 90 | globlastp |
| 3889 | LAB502 | poplar\|10v1\|AI162726_P1 | 6860 | 806 | 90 | globlastp |
| 3890 | LAB502 | cowpea\|gb166\|FF384142_P1 | 6861 | 806 | 89.9 | globlastp |
| 3891 | LAB502 | aquilegia\|10v2\|DT745773_P1 | 6862 | 806 | 89.8 | globlastp |
| 3892 | LAB502 | humulus\|11v1\|EX516110_P1 | 6863 | 806 | 89.8 | globlastp |
| 3893 | LAB502 | platanus\|11v1\|SRR096786X101055_P1 | 6864 | 806 | 89.8 | globlastp |
| 3894 | LAB502 | cotton\|10v1\|AI054556 | 6865 | 806 | 89.8 | globlastp |
| 3895 | LAB502 | apple\|11v1\|CN492215_P1 | 6866 | 806 | 89.8 | globlastp |
| 3896 | LAB502 | euphorbia\|11v1\|AW821911_P1 | 6867 | 806 | 89.6 | globlastp |
| 3897 | LAB502 | apple\|gb171\|CN492215 | 6868 | 806 | 89.6 | globlastp |
| 3898 | LAB502 | euonymus\|11v1\|SRR070038X127924_P1 | 6869 | 806 | 89.5 | globlastp |
| 3899 | LAB502 | kiwi\|gb166\|FG396573_P1 | 6870 | 806 | 89.5 | globlastp |
| 3900 | LAB502 | eucalyptus\|11v2\|CD669306_P1 | 6871 | 806 | 89.4 | globlastp |
| 3901 | LAB502 | amsonia\|11v1\|SRR098688X11212_P1 | 6872 | 806 | 89.1 | globlastp |
| 3902 | LAB502 | lotus\|09v1\|BW594491_P1 | 6873 | 806 | 89.1 | globlastp |
| 3903 | LAB502 | solanum_phureja\|09v1\|SPHA1771503 | 6874 | 806 | 89.1 | globlastp |
| 3904 | LAB502 | sorghum\|09v1\|SB07G023740 | 6875 | 806 | 88.9 | globlastp |
| 3905 | LAB502 | catharanthus\|11v1\|SRR098691X103562_T1 | 6876 | 806 | 88.82 | glotblastn |
| 3906 | LAB502 | phyla\|11v1\|SRR099035X102308_P1 | 6877 | 806 | 88.6 | globlastp |
| 3907 | LAB502 | strawberry\|11v1\|CO381353_P1 | 6878 | 806 | 88.6 | globlastp |
| 3908 | LAB502 | vinca\|11v1\|SRR098690X106184_P1 | 6879 | 806 | 88.6 | globlastp |
| 3909 | LAB502 | tomato\|09v1\|AI771503 | 6880 | 806 | 88.6 | globlastp |
| 3910 | LAB502 | tomato\|10v1\|AI771503_P1 | 6880 | 806 | 88.6 | globlastp |
| 3911 | LAB502 | vinca\|11v1\|SRR098690X102025_P1 | 6881 | 806 | 88.5 | globlastp |
| 3912 | LAB502 | strawberry\|gb164\|CO381353 | 6882 | 806 | 88.44 | glotblastn |
| 3913 | LAB502 | amborella\|gb166\|CD483909_P1 | 6883 | 806 | 88.1 | globlastp |
| 3914 | LAB502 | brachypodium\|09v1\|DV469629_P1 | 6884 | 806 | 88.1 | globlastp |
| 3915 | LAB502 | pepper\|gb171\|BM062523_P1 | 6885 | 806 | 87.7 | globlastp |
| 3916 | LAB502 | wheat\|10v2\|BE498339_P1 | 6886 | 806 | 87.6 | globlastp |
| 3917 | LAB502 | barley\|10v1\|BE421667 | 6887 | 806 | 87.6 | globlastp |
| 3918 | LAB502 | barley\|10v2\|BE421667_P1 | 6887 | 806 | 87.6 | globlastp |
| 3919 | LAB502 | leymus\|gb166\|EG375168_P1 | 6888 | 806 | 87.6 | globlastp |
| 3920 | LAB502 | oat\|10v2\|CN815134_P1 | 6889 | 806 | 87.6 | globlastp |
| 3921 | LAB502 | pseudoroegneria\|gb167\|FF342794 | 6886 | 806 | 87.6 | globlastp |
| 3922 | LAB502 | wheat\|10v2\|BE399652_P1 | 6890 | 806 | 87.6 | globlastp |
| 3923 | LAB502 | wheat\|gb164\|BE399652 | 6886 | 806 | 87.6 | globlastp |
| 3924 | LAB502 | chelidonium\|11v1\|SRR084752X100369_P1 | 6891 | 806 | 87.5 | globlastp |
| 3925 | LAB502 | solanum_phureja\|09v1\|SPHAW096899 | 6892 | 806 | 87.5 | globlastp |
| 3926 | LAB502 | tomato\|09v1\|AW096899 | 6893 | 806 | 87.4 | globlastp |
| 3927 | LAB502 | tomato\|10v1\|BG123789_P1 | 6893 | 806 | 87.4 | globlastp |
| 3928 | LAB502 | trigonella\|11v1\|SRR066194X214517_P1 | 6894 | 806 | 87.3 | globlastp |
| 3929 | LAB502 | podocarpus\|10v1\|SRR065014S0000850_P1 | 6895 | 806 | 87.2 | globlastp |
| 3930 | LAB502 | fescue\|gb161\|CK801179_P1 | 6896 | 806 | 87.1 | globlastp |
| 3931 | LAB502 | sunflower\|10v1\|DY912434 | 6897 | 806 | 87 | globlastp |
| 3932 | LAB502 | aquilegia\|10v1\|DR919884 | 6898 | 806 | 87 | globlastp |
| 3933 | LAB502 | aquilegia\|10v2\|DR919884_P1 | 6899 | 806 | 87 | globlastp |
| 3934 | LAB502 | nasturtium\|10v1\|GH167855_T1 | 6900 | 806 | 86.93 | glotblastn |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
| --- | --- | --- | --- | --- | --- | --- |
| 3935 | LAB502 | monkeyflower\|10v1\|DV208715_P1 | 6901 | 806 | 86.8 | globlastp |
| 3936 | LAB502 | sunflower\|10v1\|CD848460 | 6902 | 806 | 86.5 | globlastp |
| 3937 | LAB502 | arnica\|11v1\|SRR099034X102234_P1 | 6903 | 806 | 86.4 | globlastp |
| 3938 | LAB502 | cephalotaxus\|11v1\|SRR064395X10016_P1 | 6904 | 806 | 86.4 | globlastp |
| 3939 | LAB502 | pigeonpea\|10v1\|SRR054580S0001968_P1 | 6905 | 806 | 86.4 | globlastp |
| 3940 | LAB502 | triphysaria\|10v1\|BE574935 | 6906 | 806 | 86.3 | globlastp |
| 3941 | LAB502 | zostera\|10v1\|AM767376_P1 | 6907 | 806 | 85.8 | globlastp |
| 3942 | LAB502 | sequoia\|10v1\|SRR065044S0000432_P1 | 6908 | 806 | 85.6 | globlastp |
| 3943 | LAB502 | maize\|10v1\|BE050116_P1 | 6909 | 806 | 85.6 | globlastp |
| 3944 | LAB502 | potato\|10v1\|AW096899_T1 | 6910 | 806 | 85.52 | glotblastn |
| 3945 | LAB502 | taxus\|10v1\|SRR065067S0002495_T1 | 6911 | 806 | 85.27 | glotblastn |
| 3946 | LAB502 | wheat\|gb164\|BE400845 | 6912 | 806 | 85.12 | glotblastn |
| 3947 | LAB502 | barley\|10v1\|BM817077 | 6913 | 806 | 85.1 | globlastp |
| 3948 | LAB502 | barley\|10v2\|BM817077_P1 | 6913 | 806 | 85.1 | globlastp |
| 3949 | LAB502 | pteridium\|11v1\|SRR043594X101695_T1 | 6914 | 806 | 85.02 | glotblastn |
| 3950 | LAB502 | gnetum\|10v1\|DN954824_T1 | 6915 | 806 | 84.92 | glotblastn |
| 3951 | LAB502 | beet\|gb162\|BI096234_T1 | 6916 | 806 | 84.76 | glotblastn |
| 3952 | LAB502 | brachypodium\|09v1\|DV477465_P1 | 6917 | 806 | 84.6 | globlastp |
| 3953 | LAB502 | fern\|gb171\|DK944109_P1 | 6918 | 806 | 84.4 | globlastp |
| 3954 | LAB502 | orobanche\|10v1\|SRR023189S0009709_P1 | 6919 | 806 | 83.8 | globlastp |
| 3955 | LAB502 | plantago\|11v1\|SRR066373X102887_P1 | 6920 | 806 | 83.6 | globlastp |
| 3956 | LAB502 | coffea\|10v1\|DV671759_P1 | 6921 | 806 | 83.6 | globlastp |
| 3957 | LAB502 | centaurea\|gb166\|EL933532_T1 | 6922 | 806 | 82.41 | glotblastn |
| 3958 | LAB502 | physcomitrella\|10v1\|BJ189289_P1 | 6923 | 806 | 82.3 | globlastp |
| 3959 | LAB502 | physcomitrella\|10v1\|AW145127_P1 | 6924 | 806 | 82 | globlastp |
| 3960 | LAB502 | ceratodon\|10v1\|SRR07489050026052_P1 | 6925 | 806 | 81.6 | globlastp |
| 3961 | LAB502 | physcomitrella\|10v1\|AW699515_P1 | 6926 | 806 | 81.6 | globlastp |
| 3962 | LAB502 | trigonella\|11v1\|SRR066194X103065_P1 | 6927 | 806 | 81.2 | globlastp |
| 3963 | LAB502 | banana\|10v1\|EB085195_P1 | 6928 | 806 | 80.2 | globlastp |
| 3964 | LAB502 | lolium\|10v1\|AU245800_P1 | 6929 | 806 | 80 | globlastp |
| 3965 | LAB503 | sorghum\|09v1\|SB07G025970 | 6930 | 807 | 99.2 | globlastp |
| 3966 | LAB503 | sugarcane\|10v1\|CA070617 | 6931 | 807 | 98.7 | globlastp |
| 3967 | LAB503 | switchgrass\|gb167\|DN150120 | 6932 | 807 | 97.3 | globlastp |
| 3968 | LAB503 | rice\|gb170\|OS08G42410 | 6933 | 807 | 94.4 | globlastp |
| 3969 | LAB503 | sugarcane\|10v1\|CA121484 | 6934 | 807 | 92.6 | globlastp |
| 3970 | LAB503 | millet\|10v1\|EVO454PM011372_P1 | 6935 | 807 | 92.5 | globlastp |
| 3971 | LAB503 | switchgrass\|gb167\|FE643527 | 6936 | 807 | 92.5 | globlastp |
| 3972 | LAB503 | foxtail_millet\|10v2\|OXEC612508T1_P1 | 6937 | 807 | 92.2 | globlastp |
| 3973 | LAB503 | sorghum\|09v1\|SB02G029470 | 6938 | 807 | 91.8 | globlastp |
| 3974 | LAB503 | maize\|10v1\|AF069909_P1 | 6939 | 807 | 91.7 | globlastp |
| 3975 | LAB503 | rice\|gb170\|OS09G33500 | 6940 | 807 | 91.5 | globlastp |
| 3976 | LAB503 | barley\|10v1\|I948835 | 6941 | 807 | 91.2 | globlastp |
| 3977 | LAB503 | barley\|10v2\|BI948835_P1 | 6941 | 807 | 91.2 | globlastp |
| 3978 | LAB503 | brachypodium\|09v1\|DV469414_P1 | 6942 | 807 | 91.2 | globlastp |
| 3979 | LAB503 | brachypodium\|09v1\|DV482728_P1 | 6943 | 807 | 91 | globlastp |
| 3980 | LAB503 | wheat\|gb164\|BE442833 | 6944 | 807 | 90.9 | globlastp |
| 3981 | LAB503 | wheat\|10v2\|BE442833_P1 | 6944 | 807 | 90.9 | globlastp |
| 3982 | LAB503 | banana\|10v1\|BBS1037T3_P1 | 6945 | 807 | 89.5 | globlastp |
| 3983 | LAB503 | oat\|10v2\|CN814695_P1 | 6946 | 807 | 89.4 | globlastp |
| 3984 | LAB503 | fescue\|gb161\|DT686030_P1 | 6947 | 807 | 89.4 | globlastp |
| 3985 | LAB503 | oat\|10v2\|GR353262_P1 | 6948 | 807 | 89.3 | globlastp |
| 3986 | LAB503 | barley\|10v1\|BE421360 | 6949 | 807 | 89.1 | globlastp |
| 3987 | LAB503 | barley\|10v2\|BE421360_P1 | 6949 | 807 | 89.1 | globlastp |
| 3988 | LAB503 | wheat\|10v2\|BE399382_P1 | 6950 | 807 | 89.1 | globlastp |
| 3989 | LAB503 | wheat\|gb164\|BE399382 | 6950 | 807 | 89.1 | globlastp |
| 3990 | LAB503 | millet\|10v1\|EVO454PM002130_P1 | 6951 | 807 | 87.7 | globlastp |
| 3991 | LAB503 | oil_palm\|gb166\|CN600172_P1 | 6952 | 807 | 87 | globlastp |
| 3992 | LAB503 | ginger\|gb164\|DY351341_P1 | 6953 | 807 | 87 | globlastp |
| 3993 | LAB503 | castorbean\|09v1\|EE255930_P1 | 6954 | 807 | 86.9 | globlastp |
| 3994 | LAB503 | melon\|10v1\|DV632289_P1 | 6955 | 807 | 86.6 | globlastp |
| 3995 | LAB503 | eucalyptus\|11v2\|CT983549_P1 | 6956 | 807 | 86.5 | globlastp |
| 3996 | LAB503 | prunus\|10v1\|CN445178 | 6957 | 807 | 86.5 | globlastp |
| 3997 | LAB503 | poplar\|10v1\|BI120224_P1 | 6958 | 807 | 86.4 | globlastp |
| 3998 | LAB503 | euphorbia\|11v1\|DV142182_P1 | 6959 | 807 | 86.3 | globlastp |
| 3999 | LAB503 | tripterygium\|11v1\|SRR098677X106611_P1 | 6960 | 807 | 86.3 | globlastp |
| 4000 | LAB503 | oak\|10v1\|CU640028_P1 | 6961 | 807 | 86.3 | globlastp |
| 4001 | LAB503 | cucumber\|09v1\|DN909343_P1 | 6962 | 807 | 86.1 | globlastp |
| 4002 | LAB503 | strawberry\|11v1\|CO817439_P1 | 6963 | 807 | 86 | globlastp |
| 4003 | LAB503 | cucurbita\|11v1\|SRR091276X12375_P1 | 6964 | 807 | 85.9 | globlastp |

TABLE 71-continued

Homologues of the identified genes/polypeptides for increasing abiotic stress tolerance, water use efficiency, yield, growth rate, vigor, oil content, biomass, growth rate, fiber yield and/or quality, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4004 | LAB503 | momordica\|10v1\|SRR071315S0002639_P1 | 6965 | 807 | 85.9 | globlastp |
| 4005 | LAB503 | amsonia\|11v1\|SRR098688X100388_P1 | 6966 | 807 | 85.8 | globlastp |
| 4006 | LAB503 | apple\|11v1\|CN580763_P1 | 6967 | 807 | 85.8 | globlastp |
| 4007 | LAB503 | cassava\|09v1\|DV442964_P1 | 6968 | 807 | 85.8 | globlastp |
| 4008 | LAB503 | platanus\|11v1\|SRR096786X116152XX1_P1 | 6969 | 807 | 85.7 | globlastp |
| 4009 | LAB503 | olea\|11v1\|SRR014463.10442_P1 | 6970 | 807 | 85.6 | globlastp |
| 4010 | LAB503 | kiwi\|gb166\|FG405188_P1 | 6971 | 807 | 85.5 | globlastp |
| 4011 | LAB503 | platanus\|11v1\|SRR096786X110945_P1 | 6972 | 807 | 85.4 | globlastp |
| 4012 | LAB503 | clementine\|11v1\|BQ623671_P1 | 6973 | 807 | 85.3 | globlastp |
| 4013 | LAB503 | cotton\|10v2\|SRR032367S0018888_P1 | 6974 | 807 | 85.3 | globlastp |
| 4014 | LAB503 | euonymus\|11v1\|SRR070038X172984_P1 | 6975 | 807 | 85.3 | globlastp |
| 4015 | LAB503 | tripterygium\|11v1\|SRR098677X103583_P1 | 6976 | 807 | 85.3 | globlastp |
| 4016 | LAB503 | citrus\|gb166\|BQ623671_P1 | 6977 | 807 | 85.3 | globlastp |
| 4017 | LAB503 | poplar\|10v1\|BI070241_P1 | 6978 | 807 | 85.3 | globlastp |
| 4018 | LAB503 | cotton\|10v1\|AI729237 | 6979 | 807 | 85.3 | globlastp |
| 4019 | LAB503 | cotton\|10v2\|BF269020_P1 | 6979 | 807 | 85.3 | globlastp |
| 4020 | LAB503 | bean\|gb167\|CA896855_P1 | 6980 | 807 | 85.3 | globlastp |
| 4021 | LAB503 | chelidonium\|11v1\|SRR084752X101859_P1 | 6981 | 807 | 85 | globlastp |
| 4022 | LAB503 | orange\|11v1\|BQ623671_P1 | 6982 | 807 | 85 | globlastp |
| 4023 | LAB503 | apple\|11v1\|CN444231_P1 | 6983 | 807 | 85 | globlastp |
| 4024 | LAB503 | apple\|gb171\|CN444231 | 6983 | 807 | 85 | globlastp |
| 4025 | LAB503 | primula\|11v1\|SRR098679X100331_T1 | 6984 | 807 | 84.99 | glotblastn |
| 4026 | LAB503 | strawberry\|gb164\|CO817439 | 6985 | 807 | 84.92 | glotblastn |
| 4027 | LAB503 | nasturtium\|10v1\|SRR032558S0027093_P1 | 6986 | 807 | 84.8 | globlastp |
| 4028 | LAB503 | spurge\|gb161\|DV142182_T1 | 6987 | 807 | 84.72 | glotblastn |
| 4029 | LAB503 | cowpea\|gb166\|FF401370_P1 | 6988 | 807 | 84.7 | globlastp |
| 4030 | LAB503 | peanut\|10v1\|ES718371_P1 | 6989 | 807 | 84.7 | globlastp |
| 4031 | LAB503 | grape\|gb160\|BM437445_P1 | 6990 | 807 | 84.7 | globlastp |
| 4032 | LAB503 | cacao\|10v1\|CA795117_P1 | 6991 | 807 | 84.5 | globlastp |
| 4033 | LAB503 | phyla\|11v1\|SRR099035X107109_P1 | 6992 | 807 | 84.5 | globlastp |
| 4034 | LAB503 | tabernaemontana\|11v1\|SRR098689X104675_P1 | 6993 | 807 | 84.5 | globlastp |
| 4035 | LAB503 | nasturtium\|10v1\|SRR032558S0010961_P1 | 6994 | 807 | 84.5 | globlastp |
| 4036 | LAB503 | soybean\|11v1\|GLYMA02G46380_P1 | 6995 | 807 | 84.5 | globlastp |
| 4037 | LAB503 | soybean\|gb168\|AW689245 | 6995 | 807 | 84.5 | globlastp |
| 4038 | LAB503 | phyla\|11v1\|SRR099037X103704_P1 | 6996 | 807 | 84.3 | globlastp |
| 4039 | LAB503 | centaurea\|gb166\|EH718655_P1 | 6997 | 807 | 84.3 | globlastp |
| 4040 | LAB503 | catharanthus\|11v1\|EG560366_P1 | 6998 | 807 | 84.2 | globlastp |
| 4041 | LAB503 | orobanche\|10v1\|SRR023189S0002041_P1 | 6999 | 807 | 84.2 | globlastp |
| 4042 | LAB503 | triphysaria\|10v1\|EY130329_P1 | 7000 | 807 | 84.2 | globlastp |
| 4043 | LAB503 | tobacco\|gb162\|AJ718902 | 7001 | 807 | 84.2 | globlastp |
| 4044 | LAB503 | lotus\|09v1\|AW720381_P1 | 7002 | 807 | 84.2 | globlastp |
| 4045 | LAB503 | medicago\|09v1\|AW689245_P1 | 7003 | 807 | 84.2 | globlastp |
| 4046 | LAB503 | soybean\|11v1\|GLYMA14G36540_P1 | 7004 | 807 | 84.2 | globlastp |
| 4047 | LAB503 | soybean\|gb168\|AW720381 | 7005 | 807 | 84.2 | globlastp |
| 4048 | LAB503 | triphysaria\|10v1\|BM356437_P1 | 7006 | 807 | 84 | globlastp |
| 4049 | LAB503 | antirrhinum\|gb166\|AJ568545_P1 | 7007 | 807 | 84 | globlastp |
| 4050 | LAB503 | scabiosa\|11v1\|SRR063723X100880_T1 | 7008 | 807 | 83.91 | glotblastn |
| 4051 | LAB503 | monkeyflower\|10v1\|GO976288_P1 | 7009 | 807 | 83.9 | globlastp |
| 4052 | LAB503 | vinca\|11v1\|SRR098690X118327_P1 | 7010 | 807 | 83.9 | globlastp |
| 4053 | LAB503 | amsonia\|11v1\|SRR098688X103402_P1 | 7011 | 807 | 83.6 | globlastp |
| 4054 | LAB503 | potato\|10v1\|BG590607_P1 | 7012 | 807 | 83.6 | globlastp |
| 4055 | LAB503 | solanum_phureja\|09v1\|SPHBG134704 | 7012 | 807 | 83.6 | globlastp |
| 4056 | LAB503 | tragopogon\|10v1\|SRR020205S0013867 | 7013 | 807 | 83.6 | globlastp |
| 4057 | LAB503 | soybean\|11v1\|GLYMA14G02380_P1 | 7014 | 807 | 83.4 | globlastp |
| 4058 | LAB503 | sunflower\|10v1\|BU672032_P1 | 7015 | 807 | 83.4 | globlastp |
| 4059 | LAB503 | nasturtium\|10v1\|SRR032558S0064202_P1 | 7016 | 807 | 83.4 | globlastp |
| 4060 | LAB503 | lettuce\|10v1\|DW048847_P1 | 7017 | 807 | 83.3 | globlastp |
| 4061 | LAB503 | cassava\|09v1\|FF379831_P1 | 7018 | 807 | 83.2 | globlastp |
| 4062 | LAB503 | ipomoea_nil\|10v1\|BJ553306_P1 | 7019 | 807 | 83.2 | globlastp |
| 4063 | LAB503 | pepper\|gb171\|CA514366_P1 | 7020 | 807 | 83.2 | globlastp |
| 4064 | LAB503 | phyla\|11v1\|SRR099035X103527_P1 | 7021 | 807 | 83.2 | globlastp |
| 4065 | LAB503 | plantago\|11v1\|SRR066373X106801_T1 | 7022 | 807 | 83.16 | glotblastn |
| 4066 | LAB503 | guizotia\|10v1\|GE555771_T1 | 7023 | 807 | 83.11 | glotblastn |
| 4067 | LAB503 | abies\|11v2\|SRR098676X100907_P1 | 7024 | 807 | 83.1 | globlastp |
| 4068 | LAB503 | maritime_pine\|10v1\|AL750582_P1 | 7025 | 807 | 83.1 | globlastp |
| 4069 | LAB503 | pine\|10v2\|AA739654_P1 | 7026 | 807 | 83.1 | globlastp |
| 4070 | LAB503 | pseudotsuga\|10v1\|SRR065119S0010729_P1 | 7027 | 807 | 83.1 | globlastp |
| 4071 | LAB503 | vinca\|11v1\|SRR098690X109384_P1 | 7028 | 807 | 83.1 | globlastp |
| 4072 | LAB503 | pine\|10v1\|AA739654 | 7026 | 807 | 83.1 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4073 | LAB503 | tomato\|09v1\|BG134704 | 7029 | 807 | 83 | globlastp |
| 4074 | LAB503 | tomato\|10v1\|AA840651_P1 | 7029 | 807 | 83 | globlastp |
| 4075 | LAB503 | safflower\|gb162\|EL373784_T1 | 7030 | 807 | 82.93 | glotblastn |
| 4076 | LAB503 | trigonella\|11v1\|SRR066194X156136_P1 | 7031 | 807 | 82.9 | globlastp |
| 4077 | LAB503 | sciadopitys\|10v1\|SRR065035S0010364_P1 | 7032 | 807 | 82.8 | globlastp |
| 4078 | LAB503 | dandelion\|10v1\|DR399749_P1 | 7033 | 807 | 82.8 | globlastp |
| 4079 | LAB503 | plantago\|11v1\|SRR066373X260683_P1 | 7034 | 807 | 82.6 | globlastp |
| 4080 | LAB503 | spruce\|gb162\|CO216795 | 7035 | 807 | 82.6 | globlastp |
| 4081 | LAB503 | spruce\|gb162\|CO232905 | 7036 | 807 | 82.6 | globlastp |
| 4082 | LAB503 | artemisia\|10v1\|EY072976_P1 | 7037 | 807 | 82.6 | globlastp |
| 4083 | LAB503 | pine\|10v2\|SRR063939S0018092_T1 | 7038 | 807 | 82.59 | glotblastn |
| 4084 | LAB503 | dandelion\|10v1\|DR398635_T1 | 7039 | 807 | 82.57 | glotblastn |
| 4085 | LAB503 | aristolochia\|10v1\|SRR039082S0029802_P1 | 7040 | 807 | 82.5 | globlastp |
| 4086 | LAB503 | cephalotaxus\|11v1\|SRR064395X125475_P1 | 7041 | 807 | 82.4 | globlastp |
| 4087 | LAB503 | podocarpus\|10v1\|SRR065014S0042978_P1 | 7042 | 807 | 82.4 | globlastp |
| 4088 | LAB503 | senecio\|gb170\|DV038763_P1 | 7043 | 807 | 82.4 | globlastp |
| 4089 | LAB503 | arnica\|11v1\|SRR099034X101337_P1 | 7044 | 807 | 82.3 | globlastp |
| 4090 | LAB503 | cedrus\|11v1\|SRR065007X101201_T1 | 7045 | 807 | 82.25 | glotblastn |
| 4091 | LAB503 | aristolochia\|10v1\|SRR039086S0070639_P1 | 7046 | 807 | 82 | globlastp |
| 4092 | LAB503 | taxus\|10v1\|SRR032523S0003882_P1 | 7047 | 807 | 82 | globlastp |
| 4093 | LAB503 | canola\|10v1\|DW997807_P1 | 7048 | 807 | 81.8 | globlastp |
| 4094 | LAB503 | catharanthus\|11v1\|SRR098691X106338_P1 | 7049 | 807 | 81.8 | globlastp |
| 4095 | LAB503 | distylium\|11v1\|SRR065077X10135_P1 | 7050 | 807 | 81.8 | globlastp |
| 4096 | LAB503 | fagopyrum\|11v1\|SRR063689X101240_P1 | 7051 | 807 | 81.8 | globlastp |
| 4097 | LAB503 | fagopyrum\|11v1\|SRR063689X130202_P1 | 7052 | 807 | 81.8 | globlastp |
| 4098 | LAB503 | sequoia\|10v1\|SRR065044S0032234_P1 | 7053 | 807 | 81.8 | globlastp |
| 4099 | LAB503 | silene\|11v1\|SRR096785X116330_P1 | 7054 | 807 | 81.8 | globlastp |
| 4100 | LAB503 | trigonella\|11v1\|SRR066194X200157_P1 | 7055 | 807 | 81.8 | globlastp |
| 4101 | LAB503 | aquilegia\|10v2\|DR920527_P1 | 7056 | 807 | 81.7 | globlastp |
| 4102 | LAB503 | potato\|10v1\|BE920664_P1 | 7057 | 807 | 81.6 | globlastp |
| 4103 | LAB503 | radish\|gb164\|EV565408_P1 | 7058 | 807 | 81.6 | globlastp |
| 4104 | LAB503 | tomato\|10v1\|BG124576_P1 | 7059 | 807 | 81.6 | globlastp |
| 4105 | LAB503 | arabidopsis\|10v1\|AT5G50850_P1 | 7060 | 807 | 81.5 | globlastp |
| 4106 | LAB503 | cotton\|10v2\|DT526804_P1 | 7061 | 807 | 81.5 | globlastp |
| 4107 | LAB503 | eucalyptus\|11v2\|SRR001660X147989_P1 | 7062 | 807 | 81.4 | globlastp |
| 4108 | LAB503 | canola\|10v1\|EE477145_P1 | 7063 | 807 | 81.3 | globlastp |
| 4109 | LAB503 | radish\|gb164\|EV524384_P1 | 7064 | 807 | 81.3 | globlastp |
| 4110 | LAB503 | silene\|11v1\|SRR096785X105952_P1 | 7065 | 807 | 81.3 | globlastp |
| 4111 | LAB503 | solanum_phureja\|09v1\|SPHBG124576_P1 | 7066 | 807 | 81.3 | globlastp |
| 4112 | LAB503 | arabidopsis_lyrata\|09v1\|JGIAL029504_P1 | 7067 | 807 | 81.2 | globlastp |
| 4113 | LAB503 | b_oleracea\|gb161\|AM388630_P1 | 7068 | 807 | 81.2 | globlastp |
| 4114 | LAB503 | b_rapa\|gb162\|DY013455_P1 | 7069 | 807 | 81.2 | globlastp |
| 4115 | LAB503 | canola\|10v1\|CN729915_P1 | 7070 | 807 | 81.2 | globlastp |
| 4116 | LAB503 | arnica\|11v1\|SRR099034X104740_P1 | 7071 | 807 | 81 | globlastp |
| 4117 | LAB503 | lettuce\|10v1\|DW066145_T1 | 7072 | 807 | 81 | glotblastn |
| 4118 | LAB503 | pea\|11v1\|PSU56697_P1 | 7073 | 807 | 81 | globlastp |
| 4119 | LAB503 | zostera\|10v1\|AM771694_P1 | 7074 | 807 | 81 | globlastp |
| 4120 | LAB503 | radish\|gb164\|EV550207_P1 | 7075 | 807 | 80.6 | globlastp |
| 4121 | LAB503 | aquilegia\|10v2\|DR930190_P1 | 7076 | 807 | 80.4 | globlastp |
| 4122 | LAB503 | cotton\|10v2\|BG445737_P1 | 7077 | 807 | 80.4 | globlastp |
| 4123 | LAB503 | vinca\|11v1\|SRR098690X14173_P1 | 7078 | 807 | 80.4 | globlastp |
| 4124 | LAB503 | fagopyrum\|11v1\|SRR063689X138806_T1 | 7079 | 807 | 80.16 | glotblastn |
| 4125 | LAB503 | euonymus\|11v1\|SRR070038X229923_P1 | 7080 | 807 | 80 | globlastp |
| 4126 | LAB512 | sorghum\|09v1\|SB01G030700 | 7081 | 810 | 86.41 | glotblastn |
| 4127 | LAB533 | wheat\|gb164\|BE415843 | 7082 | 812 | 92.05 | glotblastn |
| 4128 | LAB533 | wheat\|10v2\|BE416324_P1 | 7083 | 812 | 92 | globlastp |
| 4129 | LAB543 | maize\|10v1\|DW880064_P1 | 7084 | 816 | 83 | globlastp |
| 4130 | LAB549 | sorghum\|09v1\|SB01G048390 | 7085 | 817 | 99.8 | globlastp |
| 4131 | LAB549 | sorghum\|09v1\|SLXL51636829D1 | 7086 | 817 | 99.1 | globlastp |
| 4132 | LAB549 | maize\|10v1\|EU956594_P1 | 7087 | 817 | 91.8 | globlastp |
| 4133 | LAB549 | maize\|10v1\|GRMZM2G075417T01_P1 | 7088 | 817 | 89.7 | globlastp |
| 4134 | LAB549 | foxtail_millet\|10v2\|SICRP036282_T1 | 7089 | 817 | 88.34 | glotblastn |
| 4135 | LAB549 | rice\|gb170\|OS03G03790_P1 | 7090 | 817 | 85.1 | globlastp |
| 4136 | LAB550 | switchgrass\|gb167\|FE605081 | 7091 | 818 | 82.4 | globlastp |
| 4137 | LAB550 | switchgrass\|gb167\|FL794325 | 7091 | 818 | 82.4 | globlastp |
| 4138 | LAB550 | switchgrass\|gb167\|DN142623_P1 | 7092 | 818 | 81.3 | globlastp |
| 4139 | LAB550 | switchgrass\|gb167\|DN144706_P1 | 7093 | 818 | 81.3 | globlastp |
| 4140 | LAB554 | rice\|gb170\|OS09G29630 | 7094 | 820 | 83.7 | globlastp |
| 4141 | LAB559 | sugarcane\|10v1\|CA082129 | 7095 | 821 | 89.3 | globlastp |

TABLE 71-continued

Homologues of the identified genes/polypeptides for increasing
abiotic stress tolerance, water use efficiency, yield, growth rate,
vigor, oil content, biomass, growth rate, fiber yield and/or quality,
nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4142 | LAB559 | foxtail_millet\|10v2\|SICRP039525_P1 | 7096 | 821 | 84.7 | globlastp |
| 4143 | LAB559 | millet\|10v1\|EB411109_P1 | 7097 | 821 | 84.2 | globlastp |
| 4144 | LAB564 | maize\|10v1\|AI973510_P1 | 7098 | 823 | 90.9 | globlastp |
| 4145 | LAB564 | maize\|10v1\|CK368631_P1 | 7099 | 823 | 90.3 | globlastp |
| 4146 | LAB564 | switchgrass\|gb167\|FL755404 | 7100 | 823 | 88.15 | globlastn |
| 4147 | LAB567 | sorghum\|09v1\|SB01G035410 | 7101 | 824 | 93.9 | globlastp |
| 4148 | LAB567 | millet\|10v1\|EVO454PM004173_P1 | 7102 | 824 | 91.8 | globlastp |
| 4149 | LAB567 | switchgrass\|gb167\|FE612695 | 7103 | 824 | 91.59 | globlastn |
| 4150 | LAB567 | rice\|gb170\|OS03G22730 | 7104 | 824 | 88.5 | globlastp |
| 4151 | LAB567 | rice\|gb170\|OS03G22740 | 7105 | 824 | 88.1 | globlastp |
| 4152 | LAB567 | brachypodium\|09v1\|GT764265_P1 | 7106 | 824 | 83.4 | globlastp |
| 4153 | LAB567 | wheat\|10v2\|CA706801_P1 | 7107 | 824 | 83 | globlastp |
| 4154 | LAB567 | wheat\|10v2\|BE429257_P1 | 7108 | 824 | 82.9 | globlastp |
| 4155 | LAB567 | oat\|10v2\|GO592374_P1 | 7109 | 824 | 82.9 | globlastp |
| 4156 | LAB567 | barley\|10v1\|BF622353 | 7110 | 824 | 82.7 | globlastp |
| 4157 | LAB567 | barley\|10v2\|BF622353_P1 | 7110 | 824 | 82.7 | globlastp |
| 4158 | LAB567 | wheat\|gb164\|BE403387 | 7111 | 824 | 82.7 | globlastp |
| 4159 | LAB573 | sugarcane\|10v1\|CA123154 | 7112 | 827 | 92.4 | globlastp |
| 4160 | LAB573 | maize\|10v1\|AI833418_P1 | 7113 | 827 | 91.3 | globlastp |
| 4161 | LAB573 | switchgrass\|gb167\|FL709257 | 7114 | 827 | 89.4 | globlastp |
| 4162 | LAB573 | cenchrus\|gb166\|EB661934_P1 | 7115 | 827 | 89.1 | globlastp |
| 4163 | LAB573 | switchgrass\|gb167\|DN141391 | 7116 | 827 | 86.7 | globlastp |
| 4164 | LAB573 | rice\|gb170\|OS02G54140_P1 | 7117 | 827 | 80.3 | globlastp |
| 4165 | LAB582 | sorghum\|09v1\|SLXL50077026D1 | 7118 | 829 | 80.5 | globlastp |
| 4166 | LAB595 | maize\|10v1\|CO452585_P1 | 7119 | 832 | 95.7 | globlastp |
| 4167 | LAB595 | millet\|10v1\|EVO454PM466363_P1 | 7120 | 832 | 91.1 | globlastp |
| 4168 | LAB595 | foxtail_millet\|10v2\|SICRP024023_T1 | 7121 | 832 | 90.18 | globlastn |
| 4169 | LAB595 | rice\|gb170\|OS06G42850 | 7122 | 832 | 85.9 | globlastp |
| 4170 | LAB595 | oat\|10v2\|CN814734_P1 | 7123 | 832 | 84.4 | globlastp |
| 4171 | LAB597 | foxtail_millet\|10v2\|SICRP035481_T1 | 7124 | 833 | 88.42 | globlastn |
| 4172 | LAB597 | maize\|10v1\|CN844139_P1 | 7125 | 833 | 88 | globlastp |
| 4173 | LAB597 | sugarcane\|10v1\|CA102932 | 7126 | 833 | 86 | globlastp |
| 4174 | LAB597 | rice\|gb170\|OS06G49660 | 7127 | 833 | 84.8 | globlastp |
| 4175 | LAB597 | brachypodium\|09v1\|SRR031797S0015214_P1 | 7128 | 833 | 82.6 | globlastp |
| 4176 | LAB601 | sunflower\|10v1\|SFSLX00159135D2 | 7129 | 834 | 92.59 | globlastn |
| 4177 | LAB601 | parthenium\|10v1\|GW776578_P1 | 7130 | 834 | 86.4 | globlastp |

Table 71:
Provided are the homologous polypeptides (polypep.) and polynucleotides (polynucl.) of the genes for increasing abiotic stress tolerance, yield, growth rate, vigor, oil content, biomass, fiber yield and/or quality, nitrogen use efficiency, water use efficiency and fertilizer use efficiency genes of a plant which are listed in Table 70 above.
Homology was calculated as % of identity over the aligned sequences.
The query sequences were polynucleotide and polypeptides depicted in Table 70 above, and the subject sequences are protein and polynucleotide sequences identified in the database based on greater than 80% global identity to the query nucleotide and/or polypeptide sequences.
Hom. = Homology;
Glob. = Global;
Algor. = Algorithm.

The output of the functional genomics approach described herein is a set of genes highly predicted to improve ABST, yield and/or other agronomic important traits such as growth rate, vigor, biomass, growth rate, oil content, fiber yield, fiber quality, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 14

Gene Cloning and Generation of Binary Vectors for Plant Expression

To validate their role in improving ABST, yield, growth rate, biomass, vigor, oil content, fiber yield and/or quality, WUE, NUE and/or FUE selected genes were over-expressed in plants, as follows.
Cloning Strategy
Selected genes from those presented in Examples 13 and 14 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products were purified using PCR purification kit (Qiagen).

Usually, 2 sets of primers were prepared for the amplification of each gene, via nested PCR (if required). Both sets of primers were used for amplification on cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers were designed for a gene). To facilitate further cloning of the cDNAs, an 8-12 bp extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested PCR product was inserted into a high copy vector pBlue-script KS plasmid vector [pBlue-script KS plasmid vector, Hypertext Transfer Protocol://World Wide Web (dot) stratagene (dot) to com/ manuals/212205 (dot) pdf) or pUC19 (New England Bio-Labs Inc], or into plasmids originated from these vectors. In case of the high copy vector originated from pBlue-script KS plasmid vector (pGXN or pGXNa), the PCR product was inserted in the high copy plasmid upstream to the NOS terminator (SEQ ID NO:7720) originated from pBI 101.3 binary vector (GenBank Accession No. U12640, nucleotides 4356 to 4693) and downstream to the 35S promoter. In other cases (pKSJ=6669a or pUC19_pr6669), the At6669 promoter (SEQ ID NO:7724) was already cloned into the pBlue-script KS or pUC19 respectively, so the gene was introduced downstream of the promoter.

Sequencing of the inserted genes was performed using the ABI 377 sequencer (Applied Biosystems). In some cases, after confirming the sequences of the cloned genes, the cloned cDNA accompanied/or not with the NOS terminator was introduced into a modified pGI binary vector containing the At6669 promoter via digestion with appropriate restriction endonucleases (the cloned gene replaces the GUI gene). In other cases the cloned cDNA accompanied with the At6669 promoter was introduced into a pGI vector (that does not contain the At6669 promoter). In any case the insert was followed by single copy of the NOS terminator (SEQ ID NO:7720). The digested products and the linearized plasmid vector are ligated using T4 DNA ligase enzyme (Roche, Switzerland).

Several DNA sequences of the selected genes are synthesized by GeneArt [Hypertext Transfer Protocol://World Wide Web (dot) geneart (dot) com/]. Synthetic DNA is designed in silico. Suitable restriction enzymes sites were added to the cloned sequences at the 5' end and at the 3' end to enable later cloning into the desired binary vector.

The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI (FIG. 1) is similar to pPI, but the original gene in the backbone is GUS-Intron and not GUS.

The modified pGI vector (pQFN or pQYN_6669) is a modified version of the pGI vector in which the cassette is inverted between the left and right borders so the gene and its corresponding promoter are close to the right border and the NPTII gene is close to the left border.

At6669, the *Arabidopsis thaliana* promoter sequence (SEQ ID NO:7724) was inserted in the modified pGI binary vector, upstream to the cloned genes, followed by DNA ligation and binary plasmid extraction from positive *E. coli* colonies, as described above. Colonies were analyzed by PCR using the primers covering the insert which are designed to span the introduced promoter and gene. Positive plasmids were identified, isolated and sequenced.

Selected genes cloned by the present inventors are provided in Table 72 below.

TABLE 72

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LAB448 | pQFNc | BARLEY - *Hordeum vulgare* L. ND | 7469, 7578 | 324 | 762 |
| LAB390 | pUC19c | BARLEY *Hordeum vulgare* L. ND | 7131, 7300, 7470, 7579 | 276 | 474 |
| LAB393 | pUC19c | BARLEY *Hordeum vulgare* L. ND | 7132, 7301 | 277 | 735 |
| LAB394 | pUC19c | SORGHUM *Sorghum bicolor* ND | 7133, 7302 | 278 | 477 |
| LAB395 | pUC19c | SUNFLOWER *Helianthus annuus* ND | 7134, 7303, 7134, 7580 | 279 | 736 |
| LAB396 | pUC19c | TOMATO *Lycopersicum esculentum* MD | 7135, 7304, 7471, 7304 | 280 | 479 |
| LAB397 | pUC19c | TOMATO *Lycopersicum esculentum* MD | 7472, 7581 | 281 | 737 |
| LAB398 | pUC19c | TOMATO *Lycopersicum esculentum* MD | 7136, 7305, 7473, 7305 | 282 | 738 |
| LAB399 | pUC19c | TOMATO *Lycopersicum esculentum* MD | 7137, 7306, 7137, 7582 | 283 | 482 |
| LAB400 | pUC19c | TOMATO *Lycopersicum esculentum* MD | 7138, 7307, 7474, 7583 | 284 | 739 |
| LAB401 | pUC19c | TOMATO *Lycopersicum esculentum* MD | 7139, 7308, 7139, 7584 | 285 | 484 |
| LAB402 | Topo B | BARLEY *Hordeum vulgare* L. ND | 7140, 7309, 7475, 7585 | 286 | 740 |
| LAB403 | Topo B | BARLEY *Hordeum vulgare* L. ND | 7476, 7586 | 473 | — |
| LAB404 | pUC19c | BARLEY *Hordeum vulgare* L. ND | 7141, 7310, 7477, 7587 | 287 | 741 |
| LAB405 | pUC19c | BARLEY *Hordeum vulgare* L. Manit | 7142, 7311, 7478, 7588 | 288 | 742 |

TABLE 72-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LAB406 | pUC19c | COTTON *Gossypium barbadense* Pima | 7143, 7312, 7143, 7589 | 289 | 743 |
| LAB407 | pUC19c | SUNFLOWER *Helianthus annuus* ND | 7479, 7590 | 290 | 489 |
| LAB408 | pUC19c | SUNFLOWER *Helianthus annuus* ND | 7144, 7313, 7480, 7313 | 291 | 744 |
| LAB409 | pUC19c | TOMATO *Lycopersicum esculentum* MD | 7145, 7314, 7145, 7591 | 292 | 745 |
| LAB410 | pUC19c | BARLEY *Hordeum vulgare* L. ND | 7146, 7315 | 293 | 492 |
| LAB412 | pUC19c | BARLEY *Hordeum vulgare* L. ND | 7147, 7316, 7147, 7592 | 294 | 746 |
| LAB418 | Topo B | BARLEY *Hordeum vulgare* L. ND | 7148, 7317, 7481, 7593 | 297 | 747 |
| LAB419 | pUC19c | BARLEY *Hordeum vulgare* L. ND | 7149, 7318, 7482, 7594 | 298 | 748 |
| LAB420 | pUC19c | BARLEY *Hordeum vulgare* L. ND | 7150, 7319, 7150, 7595 | 299 | 749 |
| LAB422 | pUC19c | BARLEY *Hordeum vulgare* L. ND | 7151, 7320, 7483, 7596 | 300 | 501 |
| LAB423 | pUC19c | BARLEY *Hordeum vulgare* L. ND | 7152, 7321, 7152, 7597 | 301 | 502 |
| LAB424 | pUC19c | BARLEY *Hordeum vulgare* L. ND | 7153, 7322, 7484, 7484 | 302 | 750 |
| LAB425 | pUC19c | BARLEY *Hordeum vulgare* L. ND | 7154, 7323, 7485, 7598 | 303 | 504 |
| LAB426 | pUC19c | BARLEY *Hordeum vulgare* L. ND | 7155, 7324 | 304 | 751 |
| LAB427 | pUC19c | BARLEY *Hordeum vulgare* L. ND | 7156, 7325 | 305 | 752 |
| LAB428 | pUC19c | BARLEY *Hordeum vulgare* L. Manit | 7157, 7326, 7157, 7599 | 306 | 507 |
| LAB430 | pUC19c | BARLEY *Hordeum vulgare* L. ND | 7158, 7327, 7158, 7600 | 308 | 753 |
| LAB431 | pUC19c | BARLEY *Hordeum vulgare* L. ND | 7159, 7328, 7486, 7601 | 309 | 754 |
| LAB432 | pUC19c | BARLEY *Hordeum vulgare* L. ND | 7160, 7329 | 310 | 511 |
| LAB434 | Topo B | COTTON *Gossypium barbadense* Pima | 7487, 7602 | 312 | 755 |
| LAB435 | pUC19c | BARLEY *Hordeum vulgare* L. ND | 7488, 7603 | 313 | 514 |
| LAB437 | Topo B | BARLEY *Hordeum vulgare* L. Manit | 7161, 7330 | 314 | 756 |
| LAB438 | pUC19c | BARLEY *Hordeum vulgare* L. ND | 7489, 7604 | 315 | 757 |
| LAB439 | pUC19c | BARLEY *Hordeum vulgare* L. ND | 7162, 7331 | 316 | 518 |
| LAB440 | pUC19c | BARLEY *Hordeum vulgare* L. ND | 7163, 7332, 7490, 7605 | 317 | 758 |
| LAB442 | pUC19c | BARLEY *Hordeum vulgare* L. ND | 7164, 7333 | 318 | 759 |
| LAB443 | pUC19c | BARLEY *Hordeum vulgare* L. ND | 7165, 7334, 7491, 7606 | 319 | 521 |
| LAB444 | pUC19c | BARLEY *Hordeum vulgare* L. ND | 7166, 7335, 7492, 7607 | 320 | 760 |
| LAB445 | pUC19c | BARLEY *Hordeum vulgare* L. ND | 7167, 7336 | 321 | 523 |
| LAB446 | pUC19c | BARLEY *Hordeum vulgare* L. ND | 7168, 7337, 7493, 7608 | 322 | 524 |
| LAB447 | pUC19c | BARLEY *Hordeum vulgare* L. ND | 7169, 7338, 7169, 7609 | 323 | 761 |
| LAB449 | pUC19c | BARLEY *Hordeum vulgare* L. Manit | 7170, 7339, 7170, 7610 | 325 | 527 |
| LAB450 | pUC19c | BARLEY *Hordeum vulgare* L. Manit | 7171, 7340, 7494, 7611 | 326 | 763 |
| LAB451 | pUC19c | BARLEY *Hordeum vulgare* L. ND | 7172, 7341, 7172, 7612 | 327 | 764 |
| LAB452 | pUC19c | BARLEY *Hordeum vulgare* L. Manit | 7173, 7342, 7495, 7173 | 328 | 765 |
| LAB453 | pUC19c | MAIZE *Zea mays* L. ND | 7174, 7343, 7496, 7613 | 329 | 766 |
| LAB454 | pUC19c | BARLEY *Hordeum vulgare* L. ND | 7497, 7614 | 330 | 767 |
| LAB455 | pUC19c | BARLEY *Hordeum vulgare* L. Manit | 7175, 7344, 7498, 7615 | 331 | 533 |
| LAB456 | pUC19c | BARLEY *Hordeum vulgare* L. ND | 7176, 7345, 7499, 7616 | 332 | 768 |
| LAB457 | pUC19c | BARLEY *Hordeum vulgare* L. ND | 7177, 7346, 7177, 7617 | 333 | 769 |
| LAB458 | pUC19c | BARLEY *Hordeum vulgare* L. ND | 7178, 7347, 7178, 7618 | 334 | 536 |
| LAB459 | pUC19c | BARLEY *Hordeum vulgare* L. Manit | 7500, 7619 | 335 | 770 |
| LAB460 | pUC19c | BARLEY *Hordeum vulgare* L. ND | 7179, 7348 | 336 | 538 |
| LAB461 | pUC19c | BARLEY *Hordeum vulgare* L. Mazurka | 7180, 7349, 7180, 7620 | 337 | 771 |
| LAB462 | pUC19c | BARLEY *Hordeum vulgare* L. ND | 7181, 7350, 7501, 7621 | 338 | 772 |
| LAB463 | pUC19c | BARLEY *Hordeum vulgare* L. ND | 7182, 7351, 7182, 7622 | 339 | 773 |
| LAB465 | pUC19c | BARLEY *Hordeum vulgare* L. ND | 7183, 7352 | 340 | 774 |
| LAB466 | pUC19c | BARLEY *Hordeum vulgare* L. Manit | 7184, 7353, 7502, 7623 | 341 | 775 |
| LAB467 | pUC19c | BARLEY *Hordeum vulgare* L. ND | 7185, 7354, 7503, 7624 | 342 | 545 |
| LAB468 | pUC19c | BARLEY *Hordeum vulgare* L. Manit | 7186, 7355, 7186, 7625 | 343 | 776 |
| LAB469 | pUC19c | BARLEY *Hordeum vulgare* L. ND | 7504, 7626 | 344 | 777 |
| LAB470 | pUC19c | BARLEY *Hordeum vulgare* L. ND | 7187, 7356, 7187, 7627 | 345 | 778 |
| LAB471 | pUC19c | BARLEY *Hordeum vulgare* L. Manit | 7188, 7357, 7505, 7628 | 346 | 549 |
| LAB472 | pUC19c | BARLEY *Hordeum vulgare* L. Manit | 7506, 7629 | 347 | 779 |
| LAB473 | Topo B | BARLEY *Hordeum vulgare* L. Manit | 7189, 7358, 7507, 7630 | 348 | 780 |
| LAB474 | pUC19c | BARLEY *Hordeum vulgare* L. ND | 7190, 7359, 7190, 7631 | 349 | 781 |
| LAB475 | pUC19c | BARLEY *Hordeum vulgare* L. ND | 7191, 7360, 7508, 7632 | 350 | 782 |
| LAB476 | pUC19c | BARLEY *Hordeum vulgare* L. ND | 7192, 7361, 7509, 7633 | 351 | 783 |
| LAB477 | pUC19c | BARLEY *Hordeum vulgare* L. ND | 7193, 7362, 7193, 7634 | 352 | 784 |
| LAB478 | pUC19c | BARLEY *Hordeum vulgare* L. ND | 7194, 7363 | 353 | 785 |
| LAB479 | pUC19c | COTTON *Gossypium barbadense* Pima | 7195, 7364, 7510, 7635 | 354 | 786 |
| LAB480 | pUC19c | COTTON *Gossypium barbadense* Pima | 7196, 7365 | 355 | 787 |
| LAB481 | Topo B | COTTON *Gossypium barbadense* Pima | 7197, 7366, 7511, 7636 | 356 | 788 |
| LAB483 | pUC19c | COTTON *Gossypium barbadense* Pima | 7198, 7367, 7512, 7637 | 358 | 789 |
| LAB484 | pUC19c | COTTON *Gossypium barbadense* Pima | 7199, 7368, 7513, 7638 | 359 | 790 |
| LAB485 | pUC19c | COTTON *Gossypium barbadense* Pima | 7200, 7369 | 360 | 563 |
| LAB486 | pUC19c | COTTON *Gossypium barbadense* Pima | 7514, 7639 | 361 | 791 |
| LAB487 | pUC19c | COTTON *Gossypium barbadense* Pima | 7201, 7370 | 362 | 792 |
| LAB488 | pUC19c | COTTON *Gossypium barbadense* Pima | 7202, 7371, 7515, 7640 | 363 | 793 |
| LAB489 | pUC19c | COTTON *Gossypium barbadense* Pima | 7516, 7641 | 364 | 794 |
| LAB490 | pUC19c | COTTON *Gossypium barbadense* Pima | 7203, 7372, 7517, 7642 | 365 | 795 |
| LAB491 | pUC19c | COTTON *Gossypium barbadense* Pima | 7204, 7373, 7518, 7643 | 366 | 796 |
| LAB492 | pUC19c | COTTON *Gossypium barbadense* Pima | 7205, 7374, 7519, 7644 | 367 | 797 |
| LAB493 | pUC19c | COTTON *Gossypium barbadense* Pima | 7206, 7375, 7206, 7645 | 368 | 798 |
| LAB494 | pUC19c | COTTON *Gossypium barbadense* Pima | 7207, 7376, 7520, 7646 | 369 | 799 |

TABLE 72-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LAB495 | pUC19c | COTTON *Gossypium barbadense* Pima | 7521, 7647 | 370 | 800 |
| LAB496 | pUC19c | COTTON *Gossypium barbadense* Pima | 7208, 7377, 7522, 7648 | 371 | 801 |
| LAB498 | pUC19c | COTTON *Gossypium barbadense* Pima | 7209, 7378, 7209, 7649 | 372 | 802 |
| LAB499 | pUC19c | COTTON *Gossypium barbadense* Pima | 7210, 7379, 7523, 7650 | 373 | 803 |
| LAB500 | pUC19d | COTTON *Gossypium barbadense* Pima | 7524, 7651 | 374 | 804 |
| LAB501 | pUC19c | COTTON *Gossypium barbadense* Pima | 7211, 7380, 7525, 7652 | 375 | 805 |
| LAB502 | pUC19c | COTTON *Gossypium barbadense* Pima | 7212, 7381 | 376 | 806 |
| LAB503 | pUC19c | MAIZE *Zea mays* L. ND | 7213, 7382, 7526, 7653 | 377 | 807 |
| LAB504 | pUC19d | MAIZE *Zea mays* L. ND | 7214, 7383, 7527, 7654 | 378 | 581 |
| LAB505 | pUC19c | MAIZE *Zea mays* L. ND | 7215, 7384, 7528, 7655 | 379 | 582 |
| LAB506 | pUC19c | MAIZE *Zea mays* L. ND | 7216, 7385, 7529, 7656 | 380 | 583 |
| LAB507 | pUC19c | MAIZE *Zea mays* L. Pioneer 32Y52 | 7217, 7386, 7530, 7657 | 381 | 584 |
| LAB509 | pUC19c | MAIZE *Zea mays* L. ND | 7218, 7387, 7531, 7658 | 383 | 586 |
| LAB510 | pUC19c | MAIZE *Zea mays* L. ND | 7219, 7388, 7532, 7659 | 384 | 808 |
| LAB511 | pUC19c | MAIZE *Zea mays* L. ND | 7220, 7389, 7533, 7660 | 385 | 809 |
| LAB512 | pUC19c | MAIZE *Zea mays* L. Pioneer 32Y52 | 7534, 7661 | 386 | 810 |
| LAB513 | pUC19c | MAIZE *Zea mays* L. ND | 7221, 7390, 7221, 7662 | 387 | 590 |
| LAB516 | pUC19c | RICE *Oryza sativa* L. Japonica Nipponbare | 7222, 7391, 7535, 7663 | 388 | 591 |
| LAB517 | pUC19c | RICE *Oryza sativa* L. Japonica Nipponbare | 7223, 7392, 7536, 7664 | 389 | 811 |
| LAB518 | pUC19c | RICE *Oryza sativa* L. Japonica Nipponbare | 7224, 7393, 7537, 7665 | 390 | 593 |
| LAB519 | pUC19c | RICE *Oryza sativa* L. Japonica Nipponbare | 7538, 7666 | 391 | 594 |
| LAB521 | pUC19c | RICE *Oryza sativa* L. Japonica Nipponbare | 7225, 7394, 7539, 7667 | 392 | 595 |
| LAB522 | pUC19c | RICE *Oryza sativa* L. Japonica Nipponbare | 7226, 7395, 7540, 7668 | 393 | 596 |
| LAB523 | pUC19c | RICE *Oryza sativa* L. Japonica Nipponbare | 7227, 7396, 7541, 7669 | 394 | 597 |
| LAB524 | pUC19c | RICE *Oryza sativa* L. Japonica Nipponbare | 7228, 7397, 7542, 7670 | 395 | 598 |
| LAB526 | pUC19c | RICE *Oryza sativa* L. Japonica Nipponbare | 7229, 7398, 7543, 7671 | 396 | 599 |
| LAB527 | pUC19c | RICE *Oryza sativa* L. Japonica Nipponbare | 7230, 7399, 7544, 7672 | 397 | 600 |
| LAB529 | pUC19c | RICE *Oryza sativa* L. Japonica Nipponbare | 7231, 7400, 7545, 7673 | 398 | 601 |
| LAB530 | pUC19c | RICE *Oryza sativa* L. Japonica Nipponbare | 7546, 7674 | 399 | 602 |
| LAB531 | pUC19c | RICE *Oryza sativa* L. Japonica Nipponbare | 7232, 7401, 7547, 7675 | 400 | 603 |
| LAB533 | pUC19c | RICE *Oryza sativa* L. Japonica Nipponbare | 7548, 7676 | 401 | 812 |
| LAB534 | pUC19c | RICE *Oryza sativa* L. Japonica Nipponbare | 7233, 7402 | 402 | 605 |
| LAB535 | pUC19c | RICE *Oryza sativa* L. Japonica Nipponbare | 7234, 7403 | 403 | 606 |
| LAB536 | pUC19c | RICE *Oryza sativa* L. Japonica Nipponbare | 7235, 7404, 7235, 7677 | 404 | 813 |
| LAB537 | pUC19c | SORGHUM *Sorghum bicolor* ND | 7236, 7405, 7549, 7678 | 405 | 814 |
| LAB538 | pUC19c | SORGHUM *Sorghum bicolor* ND | 7237, 7406, 7237, 7679 | 406 | 609 |
| LAB539 | pUC19c | SORGHUM *Sorghum bicolor* ND | 7238, 7407, 7550, 7680 | 407 | 610 |
| LAB540 | pUC19c | SORGHUM *Sorghum bicolor* ND | 7239, 7408 | 408 | 611 |
| LAB541 | pUC19c | SORGHUM *Sorghum bicolor* ND | 7240, 7409, 7240, 7681 | 409 | 612 |
| LAB542 | pUC19c | SORGHUM *Sorghum bicolor* ND | 7241, 7410, 7551, 7682 | 410 | 815 |
| LAB543 | pUC19c | SORGHUM *Sorghum bicolor* ND | 7242, 7411 | 411 | 816 |
| LAB544 | pUC19c | SORGHUM *Sorghum bicolor* ND | 7243, 7412, 7552, 7683 | 412 | 615 |
| LAB545 | pUC19c | SORGHUM *Sorghum bicolor* ND | 7244, 7413, 7553, 7684 | 413 | 616 |
| LAB546 | pUC19c | SORGHUM *Sorghum bicolor* ND | 7245, 7414 | 414 | 617 |
| LAB547 | pUC19c | SORGHUM *Sorghum bicolor* ND | 7246, 7415, 7554, 7415 | 415 | 618 |
| LAB548 | pUC19c | SORGHUM *Sorghum bicolor* ND | 7247, 7416, 7555, 7685 | 416 | 619 |
| LAB549 | pUC19c | SORGHUM *Sorghum bicolor* ND | 7556, 7686 | 417 | 817 |
| LAB550 | pUC19c | SORGHUM *Sorghum bicolor* ND | 7248, 7417 | 418 | 818 |
| LAB551 | pUC19c | SORGHUM *Sorghum bicolor* ND | 7249, 7418, 7557, 7687 | 419 | 622 |
| LAB552 | pUC19c | SORGHUM *Sorghum bicolor* ND | 7250, 7419 | 420 | 623 |
| LAB553 | pUC19c | SORGHUM *Sorghum bicolor* ND | 7251, 7420, 7251, 7688 | 421 | 819 |
| LAB554 | pUC19c | SORGHUM *Sorghum bicolor* ND | 7252, 7421, 7558, 7689 | 422 | 820 |
| LAB555 | pUC19c | SORGHUM *Sorghum bicolor* ND | 7253, 7422, 7559, 7690 | 423 | 626 |
| LAB557 | pUC19c | SORGHUM *Sorghum bicolor* ND | 7254, 7423 | 424 | 627 |
| LAB558 | pUC19c | SORGHUM *Sorghum bicolor* ND | 7255, 7424, 7560, 7691 | 425 | 628 |
| LAB559 | pUC19c | SORGHUM *Sorghum bicolor* ND | 7561, 7692 | 426 | 821 |
| LAB561 | Topo B | SORGHUM *Sorghum bicolor* ND | 7256, 7425 | 427 | 822 |
| LAB562 | pUC19c | SORGHUM *Sorghum bicolor* ND | 7257, 7426 | 428 | 631 |
| LAB564 | pUC19c | SORGHUM *Sorghum bicolor* ND | 7258, 7427, 7258, 7693 | 430 | 823 |
| LAB565 | pUC19c | SORGHUM *Sorghum bicolor* ND | 7259, 7428, 7562, 7694 | 431 | 634 |
| LAB566 | pUC19c | SORGHUM *Sorghum bicolor* ND | 7563, 7695 | 432 | 635 |
| LAB567 | pUC19c | SORGHUM *Sorghum bicolor* ND | 7260, 7429, 7260, 7696 | 433 | 824 |
| LAB568 | pUC19c | SORGHUM *Sorghum bicolor* ND | 7261, 7430, 7564, 7697 | 434 | 637 |
| LAB569 | pUC19c | SORGHUM *Sorghum bicolor* ND | 7262, 7431 | 435 | 638 |
| LAB570 | pUC19c | SORGHUM *Sorghum bicolor* ND | 7263, 7432, 7263, 7698 | 436 | 639 |
| LAB571 | pUC19c | SORGHUM *Sorghum bicolor* ND | 7264, 7433 | 437 | 825 |
| LAB572 | pUC19c | SORGHUM *Sorghum bicolor* ND | 7265, 7434 | 438 | 826 |
| LAB573 | pUC19c | SORGHUM *Sorghum bicolor* ND | 7266, 7435 | 439 | 827 |
| LAB575 | pUC19c | SORGHUM *Sorghum bicolor* ND | 7267, 7436, 7565, 7699 | 440 | 828 |
| LAB576 | pUC19c | SORGHUM *Sorghum bicolor* ND | 7268, 7437 | 441 | 644 |
| LAB577 | pUC19c | SORGHUM *Sorghum bicolor* ND | 7269, 7438, 7269, 7700 | 442 | 645 |
| LAB578 | pUC19c | SORGHUM *Sorghum bicolor* ND | 7270, 7439, 7566, 7701 | 443 | 646 |
| LAB581 | pUC19c | SORGHUM *Sorghum bicolor* ND | 7271, 7440, 7567, 7702 | 444 | 647 |
| LAB582 | pUC19c | SORGHUM *Sorghum bicolor* ND | 7272, 7441, 7568, 7703 | 445 | 829 |
| LAB584 | pUC19c | SORGHUM *Sorghum bicolor* ND | 7273, 7442, 7569, 7704 | 446 | 649 |

TABLE 72-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LAB585 | pUC19c | SORGHUM Sorghum bicolor ND | 7274, 7443 | 447 | 650 |
| LAB586 | pUC19c | SORGHUM Sorghum bicolor ND | 7275, 7444 | 448 | 651 |
| LAB587 | pUC19c | SORGHUM Sorghum bicolor ND | 7276, 7445, 7276, 7705 | 449 | 652 |
| LAB588 | Topo B | SORGHUM Sorghum bicolor ND | 7277, 7446, 7277, 7706 | 450 | 653 |
| LAB589 | pUC19d | SORGHUM Sorghum bicolor ND | 7278, 7447 | 451 | 654 |
| LAB590 | pUC19c | SORGHUM Sorghum bicolor ND | 7279, 7448, 7279, 7707 | 452 | 655 |
| LAB591 | pUC19c | SORGHUM Sorghum bicolor ND | 7280, 7449, 7570, 7708 | 453 | 656 |
| LAB592 | pUC19c | SORGHUM Sorghum bicolor ND | 7281, 7450, 7571, 7709 | 454 | 830 |
| LAB593 | pUC19c | SORGHUM Sorghum bicolor ND | 7282, 7451 | 455 | 831 |
| LAB594 | pUC19c_LAB594_F1 | SORGHUM Sorghum bicolor ND | 7283, 7452, 7283, 7710 | 456 | 659 |
| LAB594 | pUC19c_LAB594_F1 | SORGHUM Sorghum bicolor ND | 7284, 7453, 7284, 7453 | 456 | 659 |
| LAB594 | pUC19c | SORGHUM Sorghum bicolor ND | 7285, 7454, 7285, 7454 | 456 | 659 |
| LAB595 | pUC19c | SORGHUM Sorghum bicolor ND | 7286, 7455 | 457 | 832 |
| LAB596 | pUC19c | SORGHUM Sorghum bicolor ND | 7287, 7456 | 458 | 661 |
| LAB597 | pUC19c | SORGHUM Sorghum bicolor ND | 7288, 7457 | 459 | 833 |
| LAB598 | pUC19c | SUNFLOWER Helianthus annuus ND | 7289, 7458, 7289, 7711 | 460 | 733 |
| LAB600 | pUC19c | SUNFLOWER Helianthus annuus ND | 7290, 7459, 7572, 7712 | 461 | 665 |
| LAB601 | pUC19c | SUNFLOWER Helianthus annuus ND | 7291, 7460 | 462 | 834 |
| LAB602 | pUC19c | SUNFLOWER Helianthus annuus ND | 7292, 7461, 7292, 7713 | 463 | 667 |
| LAB603 | Topo B | TOMATO Lycopersicum esculentum MD | 7293, 7462, 7293, 7714 | 464 | 668 |
| LAB604 | pUC19c | COTTON Gossypium barbadense Pima | 7573, 7715 | 465 | 669 |
| LAB605 | pUC19c | BARLEY Hordeum vulgare L. Manit | 7294, 7463, 7294, 7716 | 466 | 670 |
| LAB607 | pUC19c | RICE Oryza sativa L. Japonica Nipponbare | 7295, 7464, 7574, 7717 | 467 | 671 |
| LAB608 | pUC19c | SORGHUM Sorghum bicolor ND | 7575, 7718 | 468 | 672 |
| LAB609 | pUC19c | MAIZE Zea mays L. ND | 7296, 7465 | 469 | 673 |
| LAB610 | pUC19c | SORGHUM Sorghum bicolor ND | 7297, 7466, 7576, 7719 | 470 | 674 |
| LAB611 | pUC19c | SORGHUM Sorghum bicolor ND | 7298, 7467 | 471 | 675 |
| LAB612 | pUC19c | COTTON Gossypium barbadense Pima | 7299, 7468, 7577, 7468 | 472 | 835 |

Table 72.
"Polyn."—Polynucleotide;
"Polyp."—polypeptide.
For cloning of each gene at least 2 primers were used: Forward (Fwd) or Reverse (Rev).
In some cases, 4 primers were used: External forward (EF), External reverse (ER), nested forward (NF) or nested reverse (NR).
The sequences of the primers used for cloning the genes are provided in the sequence listing.

Example 15

Transforming Agrobacterium Tumefaciens Cells with Binary Vectors Harboring The Polynucleotides of The Invention Each of the binary vectors described in Example 15 above were used to transform Agrobacterium cells. Two additional binary constructs, having only the At6669 promoter or no additional promoter are used as negative controls.

The binary vectors were introduced to Agrobacterium tumefaciens GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for Agrobacterium strains GV301) or streptomycin (300 mg/L; for Agrobacterium strain LB4404) and kanamycin (50 mg/L) at 28° C. for 48 hours. Abrobacterium colonies, which were developed on the selective media, were further analyzed by PCR using the primers designed to span the inserted sequence in the pPI plasmid. The resulting PCR products were isolated and sequenced to verify that the correct polynucleotide sequences of some embodiments of the invention were properly introduced to the Agrobacterium cells.

Example 16

Transformation of Arabidopsis Thaliana Plants with the Polynucleotides of Some Embodiments of the Invention Arabidopsis thaliana Columbia plants ($T_0$ plants) were transformed using the Floral Dip procedure described by Clough and Bent, 1998 (Floral dip: a simplified method for Agrobacterium-mediated transformation of Arabidopsis thaliana. Plant J 16:735-43) and by Desfeux et al., 2000 (Female Reproductive Tissues Are the Primary Target of Agrobacterium-Mediated Transformation by the Arabidopsis Floral-Dip Method. Plant Physiol, July 2000, Vol. 123, pp. 895-904), with minor modifications. Briefly, $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The T0 plants were ready for transformation six days before anthesis.

Single colonies of Agrobacterium carrying the binary constructs were generated as described in Example 16 above. Colonies were cultured in LB medium supplemented with kanamycin (50 mg/L) and gentamycin (50 mg/L). The cultures were incubated at 28° C. for 48 hours under vigorous shaking and then centrifuged at 4000 rpm for 5 minutes. The pellets comprising the Agrobacterium cells were re-suspended in a transformation medium containing half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension, such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours, to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry. Seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochloride and 0.05% triton for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 17

Evaluating Transgenic *Arabidopsis* Plant Growth Under Abiotic Stress as Well as Under Favorable Conditions in Tissue Culture Assay Assay 1: plant growth under osmotic stress [poly (ethylene glycol) (PEG)] in tissue culture conditions—One of the consequences of drought is the induction of osmotic stress in the area surrounding the roots; therefore, in many scientific studies, PEG (e.g., 2.2% PEG) is used to simulate the osmotic stress conditions resembling the high osmolarity found during drought stress.

Assay 2: plant growth under high salinity conditions (NaCl) in tissue culture conditions—High salinity is an abiotic stress that challenges the root systems of plants. Thus, an assay in which plants are grown under high salinity (110-120 mM NaCl) was conducted and plant performance in terms of shoot and root growth was evaluated.

Description of Experiment for Assays 1 and 2:

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing either 2.2% PEG: 0.5 MS media (assay 1), 110-120 mM NaCl: 0.5 MS media (assay 2), or Normal growth conditions (0.5 MS media). Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F).

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and to processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XXI (RGR leaf area, described below), XIX (RGR root coverage, described above) and XXII (RGR root length, described below).

Relative growth rate of leaf area=Regression coefficient of leaf area along time course. Formula XXI Relative growth rate of root length=Regression coefficient of root length along time course. Formula XXII At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length between each couple of sequential photographs, and results were used to resolve the effect of the gene introduced on plant vigor, under osmotic stress, as well as under optimal conditions. Similarly, the effect of the gene introduced on biomass accumulation, under osmotic stress as well as under optimal conditions was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results are considered significant if p≤0.1. The JMP statistics software package was used (Version 5.2.1, SAS Institute Inc., Cary, N.C., USA).

Experimental Results:

The genes presented in Tables 73-78 showed a significant improvement in plant ABST since they produced larger plant biomass (plant fresh and dry weight and leaf area) in T2 generation (Tables 73-76) or T1 generation (Tables 77-78) when grown under osmotic stress conditions (assay 1) or high salinity conditions (assay 2), compared to control plants. The genes were cloned under the regulation of a constitutive promoter (At6669; SEQ ID NO:7724). The evaluation of each gene was carried out by testing the performance of different number of events. Some of the genes were evaluated in more than one tissue culture assay. The results obtained in these second experiments were significantly positive as well.

TABLE 73

Genes showing improved plant performance under osmotic stress conditions - assay 1 (T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| LAB607 | 65335.1 | 63 | 0.05 | 34 | LAB607 | 65335.1 | 3.9 | 0.1 | 23 |
| LAB607 | 65336.1 | 62.8 | 0.01 | 34 | LAB607 | 65336.1 | 3.9 | 0.18 | 23 |
| LAB600 | 65717.5 | 63.9 | 0.16 | 36 | LAB600 | 65717.5 | 3.8 | 0.26 | 20 |
| LAB600 | 65718.2 | 85 | 0.03 | 81 | LAB600 | 65718.2 | 5 | 0.02 | 59 |
| LAB600 | 65719.3 | 82.2 | L | 75 | LAB600 | 65719.3 | 6 | 0.01 | 90 |
| LAB542 | 65888.2 | 73.5 | 0.02 | 56 | LAB542 | 65888.2 | 5 | L | 57 |
| LAB536 | 65148.1 | 75.1 | 0.03 | 60 | LAB536 | 65148.1 | 4.7 | L | 48 |
| LAB536 | 65151.1 | — | — | — | LAB536 | 65151.1 | 4.2 | 0.22 | 32 |
| LAB501 | 65966.3 | 81.2 | L | 73 | LAB501 | 65966.3 | 4.8 | 0.05 | 53 |
| LAB501 | 65970.2 | 59.7 | 0.15 | 27 | LAB501 | 65970.2 | — | — | — |
| LAB490 | 65868.5 | 94.3 | 0.1 | 101 | LAB490 | 65868.5 | 4.5 | 0.03 | 42 |
| CONT. | — | 47 | — | — | CONT. | — | 3.2 | — | — |
| LAB602 | 65829.4 | 79.7 | 0.11 | 71 | LAB602 | 65829.4 | 5.1 | 0.25 | 40 |
| LAB592 | 65816.1 | 63.6 | 0.28 | 37 | LAB592 | 65816.1 | — | — | — |
| LAB592 | 65817.1 | 58.4 | 0.16 | 26 | LAB592 | 65817.1 | — | — | — |
| LAB486 | 65855.3 | 58.7 | 0.06 | 26 | LAB486 | 65855.3 | — | — | — |
| LAB431 | 65944.3 | 60.1 | 0.29 | 29 | LAB431 | 65944.3 | — | — | — |
| LAB431 | 65944.6 | 68.1 | 0.23 | 46 | LAB431 | 65944.6 | 4.7 | 0.3 | 30 |
| CONT. | — | 46.5 | — | — | CONT. | — | 3.6 | — | — |
| LAB612 | 66278.4 | 149.6 | 0.2 | 44 | LAB612 | 66278.4 | 7.8 | 0.25 | 32 |
| LAB602 | 65828.1 | 217 | 0.02 | 109 | LAB602 | 65828.1 | 12 | 0.04 | 103 |
| LAB602 | 65828.2 | — | — | — | LAB602 | 65828.2 | 8.4 | 0.14 | 43 |
| LAB598 | 66081.2 | 166.1 | 0.15 | 60 | LAB598 | 66081.2 | 9.2 | 0.16 | 56 |
| LAB592 | 65819.3 | 144.5 | 0.01 | 39 | LAB592 | 65819.3 | 8 | 0.04 | 35 |
| LAB592 | 65820.1 | 159 | L | 53 | LAB592 | 65820.1 | 8.8 | L | 50 |
| LAB543 | 65895.1 | 165 | 0.19 | 59 | LAB543 | 65895.1 | 9 | 0.21 | 53 |
| LAB543 | 65897.2 | 157.8 | 0.01 | 52 | LAB543 | 65897.2 | 9.1 | L | 54 |
| LAB543 | 65898.1 | 152.2 | 0.07 | 46 | LAB543 | 65898.1 | 8.4 | 0.2 | 42 |
| LAB486 | 65855.1 | 205.1 | 0.05 | 97 | LAB486 | 65855.1 | 11.4 | 0.09 | 94 |
| LAB486 | 65855.3 | 173.1 | 0.1 | 67 | LAB486 | 65855.3 | 9.5 | 0.19 | 62 |
| LAB463 | 65989.2 | 190.9 | L | 84 | LAB463 | 65989.2 | 10.1 | L | 72 |
| LAB431 | 65944.3 | 193.5 | 0.01 | 86 | LAB431 | 65944.3 | 10.4 | 0.01 | 77 |
| LAB431 | 65944.6 | 233 | 0.04 | 124 | LAB431 | 65944.6 | 12.6 | 0.09 | 114 |
| LAB398 | 65912.6 | 155.3 | L | 49 | LAB398 | 65912.6 | 10.2 | L | 74 |
| LAB398 | 65913.3 | 134 | 0.25 | 29 | LAB398 | 65913.3 | — | — | — |
| LAB398 | 65914.2 | 175.1 | 0.09 | 68 | LAB398 | 65914.2 | 10.5 | 0.06 | 78 |
| CONT. | — | 104 | — | — | CONT. | — | 5.9 | — | — |
| LAB591 | 65627.1 | 159.9 | L | 57 | LAB591 | 65627.1 | 10.1 | L | 51 |
| LAB582 | 66267.1 | 242.2 | L | 137 | LAB582 | 66267.1 | 15.9 | L | 137 |
| LAB582 | 66268.2 | 160.5 | 0.22 | 57 | LAB582 | 66268.2 | 10.6 | 0.22 | 57 |
| LAB551 | 65813.5 | — | — | — | LAB551 | 65813.5 | 11.2 | 0.29 | 66 |
| LAB499 | 66044.1 | 181.9 | 0.02 | 78 | LAB499 | 66044.1 | 12.2 | 0.04 | 82 |
| LAB499 | 66047.1 | 145.8 | 0.15 | 43 | LAB499 | 66047.1 | 8.9 | 0.11 | 33 |
| LAB499 | 66048.1 | 179.2 | 0.04 | 76 | LAB499 | 66048.1 | 11 | 0.04 | 65 |
| LAB491 | 65858.3 | 154.4 | 0.23 | 51 | LAB491 | 65858.3 | 9.9 | 0.12 | 48 |
| LAB491 | 65859.1 | 303.7 | 0.13 | 198 | LAB491 | 65859.1 | 19.3 | 0.12 | 188 |
| LAB491 | 65859.5 | 226.2 | 0.14 | 122 | LAB491 | 65859.5 | 14.4 | 0.11 | 115 |
| LAB491 | 65861.2 | 226.2 | L | 122 | LAB491 | 65861.2 | 14.7 | L | 119 |
| LAB481 | 66200.3 | 190.7 | L | 87 | LAB481 | 66200.3 | 12.3 | L | 84 |
| LAB481 | 66202.2 | 156.9 | 0.11 | 54 | LAB481 | 66202.2 | 10.1 | 0.05 | 50 |
| LAB408 | 65930.2 | 132.4 | 0.3 | 30 | LAB408 | 65930.2 | 7.9 | 0.26 | 18 |
| LAB408 | 65930.4 | 144.1 | 0.23 | 41 | LAB408 | 65930.4 | — | — | — |
| LAB408 | 65933.2 | 200.2 | 0.06 | 96 | LAB408 | 65933.2 | 11.9 | 0.13 | 78 |
| CONT. | — | 102.1 | — | — | CONT. | — | 6.7 | — | — |

"CONT."—Control;
"Ave."—Average;
"% Incr." = % increment;
"p-val."—p-value;
"L"—p < 0.01.

TABLE 74

Genes showing improved plant performance under high salinity conditions - assay 2 (T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| LAB561 | 66632.3 | 194.5 | 0.05 | 33 | LAB561 | 66632.3 | 9.4 | 0.13 | 26 |
| LAB500 | 66485.2 | 231.5 | L | 59 | LAB500 | 66485.2 | 9.9 | 0.04 | 34 |
| LAB397 | 66356.2 | 206.3 | 0.03 | 41 | LAB397 | 66356.2 | 10.4 | 0.02 | 41 |
| CONT. | — | 146 | — | — | CONT. | — | 7.4 | — | — |
| LAB608 | 65907.2 | 171.8 | 0.09 | 20 | LAB608 | 65907.2 | 8.7 | 0.05 | 21 |
| LAB578 | 65581.2 | 181.7 | 0.17 | 27 | LAB578 | 65581.2 | 9.4 | 0.18 | 32 |
| LAB523 | 65661.2 | 174.2 | 0.23 | 22 | LAB523 | 65661.2 | — | — | — |
| LAB512 | 66739.4 | 200.6 | 0.03 | 40 | LAB512 | 66739.4 | 10.7 | 0.03 | 49 |
| LAB449 | 65098.5 | 171.3 | 0.17 | 20 | LAB449 | 65098.5 | 8.2 | 0.28 | 15 |
| LAB428 | 65079.2 | — | — | — | LAB428 | 65079.2 | 8.6 | 0.27 | 20 |
| CONT. | — | 143.3 | — | — | CONT. | — | 7.2 | — | — |
| LAB472 | 66719.3 | — | — | — | LAB472 | 66719.3 | 7.3 | 0.19 | 18 |
| LAB470 | 66627.3 | 158.1 | 0.07 | 21 | LAB470 | 66627.3 | 7.7 | 0.08 | 24 |
| LAB470 | 66630.1 | 173.6 | 0.06 | 33 | LAB470 | 66630.1 | 8.6 | 0.04 | 39 |
| LAB470 | 66630.4 | 206.4 | L | 58 | LAB470 | 66630.4 | 10.6 | L | 72 |
| LAB466 | 66621.2 | 197.3 | 0.01 | 51 | LAB466 | 66621.2 | 8.2 | 0.1 | 33 |
| LAB466 | 66622.4 | 166.8 | 0.15 | 27 | LAB466 | 66622.4 | 8.1 | 0.13 | 31 |
| LAB466 | 66622.5 | 157.7 | 0.05 | 20 | LAB466 | 66622.5 | 7.5 | 0.28 | 21 |
| LAB462 | 66615.11 | 155 | 0.14 | 18 | LAB462 | 66615.11 | 7.5 | 0.23 | 21 |
| LAB462 | 66617.1 | 173.5 | 0.05 | 33 | LAB462 | 66617.1 | 8 | 0.08 | 30 |
| LAB462 | 66618.2 | 150.9 | 0.25 | 15 | LAB462 | 66618.2 | — | — | — |
| LAB454 | 66813.4 | 166.5 | 0.14 | 27 | LAB454 | 66813.4 | 8 | 0.07 | 29 |
| LAB412 | 66698.2 | 222.4 | 0.02 | 70 | LAB412 | 66698.2 | 10.3 | L | 66 |
| LAB412 | 66699.2 | 177.8 | 0.1 | 36 | LAB412 | 66699.2 | 8.4 | 0.11 | 36 |
| LAB404 | 66779.1 | 170.3 | 0.02 | 30 | LAB404 | 66779.1 | — | — | — |
| LAB403 | 66802.6 | 177.9 | 0.12 | 36 | LAB403 | 66802.6 | 9.1 | 0.15 | 47 |
| LAB403 | 66804.5 | 187 | 0.08 | 43 | LAB403 | 66804.5 | 10.2 | L | 65 |
| CONT. | — | 130.9 | — | — | CONT. | — | 6.2 | — | — |
| LAB516 | 65870.2 | 158.8 | 0.05 | 35 | LAB516 | 65870.2 | 8 | 0.05 | 39 |
| LAB511 | 66258.4 | 145.6 | 0.19 | 23 | LAB511 | 66258.4 | — | — | — |
| LAB475 | 67390.2 | 140 | 0.21 | 19 | LAB475 | 67390.2 | — | — | — |
| LAB471 | 66192.1 | 155.8 | 0.08 | 32 | LAB471 | 66192.1 | 6.7 | 0.29 | 18 |
| LAB457 | 65100.1 | 169.8 | 0.02 | 44 | LAB457 | 65100.1 | 8.3 | 0.1 | 46 |
| LAB457 | 65100.2 | — | — | — | LAB457 | 65100.2 | 7.3 | 0.29 | 28 |
| CONT. | — | 118.1 | — | — | CONT. | — | 5.7 | — | — |
| LAB586 | 65587.2 | 200.7 | 0.17 | 18 | LAB586 | 65587.2 | 11.6 | 0.21 | 19 |
| LAB537 | 66330.6 | 192.1 | 0.19 | 13 | LAB537 | 66330.6 | — | — | — |
| LAB493 | 66476.2 | 207.6 | 0.12 | 22 | LAB493 | 66476.2 | — | — | — |
| LAB479 | 66346.2 | 201.2 | 0.07 | 18 | LAB479 | 66346.2 | 11.2 | 0.18 | 14 |
| LAB478 | 66311.1 | 201.5 | 0.13 | 18 | LAB478 | 66311.1 | — | — | — |
| LAB397 | 66360.6 | 205.4 | 0.02 | 21 | LAB397 | 66360.6 | 10.8 | 0.17 | 10 |
| CONT. | — | 170.2 | — | — | CONT. | — | 9.8 | — | — |
| LAB559 | 66789.3 | 199.6 | 0.1 | 29 | LAB559 | 66789.3 | 11.7 | 0.02 | 47 |
| LAB489 | 66725.1 | — | — | — | LAB489 | 66725.1 | 10.4 | 0.16 | 31 |
| LAB480 | 66252.3 | 220.2 | 0.1 | 43 | LAB480 | 66252.3 | 10.9 | 0.01 | 38 |
| LAB408 | 65930.2 | 185.5 | 0.2 | 20 | LAB408 | 65930.2 | 9.6 | 0.22 | 21 |
| LAB408 | 65933.2 | — | — | — | LAB408 | 65933.2 | 10.4 | 0.15 | 31 |
| LAB407 | 66244.2 | 186.4 | 0.2 | 21 | LAB407 | 66244.2 | 10.1 | 0.06 | 28 |
| CONT. | — | 154.3 | — | — | CONT. | — | 7.9 | — | — |
| LAB582 | 66267.1 | 244 | 0.18 | 25 | LAB582 | 66267.1 | 12.3 | 0.19 | 32 |
| LAB551 | 65811.5 | 279.3 | 0.03 | 43 | LAB551 | 65811.5 | 12.8 | 0.14 | 36 |
| LAB551 | 65813.2 | 246.1 | 0.29 | 26 | LAB551 | 65813.2 | — | — | — |
| LAB499 | 66048.4 | 268.3 | 0.25 | 38 | LAB499 | 66048.4 | — | — | — |
| LAB491 | 65859.2 | 233 | 0.28 | 19 | LAB491 | 65859.2 | — | — | — |
| LAB491 | 65861.3 | 259.5 | 0.19 | 33 | LAB491 | 65861.3 | 12.6 | 0.22 | 34 |
| CONT. | — | 195.1 | — | — | CONT. | — | 9.4 | — | — |
| LAB604 | 66495.4 | 141.2 | 0.27 | 19 | LAB604 | 66495.4 | — | — | — |
| LAB575 | 66782.5 | 139.1 | 0.13 | 17 | LAB575 | 66782.5 | 7.6 | 0.05 | 34 |
| LAB575 | 66783.4 | 140.4 | 0.14 | 18 | LAB575 | 66783.4 | 8.2 | 0.05 | 44 |
| LAB575 | 66784.6 | 149.7 | 0.08 | 26 | LAB575 | 66784.6 | 7 | 0.17 | 24 |
| LAB446 | 65090.3 | 164.7 | 0.07 | 39 | LAB446 | 65090.3 | 7.6 | 0.12 | 35 |
| LAB446 | 65091.3 | — | — | — | LAB446 | 65091.3 | 7.3 | 0.22 | 29 |
| LAB439 | 65950.1 | 139.3 | 0.15 | 17 | LAB439 | 65950.1 | 7.1 | 0.07 | 25 |
| LAB439 | 65950.2 | 165.2 | 0.07 | 39 | LAB439 | 65950.2 | 8.8 | 0.07 | 56 |
| LAB427 | 65539.3 | 157.5 | 0.08 | 33 | LAB427 | 65539.3 | 8 | 0.03 | 42 |
| LAB427 | 65544.1 | 147.9 | 0.26 | 25 | LAB427 | 65544.1 | 7.7 | 0.21 | 36 |
| LAB418 | 66825.1 | 137.8 | 0.16 | 16 | LAB418 | 66825.1 | 7.1 | 0.07 | 26 |
| LAB396 | 65924.1 | 140.4 | 0.27 | 18 | LAB396 | 65924.1 | — | — | — |
| LAB396 | 65926.1 | 171.8 | 0.01 | 45 | LAB396 | 65926.1 | 8.6 | L | 51 |
| LAB396 | 65927.4 | 155 | 0.1 | 31 | LAB396 | 65927.4 | 7.3 | 0.1 | 29 |

TABLE 74-continued

Genes showing improved plant performance under high salinity conditions - assay 2 (T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| CONT. | — | 118.7 | — | — | CONT. | — | 5.7 | — | — |
| LAB603 | 66490.2 | — | — | — | LAB603 | 66490.2 | 7.3 | 0.21 | 26 |
| LAB587 | 66639.4 | 163.3 | 0.11 | 30 | LAB587 | 66639.4 | 7.8 | 0.15 | 34 |
| LAB561 | 66632.3 | 153.3 | 0.1 | 22 | LAB561 | 66632.3 | 7.2 | 0.15 | 24 |
| LAB561 | 66633.2 | 159.8 | 0.08 | 27 | LAB561 | 66633.2 | 7.6 | 0.08 | 29 |
| LAB561 | 66633.3 | 150.5 | 0.21 | 19 | LAB561 | 66633.3 | 7.8 | 0.15 | 33 |
| LAB559 | 66789.3 | — | — | — | LAB559 | 66789.3 | 7.2 | 0.12 | 22 |
| LAB500 | 66482.8 | — | — | — | LAB500 | 66482.8 | 7.5 | 0.27 | 28 |
| LAB489 | 66723.1 | 148.9 | 0.04 | 18 | LAB489 | 66723.1 | 7.8 | 0.1 | 33 |
| LAB394 | 66565.1 | 156.8 | 0.01 | 24 | LAB394 | 66565.1 | 8.2 | 0.01 | 41 |
| CONT. | — | 126.1 | — | — | CONT. | — | 5.8 | — | — |
| LAB611 | 65997.9 | — | — | — | LAB611 | 65997.9 | 6.1 | 0.11 | 52 |
| LAB563 | 67029.3 | — | — | — | LAB563 | 67029.3 | 4.9 | 0.21 | 22 |
| LAB563 | 67029.4 | 110.8 | 0.02 | 38 | LAB563 | 67029.4 | 5.8 | L | 44 |
| LAB563 | 67032.4 | 102 | 0.27 | 27 | LAB563 | 67032.4 | — | — | — |
| LAB485 | 67023.1 | 102.8 | 0.08 | 28 | LAB485 | 67023.1 | 5.7 | 0.04 | 42 |
| LAB485 | 67024.2 | 108.8 | 0.04 | 35 | LAB485 | 67024.2 | 5.7 | 0.08 | 42 |
| LAB473 | 66873.3 | 102.2 | 0.23 | 27 | LAB473 | 66873.3 | 5.4 | 0.12 | 34 |
| LAB433 | 67038.5 | 103 | 0.19 | 28 | LAB433 | 67038.5 | 5.8 | 0.05 | 44 |
| LAB400 | 65510.1 | 109.4 | 0.11 | 36 | LAB400 | 65510.1 | 5.2 | 0.09 | 29 |
| LAB400 | 65511.2 | 108.1 | 0.14 | 34 | LAB400 | 65511.2 | 5.4 | 0.05 | 34 |
| LAB393 | 66285.4 | 114.1 | 0.13 | 42 | LAB393 | 66285.4 | — | — | — |
| LAB393 | 66286.1 | — | — | — | LAB393 | 66286.1 | 5 | 0.05 | 24 |
| LAB393 | 66288.2 | 99.8 | 0.22 | 24 | LAB393 | 66288.2 | 5 | 0.13 | 24 |
| LAB390 | 67016.3 | 110.2 | 0.02 | 37 | LAB390 | 67016.2 | 6.2 | L | 54 |
| LAB390 | 67017.2 | 101.1 | 0.1 | 26 | LAB390 | 67017.2 | 5.6 | 0.04 | 39 |
| LAB390 | 67017.4 | 117.2 | L | 46 | LAB390 | 67017.4 | 5.6 | L | 40 |
| LAB390 | 67020.1 | 94.1 | 0.12 | 17 | LAB390 | 67020.1 | 4.9 | 0.07 | 20 |
| LAB390 | 67020.3 | 101 | 0.02 | 25 | LAB390 | 67020.3 | 5 | 0.03 | 25 |
| CONT. | — | 80.5 | — | — | CONT. | — | 4 | — | — |
| LAB610 | 65342.3 | 145.7 | 0.1 | 21 | LAB610 | 65342.3 | 7.2 | 0.15 | 20 |
| LAB595 | 65270.2 | 186.6 | L | 55 | LAB595 | 65270.2 | 8.5 | L | 41 |
| LAB595 | 65273.3 | 150.2 | 0.14 | 25 | LAB595 | 65273.3 | — | — | — |
| LAB562 | 65614.4 | 151.9 | 0.26 | 26 | LAB562 | 65614.4 | 7.8 | 0.2 | 30 |
| LAB423 | 65528.3 | 139.7 | 0.2 | 16 | LAB423 | 65528.3 | 6.8 | 0.23 | 13 |
| CONT. | — | 120.6 | — | — | CONT. | — | 6 | — | — |
| LAB524 | 65135.1 | 173.4 | 0.14 | 37 | LAB524 | 65135.1 | 9.4 | 0.1 | 37 |
| LAB512 | 66735.2 | 158.8 | 0.07 | 25 | LAB512 | 66735.2 | 8.7 | 0.09 | 27 |
| LAB473 | 66873.1 | 154.2 | 0.19 | 22 | LAB473 | 66873.1 | 8.2 | 0.21 | 20 |
| LAB433 | 67036.3 | 146.9 | 0.25 | 16 | LAB433 | 67036.3 | 8 | 0.17 | 17 |
| CONT. | — | 126.6 | — | — | CONT. | — | 6.8 | — | — |
| LAB593 | 66341.1 | 181.6 | 0.1 | 22 | LAB593 | 66341.1 | 9.5 | 0.09 | 35 |
| LAB575 | 66784.6 | 168.2 | 0.28 | 13 | LAB575 | 66784.6 | 8.5 | 0.21 | 19 |
| LAB508 | 66730.5 | 176.1 | 0.08 | 18 | LAB508 | 66730.5 | 8.6 | 0.04 | 20 |
| LAB508 | 66733.4 | — | — | — | LAB508 | 66733.4 | 8.1 | 0.21 | 15 |
| LAB507 | 66798.1 | 166 | 0.25 | 11 | LAB507 | 66798.1 | 8.4 | 0.07 | 19 |
| LAB476 | 66306.6 | 193 | 0.17 | 30 | LAB476 | 66306.6 | 9.2 | 0.17 | 29 |
| LAB476 | 66307.2 | 187.7 | 0.01 | 26 | LAB476 | 66307.2 | 9.5 | 0.08 | 34 |
| LAB424 | 66713.2 | 172.4 | 0.02 | 16 | LAB424 | 66713.2 | — | — | — |
| LAB422 | 65936.2 | 199.3 | 0.05 | 34 | LAB422 | 65936.2 | 8.9 | 0.12 | 26 |
| LAB422 | 65938.3 | 174 | 0.15 | 17 | LAB422 | 65938.3 | 8.6 | 0.03 | 21 |
| LAB418 | 66825.1 | 190.8 | 0.15 | 28 | LAB418 | 66825.1 | — | — | — |
| LAB412 | 66699.2 | 195.3 | L | 31 | LAB412 | 66699.2 | 9.1 | 0.03 | 27 |
| LAB412 | 66701.2 | 158.8 | 0.12 | 7 | LAB412 | 66701.2 | — | — | — |
| CONT. | — | 148.9 | — | — | CONT. | — | 7.1 | — | — |
| LAB607 | 65335.2 | 110.9 | 0.08 | 27 | LAB607 | 65335.2 | 5.5 | 0.02 | 41 |
| LAB607 | 65335.3 | 116.3 | 0.04 | 33 | LAB607 | 65335.3 | 5.6 | 0.02 | 45 |
| LAB600 | 65718.2 | 116.4 | 0.04 | 33 | LAB600 | 65718.2 | 6.2 | L | 62 |
| LAB600 | 65719.3 | 106.6 | 0.24 | 22 | LAB600 | 65719.3 | 5.2 | 0.15 | 34 |
| LAB542 | 65888.3 | — | — | — | LAB542 | 65888.3 | 5.5 | 0.14 | 42 |
| LAB542 | 65888.6 | — | — | — | LAB542 | 65888.6 | 4.8 | 0.21 | 23 |
| LAB542 | 65889.2 | — | — | — | LAB542 | 65889.2 | 4.5 | 0.27 | 17 |
| LAB542 | 65892.6 | 110.2 | L | 26 | LAB542 | 65892.6 | 5.1 | 0.12 | 32 |
| LAB536 | 65148.1 | — | — | — | LAB536 | 65148.1 | 4.8 | 0.12 | 23 |
| LAB501 | 65968.3 | 99.6 | 0.26 | 14 | LAB501 | 65968.3 | 5.4 | 0.1 | 40 |
| LAB501 | 65969.1 | — | — | — | LAB501 | 65969.1 | 4.7 | 0.19 | 22 |
| LAB501 | 65970.1 | 130.1 | 0.13 | 49 | LAB501 | 65970.1 | 7.5 | 0.02 | 94 |
| LAB501 | 65970.2 | 100 | 0.16 | 14 | LAB501 | 65970.2 | 5.3 | 0.03 | 38 |
| LAB490 | 65867.3 | 105.1 | 0.14 | 20 | LAB490 | 65867.3 | 5.6 | 0.08 | 46 |
| LAB490 | 65868.2 | 102.9 | 0.18 | 18 | LAB490 | 65868.2 | 5.5 | 0.15 | 44 |

TABLE 74-continued

Genes showing improved plant performance under high salinity conditions - assay 2 (T2 generation)

| Gene Name | Event # | Fresh Weight [mg] Ave. | P-Val. | % Incr. | Gene Name | Event # | Dry Weight [mg] Ave. | P-Val. | % Incr. |
|---|---|---|---|---|---|---|---|---|---|
| LAB490 | 65868.5 | — | — | — | LAB490 | 65868.5 | 5.7 | 0.01 | 48 |
| LAB482 | 66830.1 | — | — | — | LAB482 | 66830.1 | 5.4 | 0.04 | 40 |
| LAB482 | 66832.1 | — | — | — | LAB482 | 66832.1 | 4.8 | 0.13 | 24 |
| LAB482 | 66834.2 | 106.6 | 0.04 | 22 | LAB482 | 66834.2 | 5.4 | 0.01 | 39 |
| LAB451 | 66704.5 | 121.6 | 0.11 | 39 | LAB451 | 66704.5 | 6.4 | 0.01 | 65 |
| LAB445 | 66464.3 | 103.2 | 0.16 | 18 | LAB445 | 66464.3 | 5.3 | 0.03 | 37 |
| LAB445 | 66468.1 | — | — | — | LAB445 | 66468.1 | 5.1 | 0.12 | 31 |
| CONT. | — | 87.4 | — | — | CONT. | — | 3.9 | — | — |
| LAB445 | 66464.3 | 197 | 0.02 | 26 | LAB445 | 66464.3 | 9.6 | 0.01 | 27 |
| LAB445 | 66468.1 | 184.6 | 0.17 | 18 | LAB445 | 66468.1 | 9.4 | 0.11 | 24 |
| CONT. | — | 156.9 | — | — | CONT. | — | 7.6 | — | — |

"CONT."—Control;
"Ave."—Average;
"% Incr." = % increment;
"p-val."—p-value;
"L"—p < 0.01.

TABLE 75

Genes showing improved plant performance under osmotic stress conditions - assay 1 (T2 generation)

| Gene Name | Event # | Leaf Area [cm$^2$] Ave. | P-Val. | % Incr. |
|---|---|---|---|---|
| LAB607 | 65336.1 | 0.3 | 0.07 | 23 |
| LAB600 | 65718.2 | 0.4 | 0.09 | 34 |
| LAB600 | 65719.3 | 0.4 | L | 47 |
| LAB542 | 65888.2 | 0.4 | 0.04 | 41 |
| LAB536 | 65148.1 | 0.4 | 0.03 | 36 |
| LAB501 | 65966.3 | 0.4 | L | 48 |
| LAB490 | 65868.5 | 0.4 | 0.02 | 33 |
| CONT. | — | 0.3 | — | — |
| LAB602 | 65829.4 | 0.4 | 0.09 | 49 |
| LAB486 | 65855.3 | 0.3 | 0.22 | 23 |
| CONT. | — | 0.3 | — | — |
| LAB602 | 65828.1 | 0.8 | 0.03 | 68 |
| LAB602 | 65828.2 | 0.6 | 0.25 | 28 |
| LAB598 | 66081.2 | 0.7 | 0.23 | 38 |
| LAB592 | 65819.3 | 0.6 | 0.07 | 30 |
| LAB592 | 65820.1 | 0.6 | 0.07 | 27 |
| LAB543 | 65895.1 | 0.6 | 0.21 | 31 |
| LAB543 | 65897.2 | 0.7 | 0.02 | 40 |
| LAB543 | 65898.1 | 0.6 | 0.13 | 34 |
| LAB486 | 65855.1 | 0.7 | 0.09 | 52 |
| LAB486 | 65855.3 | 0.7 | 0.07 | 51 |
| LAB463 | 65989.2 | 0.8 | L | 62 |
| LAB431 | 65944.3 | 0.8 | L | 72 |
| LAB431 | 65944.6 | 0.9 | 0.07 | 78 |
| LAB398 | 65912.6 | 0.6 | 0.06 | 29 |
| LAB398 | 65914.2 | 0.7 | 0.07 | 49 |
| CONT. | — | 0.5 | — | — |
| LAB591 | 65627.1 | 0.7 | 0.01 | 31 |
| LAB582 | 66267.1 | 0.9 | L | 80 |
| LAB582 | 66268.2 | 0.7 | 0.23 | 29 |
| LAB499 | 66044.1 | 0.8 | 0.04 | 46 |
| LAB499 | 66047.1 | 0.6 | 0.21 | 20 |
| LAB499 | 66048.1 | 0.8 | 0.05 | 43 |
| LAB491 | 65858.3 | 0.7 | 0.18 | 36 |
| LAB491 | 65859.1 | 1.1 | 0.08 | 106 |
| LAB491 | 65859.5 | 0.9 | 0.05 | 73 |
| LAB491 | 65861.2 | 1 | L | 83 |
| LAB481 | 66200.3 | 0.7 | L | 40 |
| LAB481 | 66202.2 | 0.7 | 0.1 | 25 |
| LAB408 | 65933.2 | 0.8 | 0.06 | 54 |
| CONT. | — | 0.5 | — | — |

Table 75.
"CONT."—Control;
"Ave."—Average;
"% Incr." = % increment;
"p-val."—p-value;
L—p < 0.01.

TABLE 76

Genes showing improved plant performance under high salinity conditions - assay 2 (T2 generation)

| Gene Name | Event # | Leaf Area [cm$^2$] Ave. | P-Val. | % Incr. |
|---|---|---|---|---|
| LAB587 | 66639.3 | 0.5 | 0.14 | 24 |
| LAB561 | 66632.3 | 0.5 | 0.2 | 21 |
| LAB533 | 66429.1 | 0.5 | 0.22 | 19 |
| LAB500 | 66485.2 | 0.6 | 0.02 | 41 |
| LAB478 | 66312.2 | 0.5 | 0.19 | 22 |
| LAB477 | 66576.1 | 0.5 | 0.23 | 19 |
| LAB397 | 66356.2 | 0.5 | 0.14 | 23 |
| CONT. | — | 0.4 | — | — |
| LAB608 | 65907.2 | 0.6 | 0.02 | 26 |
| LAB608 | 65909.2 | 0.5 | 0.03 | 17 |
| LAB578 | 65581.2 | 0.5 | 0.17 | 20 |
| LAB523 | 65660.3 | 0.5 | 0.02 | 20 |
| LAB523 | 65661.2 | 0.6 | L | 24 |
| LAB512 | 66739.4 | 0.6 | L | 33 |
| LAB449 | 65098.5 | 0.5 | 0.01 | 22 |
| LAB428 | 65079.2 | 0.5 | 0.04 | 22 |
| CONT. | — | 0.4 | — | — |
| LAB586 | 65587.2 | 0.6 | 0.28 | 11 |
| CONT. | — | 0.5 | — | — |
| LAB472 | 66717.5 | 0.5 | 0.09 | 10 |
| LAB470 | 66627.3 | 0.5 | 0.16 | 13 |
| LAB470 | 66630.1 | 0.6 | 0.01 | 19 |
| LAB470 | 66630.4 | 0.7 | L | 47 |

TABLE 76-continued

Genes showing improved plant performance under high salinity conditions - assay 2 (T2 generation)

| Gene Name | Event # | Leaf Area [cm²] Ave. | P-Val. | % Incr. |
|---|---|---|---|---|
| LAB466 | 66621.2 | 0.7 | 0.02 | 43 |
| LAB466 | 66622.4 | 0.5 | 0.11 | 16 |
| LAB466 | 66622.5 | 0.6 | 0.03 | 20 |
| LAB462 | 66615.11 | 0.5 | 0.26 | 14 |
| LAB462 | 66617.1 | 0.5 | 0.2 | 17 |
| LAB462 | 66618.2 | 0.5 | 0.12 | 12 |
| LAB454 | 66813.4 | 0.5 | 0.27 | 15 |
| LAB412 | 66698.2 | 0.6 | L | 33 |
| LAB412 | 66699.2 | 0.6 | 0.11 | 22 |
| LAB404 | 66778.2 | 0.5 | 0.05 | 18 |
| LAB404 | 66779.1 | 0.6 | 0.13 | 20 |
| LAB403 | 66802.6 | 0.6 | L | 22 |
| LAB403 | 66804.5 | 0.5 | 0.27 | 17 |
| CONT. | — | 0.5 | — | — |
| LAB516 | 65870.2 | 0.5 | 0.15 | 25 |
| LAB516 | 65870.3 | 0.5 | 0.28 | 15 |
| LAB511 | 66258.4 | 0.6 | 0.05 | 36 |
| LAB506 | 65115.4 | 0.5 | 0.25 | 20 |
| LAB475 | 67390.2 | 0.5 | 0.07 | 26 |
| LAB475 | 67391.1 | 0.5 | 0.18 | 23 |
| LAB474 | 66470.8 | 0.5 | 0.22 | 22 |
| LAB471 | 66188.2 | 0.5 | 0.3 | 14 |
| LAB471 | 66192.1 | 0.5 | 0.09 | 25 |
| LAB459 | 67376.3 | 0.5 | 0.03 | 31 |
| LAB459 | 67376.7 | 0.5 | 0.12 | 21 |
| LAB457 | 65100.1 | 0.6 | L | 42 |
| LAB457 | 65100.2 | 0.5 | 0.15 | 24 |
| LAB457 | 65104.2 | 0.5 | 0.11 | 23 |
| CONT. | — | 0.4 | — | — |
| LAB601 | 66509.2 | 0.6 | 0.28 | 8 |
| LAB586 | 65587.2 | 0.6 | 0.01 | 18 |
| CONT. | — | 0.5 | — | — |
| LAB559 | 66789.3 | 0.5 | 0.26 | 14 |
| LAB408 | 65933.2 | 0.6 | 0.12 | 33 |
| CONT. | — | 0.5 | — | — |
| LAB582 | 66267.1 | 0.7 | 0.12 | 14 |
| LAB538 | 66225.1 | 0.7 | 0.05 | 18 |
| CONT. | — | 0.6 | — | — |
| LAB604 | 66494.1 | 0.5 | 0.1 | 20 |
| LAB575 | 66782.5 | 0.5 | 0.2 | 10 |
| LAB575 | 66783.4 | 0.5 | 0.14 | 14 |
| LAB575 | 66784.6 | 0.6 | 0.03 | 30 |
| LAB446 | 65090.3 | 0.6 | 0.14 | 21 |
| LAB439 | 65950.1 | 0.5 | 0.18 | 11 |
| LAB439 | 65950.2 | 0.6 | 0.13 | 39 |
| LAB427 | 65539.3 | 0.5 | 0.19 | 10 |
| LAB427 | 65544.1 | 0.5 | 0.3 | 14 |
| LAB418 | 66827.5 | 0.5 | 0.19 | 14 |
| LAB396 | 65926.1 | 0.7 | L | 42 |
| LAB396 | 65927.4 | 0.5 | 0.11 | 13 |
| CONT. | — | 0.5 | — | — |
| LAB587 | 66638.2 | 0.6 | L | 29 |
| LAB587 | 66639.4 | 0.5 | 0.06 | 21 |
| LAB561 | 66632.3 | 0.5 | 0.02 | 23 |
| LAB559 | 66791.2 | 0.5 | 0.1 | 14 |
| LAB559 | 66791.3 | 0.5 | 0.26 | 8 |
| LAB500 | 66482.8 | 0.5 | 0.19 | 19 |
| LAB500 | 66485.2 | 0.5 | 0.11 | 15 |
| LAB489 | 66723.1 | 0.6 | L | 25 |
| LAB477 | 66574.1 | 0.5 | 0.06 | 22 |
| LAB394 | 66562.3 | 0.5 | 0.22 | 13 |
| LAB394 | 66565.1 | 0.6 | 0.01 | 37 |
| CONT. | — | 0.4 | — | — |
| LAB563 | 67029.4 | 0.4 | 0.02 | 29 |
| LAB563 | 67032.4 | 0.4 | 0.06 | 14 |
| LAB537 | 66329.2 | 0.4 | 0.29 | 12 |
| LAB537 | 66330.6 | 0.4 | 0.27 | 10 |
| LAB485 | 67023.1 | 0.5 | 0.03 | 34 |
| LAB473 | 66873.1 | 0.4 | 0.02 | 20 |
| LAB473 | 66873.3 | 0.4 | 0.03 | 18 |
| LAB433 | 67034.3 | 0.4 | 0.12 | 16 |
| LAB433 | 67038.5 | 0.4 | L | 30 |
| LAB400 | 65511.2 | 0.4 | 0.06 | 32 |
| LAB393 | 66287.2 | 0.4 | 0.06 | 12 |
| LAB390 | 67016.2 | 0.4 | 0.16 | 16 |
| LAB390 | 67017.2 | 0.4 | 0.02 | 26 |
| LAB390 | 67017.4 | 0.4 | 0.02 | 32 |
| LAB390 | 67020.3 | 0.4 | 0.03 | 14 |
| CONT. | — | 0.3 | — | — |
| LAB610 | 65342.3 | 0.6 | 0.03 | 26 |
| LAB595 | 65270.2 | 0.6 | 0.04 | 36 |
| LAB595 | 65273.2 | 0.5 | 0.18 | 10 |
| LAB562 | 65614.4 | 0.5 | 0.29 | 13 |
| CONT. | — | 0.5 | — | — |
| LAB524 | 65135.1 | 0.5 | L | 32 |
| LAB524 | 65136.4 | 0.5 | 0.14 | 21 |
| LAB512 | 66735.2 | 0.5 | 0.19 | 14 |
| LAB485 | 67022.2 | 0.5 | 0.27 | 14 |
| LAB485 | 67024.2 | 0.4 | 0.26 | 12 |
| LAB473 | 66873.1 | 0.5 | 0.06 | 30 |
| LAB473 | 66874.2 | 0.4 | 0.24 | 12 |
| LAB473 | 66875.1 | 0.5 | 0.26 | 24 |
| LAB433 | 67036.3 | 0.5 | 0.07 | 19 |
| LAB433 | 67036.4 | 0.4 | 0.21 | 13 |
| CONT. | — | 0.4 | — | — |
| LAB476 | 66305.1 | 0.6 | 0.07 | 14 |
| LAB476 | 66306.6 | 0.6 | 0.27 | 17 |
| LAB476 | 66307.2 | 0.6 | 0.03 | 21 |
| LAB424 | 66713.2 | 0.5 | 0.2 | 7 |
| LAB422 | 65936.2 | 0.6 | 0.04 | 19 |
| LAB418 | 66826.2 | 0.6 | 0.21 | 16 |
| CONT. | — | 0.5 | — | — |
| LAB607 | 65335.3 | 0.4 | 0.13 | 15 |
| LAB600 | 65718.2 | 0.4 | 0.07 | 18 |
| LAB542 | 65888.6 | 0.4 | 0.18 | 24 |
| LAB542 | 65892.6 | 0.4 | L | 35 |
| LAB501 | 65970.1 | 0.5 | 0.04 | 41 |
| LAB501 | 65970.2 | 0.4 | 0.28 | 10 |
| LAB490 | 65868.5 | 0.4 | 0.01 | 24 |
| LAB451 | 66704.5 | 0.4 | 0.02 | 28 |
| CONT. | — | 0.3 | — | — |
| LAB451 | 66704.3 | 0.6 | 0.14 | 12 |
| LAB451 | 66704.5 | 0.6 | 0.17 | 7 |
| LAB451 | 66707.5 | 0.7 | 0.06 | 20 |
| LAB445 | 66468.1 | 0.7 | L | 25 |
| CONT. | — | 0.5 | — | — |

Table 76.

"CONT."—Control;

"Ave."—Average;

"% Incr." = % increment;

"p-val."—p-value;

L—p < 0.01.

TABLE 77

Genes showing improved plant performance under high salinity conditions - assay 2 (T1 generation)

| | | Plant Biomass Fresh Weight [mg] | | | | | Plant Biomass Dry Weight [mg] | | |
|---|---|---|---|---|---|---|---|---|---|
| Gene Name | Event # | Ave. | p-val. | % Incr. | Gene Name | Event # | Ave. | p-val. | % Incr. |
| LAB581 | — | — | — | — | LAB581 | | 5 | 0.19 | 26 |
| LAB475 | | 95.9 | 0.09 | 22 | LAB475 | | 5.2 | 0.15 | 30 |
| LAB448 | | 99.8 | 0.03 | 27 | LAB448 | | 5.1 | 0.13 | 28 |
| CONT. | | 78.8 | — | — | CONT. | | 4 | — | — |

"CONT."—Control;
"Ave."—Average;
"% Incr." = % increment;
"p-val."—p-value;
"L"—p < 0.01.

TABLE 78

Genes showing improved plant performance under high salinity conditions - assay 2 (T1 generation)

| | | Leaf Area [cm²] | | |
|---|---|---|---|---|
| Gene Name | Event # | Ave. | p-value | % Incr. |
| LAB448 | | 0.4 | 0.14 | 16 |
| LAB391 | | 0.4 | 0.13 | 16 |
| CONT. | | 0.4 | — | — |

Table 78.
"CONT."—Control;
"Ave."—Average;
"% Incr." = % increment;
"p-val."—p-value;
L-p < 0.01.

The genes presented in Tables 79-81 showed a significant improvement in plant ABST since they produced a larger root biomass (root length and root coverage) when grown under osmotic stress conditions (assay 1) or high salinity conditions (assay 2), compared to control plants. Plants producing larger root biomass have better possibilities to absorb larger amount of water from soil. The genes were cloned under the regulation of a constitutive promoter (At6669; SEQ ID NO:7724). The evaluation of each gene was performed by testing the performance of different number of events. Some of the genes were evaluated in more than one tissue culture assay. This second experiment confined the significant increment in root performance. Event with p-value <0.1 was considered statistically significant.

TABLE 79

Genes showing improved root performance and growth under osmotic stress conditions - assay 1 (T2 generation)

| | | Roots Length [cm] | | | | | Roots Coverage [cm²] | | |
|---|---|---|---|---|---|---|---|---|---|
| Gene Name | Event # | Ave. | P-Val. | % Incr. | Gene Name | Event # | Ave. | P-Val. | % Incr. |
| LAB607 | 65336.1 | 7.3 | L | 13 | LAB607 | 65336.1 | 8.2 | L | 67 |
| LAB600 | 65718.2 | 7 | 0.07 | 8 | LAB600 | 65718.2 | 6.9 | 0.12 | 40 |
| LAB600 | 65719.3 | 7.7 | L | 20 | LAB600 | 65719.3 | 8 | L | 63 |
| LAB536 | 65148.1 | 5.7 | 0.26 | 15 | LAB542 | 65888.2 | 6.2 | 0.15 | 26 |
| LAB501 | 65966.3 | 7.3 | L | 13 | LAB501 | 65966.3 | 6.8 | 0.03 | 38 |
| LAB490 | 65868.5 | 7 | 0.13 | 8 | LAB490 | 65868.5 | 6.7 | 0.06 | 36 |
| CONT. | — | 6.5 | — | — | CONT. | | 4.9 | — | — |
| LAB602 | 65828.1 | 6.1 | 0.08 | 14 | LAB602 | 65828.1 | 5.2 | 0.22 | 19 |
| LAB602 | 65828.2 | 6.5 | 0.03 | 21 | LAB602 | 65828.2 | 6.2 | 0.08 | 43 |
| LAB602 | 65829.4 | 7.1 | L | 31 | LAB602 | 65829.4 | 8.3 | 0.03 | 90 |
| LAB602 | 65830.3 | 6.1 | 0.13 | 14 | LAB602 | 65830.3 | — | — | — |
| LAB602 | 65831.1 | 6.5 | 0.04 | 21 | LAB602 | 65831.1 | 5.4 | 0.28 | 23 |
| LAB598 | 66081.2 | 7.2 | L | 33 | LAB598 | 66081.2 | 5.8 | 0.14 | 33 |
| LAB598 | 66081.5 | 7.1 | 0.03 | 32 | LAB598 | 66081.5 | — | — | — |
| LAB598 | 66082.2 | 6.1 | 0.21 | 14 | LAB598 | 66082.2 | — | — | — |
| LAB592 | 65816.1 | 6 | 0.17 | 12 | LAB592 | 65816.1 | 5.2 | 0.28 | 19 |
| LAB592 | 65817.1 | — | — | — | LAB592 | 65817.1 | 5.2 | 0.21 | 18 |
| LAB543 | 65894.1 | 6.6 | 0.04 | 22 | LAB543 | 65894.1 | — | — | — |
| LAB543 | 65895.1 | 6.5 | 0.03 | 21 | LAB543 | 65895.1 | — | — | — |
| LAB543 | 65896.1 | 6.8 | 0.02 | 27 | LAB543 | 65896.1 | 6.1 | 0.05 | 40 |
| LAB543 | 65897.2 | 6.4 | 0.12 | 18 | LAB543 | 65897.2 | — | — | — |
| LAB543 | 65898.1 | 6.2 | 0.14 | 16 | LAB543 | 65898.1 | — | — | — |
| LAB486 | 65853.5 | 6.6 | 0.1 | 21 | LAB486 | 65853.5 | 5.5 | 0.21 | 27 |
| LAB486 | 65855.1 | 7 | L | 30 | LAB486 | 65855.1 | 5.5 | 0.18 | 25 |
| LAB486 | 65855.3 | 7.5 | L | 39 | LAB486 | 65855.3 | 7.6 | L | 74 |
| LAB486 | 65856.2 | 7.2 | L | 33 | LAB486 | 65856.2 | 5.4 | 0.13 | 23 |

TABLE 79-continued

Genes showing improved root performance and growth under osmotic stress conditions - assay 1 (T2 generation)

| | | Roots Length [cm] | | | | | Roots Coverage [cm²] | | |
|---|---|---|---|---|---|---|---|---|---|
| Gene Name | Event # | Ave. | P-Val. | % Incr. | Gene Name | Event # | Ave. | P-Val. | % Incr. |
| LAB431 | 65943.5 | 6.5 | 0.02 | 20 | LAB431 | 65943.5 | — | — | — |
| LAB431 | 65944.3 | 6.4 | 0.03 | 18 | LAB431 | 65944.3 | — | — | — |
| LAB431 | 65945.1 | 7.2 | L | 34 | LAB431 | 65945.1 | 6.5 | L | 49 |
| LAB431 | 65945.2 | 7.7 | L | 42 | LAB431 | 65945.2 | 6.3 | 0.02 | 44 |
| CONT. | — | 5.4 | — | — | CONT. | — | 4.4 | — | — |
| LAB612 | 66282.4 | 7.8 | 0.12 | 12 | LAB612 | 66282.4 | — | — | — |
| LAB602 | 65828.1 | 7.7 | 0.15 | 10 | LAB602 | 65828.1 | 10.9 | 0.03 | 44 |
| LAB602 | 65828.2 | — | — | — | LAB602 | 65828.2 | 9.8 | 0.06 | 30 |
| LAB598 | 66081.5 | 7.6 | 0.11 | 9 | LAB598 | 66081.5 | 9.4 | 0.17 | 25 |
| LAB592 | 65819.3 | — | — | — | LAB592 | 65819.3 | 9.7 | 0.05 | 29 |
| LAB592 | 65820.1 | 7.7 | 0.11 | 10 | LAB592 | 65820.1 | 10.6 | 0.02 | 41 |
| LAB543 | 65897.2 | 7.7 | 0.08 | 10 | LAB543 | 65897.2 | 10 | 0.09 | 33 |
| LAB486 | 65855.1 | 7.8 | 0.11 | 12 | LAB486 | 65855.1 | 11 | 0.15 | 46 |
| LAB486 | 65855.3 | — | — | — | LAB486 | 65855.3 | 9.4 | 0.15 | 25 |
| LAB486 | 65856.2 | 8 | 0.05 | 14 | LAB486 | 65856.2 | — | — | — |
| LAB463 | 65989.2 | — | — | — | LAB463 | 65989.2 | 9.8 | 0.07 | 30 |
| LAB431 | 65944.3 | 7.9 | 0.04 | 13 | LAB431 | 65944.3 | 11.2 | L | 48 |
| LAB431 | 65945.1 | 7.5 | 0.29 | 7 | LAB431 | 65945.1 | — | — | — |
| LAB398 | 65912.6 | 7.8 | 0.04 | 13 | LAB398 | 65912.6 | 9.2 | 0.14 | 22 |
| LAB398 | 65913.3 | 8 | 0.04 | 14 | LAB398 | 65913.3 | 9.2 | 0.21 | 22 |
| LAB398 | 65914.2 | 7.7 | 0.18 | 11 | LAB398 | 65914.2 | 9.4 | 0.25 | 25 |
| CONT. | — | 7 | — | — | CONT. | — | 7.5 | — | — |
| LAB582 | 66267.1 | — | — | — | LAB582 | 66267.1 | 11.9 | L | 42 |
| LAB499 | 66044.1 | — | — | — | LAB499 | 66044.1 | 9.4 | 0.28 | 12 |
| LAB499 | 66048.1 | — | — | — | LAB499 | 66048.1 | 10.3 | 0.12 | 23 |
| LAB491 | 65859.1 | — | — | — | LAB491 | 65859.1 | 13.3 | 0.07 | 58 |
| LAB491 | 65859.5 | 8.4 | 0.02 | 8 | LAB491 | 65859.5 | 13.1 | 0.08 | 57 |
| LAB491 | 65861.2 | — | — | — | LAB491 | 65861.2 | 12.4 | L | 48 |
| LAB481 | 66200.3 | — | — | — | LAB481 | 66200.3 | 10.5 | 0.03 | 25 |
| LAB481 | 66202.2 | — | — | — | LAB481 | 66202.2 | 9.4 | 0.12 | 13 |
| LAB408 | 65933.2 | — | — | — | LAB408 | 65933.2 | 10.9 | 0.17 | 30 |
| CONT. | — | 7.8 | — | — | CONT. | — | 8.4 | — | — |

"CONT."—Control;
"Ave."—Average;
"% Incr." = % increment;
"p-val."—p-value;
"L"—p < 0.01.

TABLE 80

Genes showing improved root performance and growth under high salinity conditions - assay 2 (T2 generation)

| | | Roots Length [cm] | | | | | Roots Coverage [cm²] | | |
|---|---|---|---|---|---|---|---|---|---|
| Gene Name | Event # | Ave. | p-Val. | % Incr. | Gene Name | Event # | Ave. | p-Val. | % Incr. |
| LAB587 | 66639.3 | 4.6 | 0.04 | 22 | LAB587 | 66639.3 | 5.2 | 0.05 | 45 |
| LAB561 | 66632.2 | 4.3 | 0.11 | 14 | LAB561 | 66632.2 | 4.4 | 0.16 | 23 |
| LAB561 | 66632.3 | — | — | — | LAB561 | 66632.3 | 4.1 | 0.3 | 16 |
| LAB561 | 66633.3 | 4.1 | 0.28 | 8 | LAB561 | 66633.3 | — | — | — |
| LAB533 | 66428.1 | 4.3 | 0.15 | 14 | LAB533 | 66428.1 | 4.6 | 0.07 | 28 |
| LAB478 | 66311.1 | 4.4 | 0.09 | 16 | LAB478 | 66311.1 | 4.9 | 0.05 | 36 |
| LAB477 | 66572.1 | 4.2 | 0.22 | 10 | LAB477 | 66572.1 | — | — | — |
| LAB477 | 66574.1 | — | — | — | LAB477 | 66574.1 | 4.4 | 0.3 | 22 |
| LAB397 | 66356.2 | 4.5 | 0.03 | 18 | LAB397 | 66356.2 | 4.9 | 0.09 | 38 |
| LAB397 | 66359.2 | 4.1 | 0.27 | 9 | LAB397 | 66359.2 | — | — | — |
| CONT. | — | 3.8 | — | — | CONT. | — | 3.6 | — | — |
| LAB608 | 65906.1 | 4.3 | 0.27 | 6 | LAB608 | 65906.1 | 4.5 | 0.07 | 27 |
| LAB608 | 65907.3 | — | — | — | LAB608 | 65907.3 | 4.4 | 0.05 | 26 |
| LAB608 | 65909.1 | 5 | 0.01 | 23 | LAB608 | 65909.1 | 4.6 | 0.05 | 31 |
| LAB578 | 65581.2 | 4.6 | 0.1 | 12 | LAB578 | 65581.2 | 4.5 | 0.14 | 29 |
| LAB578 | 65581.3 | 4.4 | 0.16 | 9 | LAB578 | 65581.3 | 4.9 | 0.02 | 40 |
| LAB578 | 65583.2 | 4.4 | 0.28 | 7 | LAB578 | 65583.2 | — | — | — |
| LAB523 | 65660.3 | 4.6 | 0.1 | 13 | LAB523 | 65660.3 | — | — | — |
| LAB523 | 65661.2 | 4.9 | L | 21 | LAB523 | 65661.2 | 4.5 | 0.19 | 30 |
| LAB523 | 65663.5 | 4.8 | L | 19 | LAB523 | 65663.5 | — | — | — |
| LAB512 | 66739.1 | 4.7 | 0.01 | 17 | LAB512 | 66739.1 | 5.2 | 0.01 | 49 |

TABLE 80-continued

Genes showing improved root performance and growth under high salinity conditions - assay 2 (T2 generation)

| | | Roots Length [cm] | | | | | Roots Coverage [cm²] | | |
|---|---|---|---|---|---|---|---|---|---|
| Gene Name | Event # | Ave. | p-Val. | % Incr. | Gene Name | Event # | Ave. | p-Val. | % Incr. |
| LAB488 | 66819.1 | — | — | — | LAB488 | 66819.1 | 3.9 | 0.27 | 13 |
| LAB488 | 66822.4 | 4.7 | 0.07 | 15 | LAB488 | 66822.4 | 4.8 | 0.06 | 38 |
| LAB450 | 65305.3 | 4.7 | 0.11 | 16 | LAB450 | 65305.3 | — | — | — |
| LAB450 | 65309.1 | 4.8 | 0.09 | 17 | LAB450 | 65309.1 | — | — | — |
| LAB449 | 65098.4 | 4.6 | 0.03 | 13 | LAB449 | 65098.4 | 4.5 | 0.12 | 28 |
| LAB428 | 65078.2 | 4.7 | 0.02 | 15 | LAB428 | 65078.2 | — | — | — |
| LAB428 | 65079.1 | 4.4 | 0.23 | 9 | LAB428 | 65079.1 | — | — | — |
| LAB428 | 65079.2 | 4.8 | L | 18 | LAB428 | 65079.2 | 4.8 | L | 37 |
| LAB428 | 65082.3 | 4.9 | 0.06 | 19 | LAB428 | 65082.3 | — | — | — |
| LAB420 | 66836.1 | 4.5 | 0.23 | 11 | LAB420 | 66836.1 | — | — | — |
| LAB420 | 66836.3 | 4.4 | 0.15 | 9 | LAB420 | 66836.3 | 4.4 | 0.06 | 25 |
| LAB420 | 66837.1 | 4.8 | 0.19 | 18 | LAB420 | 66837.1 | 4.8 | 0.05 | 37 |
| LAB420 | 66838.2 | 4.8 | 0.01 | 18 | LAB420 | 66838.2 | 4.7 | 0.11 | 33 |
| CONT. | — | 4.1 | — | — | CONT. | — | 3.5 | — | — |
| LAB493 | 66476.2 | 5.2 | 0.07 | 15 | LAB493 | 66476.2 | 6.4 | 0.23 | 38 |
| CONT. | — | 4.5 | — | — | CONT. | — | 4.6 | — | — |
| LAB470 | 66630.1 | 5.1 | 0.13 | 10 | LAB470 | 66630.1 | — | — | — |
| LAB470 | 66630.4 | — | — | — | LAB470 | 66630.4 | 6.3 | 0.18 | 26 |
| LAB466 | 66620.4 | — | — | — | LAB466 | 66620.4 | 6 | 0.21 | 19 |
| LAB466 | 66621.2 | 5.6 | 0.06 | 21 | LAB466 | 66621.2 | 7.9 | 0.09 | 57 |
| LAB466 | 66622.4 | 5 | 0.28 | 10 | LAB466 | 66622.4 | 6.4 | 0.1 | 26 |
| LAB466 | 66622.5 | 5.6 | L | 21 | LAB466 | 66622.5 | 7.3 | 0.02 | 44 |
| LAB404 | 66779.1 | 5 | 0.26 | 9 | LAB404 | 66779.1 | 6.2 | 0.05 | 23 |
| LAB404 | 66780.6 | 5 | 0.17 | 9 | LAB404 | 66780.6 | 5.9 | 0.08 | 17 |
| LAB403 | 66802.6 | 5.5 | L | 21 | LAB403 | 66802.6 | 7.1 | 0.02 | 40 |
| LAB403 | 66804.5 | 5.1 | 0.07 | 11 | LAB403 | 66804.5 | 6.7 | 0.03 | 33 |
| LAB403 | 66804.8 | — | — | — | LAB403 | 66804.8 | 5.6 | 0.23 | 12 |
| CONT. | — | 4.6 | — | — | CONT. | — | 5 | — | — |
| LAB516 | 65870.2 | 4.8 | 0.19 | 14 | LAB516 | 65870.2 | 6.1 | 0.08 | 48 |
| LAB516 | 65870.3 | 4.7 | 0.1 | 10 | LAB516 | 65870.3 | 4.9 | 0.21 | 19 |
| LAB516 | 65871.3 | 4.7 | 0.19 | 10 | LAB516 | 65871.3 | — | — | — |
| LAB516 | 65874.3 | 4.8 | 0.05 | 14 | LAB516 | 65874.3 | — | — | — |
| LAB516 | 65875.2 | 5.5 | L | 30 | LAB516 | 65875.2 | 5.8 | 0.07 | 40 |
| LAB511 | 66258.4 | 5 | 0.02 | 17 | LAB511 | 66258.4 | 6.3 | L | 54 |
| LAB506 | 65111.4 | 4.7 | 0.11 | 11 | LAB506 | 65111.4 | — | — | — |
| LAB506 | 65114.2 | 5 | L | 19 | LAB506 | 65114.2 | 5.8 | 0.02 | 40 |
| LAB506 | 65115.4 | 4.8 | 0.05 | 14 | LAB506 | 65115.4 | 5 | 0.17 | 22 |
| LAB475 | 67390.2 | 5.1 | 0.07 | 21 | LAB475 | 67390.2 | 6.1 | 0.08 | 48 |
| LAB475 | 67391.1 | 5 | 0.01 | 19 | LAB475 | 67391.1 | 6.1 | 0.02 | 47 |
| LAB475 | 67391.6 | 4.8 | 0.1 | 12 | LAB475 | 67391.6 | 5.2 | 0.11 | 25 |
| LAB474 | 66475.2 | 4.7 | 0.18 | 11 | LAB474 | 66475.2 | — | — | — |
| LAB474 | 66475.3 | 4.6 | 0.16 | 10 | LAB474 | 66475.3 | — | — | — |
| LAB471 | 66188.2 | 5.3 | L | 24 | LAB471 | 66188.2 | 5.5 | 0.05 | 33 |
| LAB471 | 66191.2 | 5 | 0.02 | 18 | LAB471 | 66191.2 | — | — | — |
| LAB459 | 67376.3 | 4.7 | 0.13 | 10 | LAB459 | 67376.3 | 5.2 | 0.15 | 25 |
| LAB459 | 67376.7 | 4.9 | 0.03 | 15 | LAB459 | 67376.7 | 5.5 | 0.12 | 33 |
| LAB457 | 65100.2 | 5.1 | L | 19 | LAB457 | 65100.2 | 5.8 | 0.04 | 41 |
| LAB457 | 65101.2 | 4.9 | 0.06 | 16 | LAB457 | 65101.2 | 5.2 | 0.11 | 26 |
| LAB457 | 65104.2 | 5 | 0.06 | 17 | LAB457 | 65104.2 | 6 | 0.04 | 47 |
| LAB435 | 67374.1 | 5.7 | L | 35 | LAB435 | 67374.1 | — | — | — |
| LAB435 | 67374.3 | 4.6 | 0.14 | 9 | LAB435 | 67374.3 | — | — | — |
| CONT. | — | 4.2 | — | — | CONT. | — | 4.1 | | |
| LAB493 | 66476.2 | 4.2 | 0.16 | 9 | LAB493 | 66476.2 | 4.7 | 0.28 | 10 |
| LAB493 | 66476.4 | 4.6 | 0.01 | 20 | LAB493 | 66476.4 | — | — | — |
| LAB479 | 66346.2 | 4.4 | 0.02 | 15 | LAB479 | 66346.2 | 5.7 | 0.01 | 35 |
| LAB478 | 66311.1 | 4.4 | 0.04 | 16 | LAB478 | 66311.1 | 5.3 | 0.08 | 24 |
| CONT. | — | 3.8 | — | — | CONT. | — | 4.2 | — | — |
| LAB597 | 66272.3 | — | — | — | LAB597 | 66272.3 | 4.4 | 0.3 | 13 |
| LAB597 | 66273.1 | — | — | — | LAB597 | 66273.1 | 4.8 | 0.1 | 24 |
| LAB559 | 66789.3 | — | — | — | LAB559 | 66789.3 | 5.4 | 0.02 | 38 |
| LAB559 | 66790.3 | — | — | — | LAB559 | 66790.3 | 4.6 | 0.3 | 19 |
| LAB489 | 66723.1 | 5.2 | 0.05 | 27 | LAB489 | 66723.1 | 5.5 | 0.05 | 42 |
| LAB489 | 66723.4 | 4.4 | 0.3 | 8 | LAB489 | 66723.4 | 5.2 | 0.02 | 32 |
| LAB480 | 66248.5 | 4.9 | 0.04 | 19 | LAB480 | 66248.5 | 6.1 | 0.06 | 56 |
| LAB480 | 66250.2 | 4.7 | 0.09 | 16 | LAB480 | 66250.2 | 5.1 | 0.02 | 30 |
| LAB480 | 66252.3 | 4.6 | 0.07 | 14 | LAB480 | 66252.3 | 5.7 | 0.03 | 46 |
| LAB447 | 66350.3 | — | — | — | LAB447 | 66350.3 | 5.1 | 0.05 | 31 |
| LAB447 | 66351.2 | — | — | — | LAB447 | 66351.2 | 4.8 | 0.17 | 23 |
| LAB419 | 66164.2 | 5 | 0.02 | 23 | LAB419 | 66164.2 | 5.3 | 0.12 | 36 |
| LAB419 | 66165.4 | | | | LAB419 | 66165.4 | 4.7 | 0.08 | 20 |
| LAB408 | 65930.2 | 4.6 | 0.17 | 14 | LAB408 | 65930.2 | 5.7 | 0.05 | 47 |
| LAB408 | 65932.2 | 4.9 | 0.09 | 21 | LAB408 | 65932.2 | 5.3 | L | 37 |

TABLE 80-continued

Genes showing improved root performance and growth
under high salinity conditions - assay 2 (T2 generation)

| | | Roots Length [cm] | | | | | Roots Coverage [cm²] | | |
|---|---|---|---|---|---|---|---|---|---|
| Gene Name | Event # | Ave. | p-Val. | % Incr. | Gene Name | Event # | Ave. | p-Val. | % Incr. |
| LAB408 | 65933.2 | — | — | — | LAB408 | 65933.2 | 4.9 | 0.12 | 27 |
| LAB407 | 66244.2 | — | — | — | LAB407 | 66244.2 | 4.7 | 0.28 | 20 |
| LAB394 | 66561.2 | 4.7 | 0.06 | 16 | LAB394 | 66561.2 | — | — | — |
| CONT. | — | 4.1 | — | — | CONT. | — | 3.9 | — | — |
| LAB582 | 66267.1 | 4.3 | 0.12 | 13 | LAB582 | 66267.1 | 4.8 | 0.19 | 24 |
| LAB551 | 65813.2 | | — | — | LAB551 | 65813.2 | 4.9 | 0.02 | 27 |
| LAB538 | 66225.1 | 4.7 | 0.03 | 24 | LAB538 | 66225.1 | 5.5 | 0.14 | 43 |
| LAB499 | 66044.1 | 4.5 | L | 18 | LAB499 | 66044.1 | 4.6 | 0.2 | 19 |
| LAB499 | 66045.1 | 4.2 | 0.26 | 11 | LAB499 | 66045.1 | — | — | — |
| LAB499 | 66048.4 | 4.3 | 0.1 | 13 | LAB499 | 66048.4 | 4.7 | 0.19 | 23 |
| LAB491 | 65859.5 | 4.3 | 0.06 | 15 | LAB491 | 65859.5 | 5.2 | 0.22 | 36 |
| LAB491 | 65861.2 | 4.5 | L | 20 | LAB491 | 65861.2 | 5.1 | L | 33 |
| LAB491 | 65861.3 | 4.4 | 0.19 | 16 | LAB491 | 65861.3 | 5.3 | 0.03 | 40 |
| LAB408 | 65932.2 | 4.8 | L | 28 | LAB408 | 65932.2 | 4.6 | 0.02 | 19 |
| LAB395 | 66232.1 | 4.4 | 0.05 | 17 | LAB395 | 66232.1 | 4.5 | 0.17 | 17 |
| CONT. | — | 3.8 | — | — | CONT. | — | 3.8 | — | — |
| LAB604 | 66494.1 | — | — | — | LAB604 | 66494.1 | 4.7 | 0.13 | 14 |
| LAB604 | 66495.4 | — | — | — | LAB604 | 66495.4 | 4.7 | 0.19 | 13 |
| LAB575 | 66784.6 | 4.9 | 0.08 | 8 | LAB575 | 66784.6 | 5.1 | 0.06 | 25 |
| LAB519 | 66321.1 | 5.1 | 0.08 | 12 | LAB519 | 66321.1 | — | — | — |
| LAB519 | 66323.1 | — | — | — | LAB519 | 66323.1 | 4.8 | 0.25 | 17 |
| LAB446 | 65091.2 | 5 | 0.04 | 10 | LAB446 | 65091.2 | 4.9 | 0.09 | 19 |
| LAB446 | 65094.1 | 5 | 0.16 | 9 | LAB446 | 65094.1 | 4.5 | 0.11 | 10 |
| LAB439 | 65949.3 | — | — | — | LAB439 | 65949.3 | 5 | 0.28 | 21 |
| LAB439 | 65950.1 | 5.3 | 0.02 | 15 | LAB439 | 65950.1 | 5.3 | 0.04 | 29 |
| LAB439 | 65950.2 | — | — | — | LAB439 | 65950.2 | 6.1 | 0.29 | 49 |
| LAB438 | 66460.1 | 4.8 | 0.22 | 5 | LAB438 | 66460.1 | — | — | — |
| LAB438 | 66461.5 | | — | — | LAB438 | 66461.5 | 5 | 0.27 | 22 |
| LAB427 | 65539.1 | 5.2 | 0.02 | 13 | LAB427 | 65539.1 | 5.2 | 0.15 | 27 |
| LAB427 | 65539.3 | — | — | — | LAB427 | 65539.3 | — | — | — |
| LAB427 | 65539.6 | 4.9 | 0.19 | 8 | LAB427 | 65539.6 | 4.8 | 0.09 | 16 |
| LAB396 | 65924.1 | 5.4 | 0.02 | 18 | LAB396 | 65924.1 | 5.6 | 0.04 | 36 |
| LAB396 | 65926.1 | — | — | — | LAB396 | 65926.1 | 5 | 0.3 | 23 |
| CONT. | — | 4.6 | — | — | CONT. | — | 4.1 | — | — |
| LAB603 | 66489.1 | 4.3 | 0.17 | 10 | LAB603 | 66489.1 | — | — | — |
| LAB603 | 66490.2 | 4.5 | 0.09 | 17 | LAB603 | 66490.2 | 4.6 | 0.19 | 34 |
| LAB603 | 66491.3 | 4.4 | 0.14 | 13 | LAB603 | 66491.3 | — | — | — |
| LAB587 | 66638.2 | 4.8 | L | 24 | LAB587 | 66638.2 | 4.7 | 0.05 | 38 |
| LAB587 | 66639.3 | 4.5 | 0.1 | 17 | LAB587 | 66639.3 | 4.3 | 0.08 | 26 |
| LAB587 | 66639.4 | 4.6 | 0.03 | 18 | LAB587 | 66639.4 | 4.4 | 0.09 | 29 |
| LAB561 | 66632.2 | 4.7 | 0.06 | 22 | LAB561 | 66632.2 | — | — | — |
| LAB561 | 66632.3 | 5 | 0.03 | 29 | LAB561 | 66632.3 | 5.7 | 0.03 | 68 |
| LAB561 | 66633.2 | 5.1 | L | 32 | LAB561 | 66633.2 | 4.8 | 0.07 | 42 |
| LAB561 | 66634.1 | 4.5 | 0.04 | 16 | LAB561 | 66634.1 | 4.4 | 0.09 | 29 |
| LAB559 | 66790.3 | 4.6 | 0.02 | 19 | LAB559 | 66790.3 | 4.1 | 0.18 | 21 |
| LAB559 | 66791.2 | 4.5 | 0.04 | 18 | LAB559 | 66791.2 | 4.4 | 0.19 | 28 |
| LAB559 | 66791.3 | 4.4 | 0.09 | 15 | LAB559 | 66791.3 | — | — | — |
| LAB533 | 66428.1 | 4.3 | 0.18 | 11 | LAB533 | 66428.1 | — | — | — |
| LAB533 | 66429.1 | 4.3 | 0.17 | 11 | LAB533 | 66429.1 | — | — | — |
| LAB533 | 66430.5 | 4.4 | 0.13 | 15 | LAB533 | 66430.5 | — | — | — |
| LAB533 | 66431.2 | 4.5 | 0.06 | 16 | LAB533 | 66431.2 | — | — | — |
| LAB500 | 66482.8 | 4.7 | 0.12 | 22 | LAB500 | 66482.8 | 4.7 | 0.23 | 36 |
| LAB500 | 66484.1 | 4.3 | 0.2 | 11 | LAB500 | 66484.1 | — | — | — |
| LAB500 | 66485.2 | 5 | L | 28 | LAB500 | 66485.2 | 4.5 | 0.04 | 31 |
| LAB500 | 66485.3 | 4.6 | 0.02 | 18 | LAB500 | 66485.3 | — | — | — |
| LAB489 | 66722.2 | 4.8 | 0.01 | 26 | LAB489 | 66722.2 | 4.5 | 0.17 | 33 |
| LAB489 | 66723.1 | 4.3 | 0.21 | 11 | LAB489 | 66723.1 | 4.4 | 0.17 | 28 |
| LAB477 | 66572.1 | 4.4 | 0.12 | 13 | LAB477 | 66572.1 | — | — | — |
| LAB477 | 66574.1 | 4.9 | L | 28 | LAB477 | 66574.1 | 5.3 | L | 55 |
| LAB477 | 66576.2 | 4.5 | 0.02 | 18 | LAB477 | 66576.2 | — | — | — |
| LAB394 | 66560.5 | 4.4 | 0.07 | 13 | LAB394 | 66560.5 | 4 | 0.27 | 16 |
| LAB394 | 66561.2 | 4.4 | 0.17 | 14 | LAB394 | 66561.2 | — | — | — |
| LAB394 | 66562.3 | 4.6 | 0.03 | 20 | LAB394 | 66562.3 | 4.2 | 0.16 | 23 |
| LAB394 | 66565.1 | 4.7 | 0.06 | 22 | LAB394 | 66565.1 | 4.9 | 0.12 | 43 |
| CONT. | — | 3.9 | — | — | CONT. | — | 3.4 | — | — |
| LAB563 | 67029.4 | 4.2 | 0.11 | 10 | LAB563 | 67029.4 | 4.5 | 0.02 | 46 |
| LAB485 | 67022.2 | — | — | — | LAB485 | 67022.2 | 3.8 | 0.29 | 26 |
| LAB485 | 67023.1 | 4.5 | 0.08 | 17 | LAB485 | 67023.1 | — | — | — |
| LAB485 | 67024.1 | 4.4 | 0.05 | 15 | LAB485 | 67024.1 | 3.8 | 0.09 | 25 |
| LAB433 | 67036.4 | 4.5 | L | 18 | LAB433 | 67036.4 | 4.1 | L | 36 |
| LAB400 | 65509.1 | 4.8 | L | 24 | LAB400 | 65509.1 | 4.7 | 0.01 | 53 |
| LAB400 | 65511.2 | 4.8 | 0.03 | 26 | LAB400 | 65511.2 | 4.4 | 0.06 | 45 |

TABLE 80-continued

Genes showing improved root performance and growth under high salinity conditions - assay 2 (T2 generation)

| | | Roots Length [cm] | | | | | Roots Coverage [cm²] | | |
|---|---|---|---|---|---|---|---|---|---|
| Gene Name | Event # | Ave. | p-Val. | % Incr. | Gene Name | Event # | Ave. | p-Val. | % Incr. |
| LAB393 | 66285.4 | 4.6 | 0.05 | 21 | LAB393 | 66285.4 | 3.9 | L | 28 |
| LAB390 | 67016.2 | — | 3.7 | — | LAB390 | 67016.2 | 0.2 | 4 | 20 |
| LAB390 | 67017.4 | 4.7 | 0.1 | 21 | LAB390 | 67017.4 | 4.1 | 0.27 | 36 |
| LAB390 | 67020.1 | 4.2 | 0.26 | 9 | LAB390 | 67020.1 | — | — | — |
| CONT. | — | 3.8 | — | — | CONT. | — | 3 | — | — |
| LAB595 | 65270.2 | — | — | — | LAB595 | 65270.2 | 4 | 0.25 | 23 |
| LAB595 | 65270.3 | — | — | — | LAB595 | 65270.3 | 3.9 | 0.1 | 19 |
| LAB577 | 65578.4 | 4.4 | 0.02 | 12 | LAB577 | 65578.4 | 3.8 | L | 17 |
| LAB562 | 65612.3 | 4.3 | 0.21 | 10 | LAB562 | 65612.3 | 3.6 | 0.22 | 11 |
| LAB562 | 65614.4 | — | — | — | LAB562 | 65614.4 | 4.2 | 0.04 | 28 |
| LAB505 | 65110.4 | — | — | — | LAB505 | 65110.4 | 3.6 | 0.24 | 10 |
| LAB459 | 67379.3 | — | — | — | LAB459 | 67379.3 | 3.9 | 0.16 | 21 |
| LAB423 | 65527.1 | 5.1 | L | 32 | LAB423 | 65527.1 | 4.6 | 0.1 | 40 |
| LAB423 | 65527.3 | 4.6 | L | 19 | LAB423 | 65527.3 | 3.8 | 0.22 | 18 |
| CONT. | — | 3.9 | — | — | CONT. | — | 3.2 | — | — |
| LAB524 | 65135.1 | 4.1 | 0.1 | 15 | LAB524 | 65135.1 | 4.3 | 0.17 | 46 |
| LAB512 | 66735.2 | — | — | — | LAB512 | 66735.2 | 3.5 | 0.26 | 17 |
| LAB485 | 67023.1 | 4.1 | 0.14 | 14 | LAB485 | 67023.1 | — | — | — |
| LAB473 | 66873.1 | — | — | — | LAB473 | 66873.1 | 3.7 | 0.05 | 23 |
| LAB473 | 66874.2 | 3.9 | 0.22 | 9 | LAB473 | 66874.2 | 3.5 | 0.2 | 17 |
| LAB473 | 66875.1 | 4.4 | 0.03 | 23 | LAB473 | 66875.1 | 4.4 | 0.06 | 47 |
| LAB433 | 67036.3 | 4.3 | L | 19 | LAB433 | 67036.3 | 4 | 0.03 | 33 |
| LAB433 | 67036.4 | 4.2 | 0.13 | 17 | LAB433 | 67036.4 | 3.5 | 0.24 | 18 |
| LAB433 | 67038.5 | — | — | — | LAB433 | 67038.5 | 3.3 | 0.16 | 12 |
| LAB390 | 67017.2 | 4 | 0.13 | 11 | LAB390 | 67017.2 | 3.5 | 0.21 | 19 |
| LAB390 | 67020.1 | 4.1 | 0.23 | 13 | LAB390 | 67020.1 | — | — | — |
| LAB390 | 67020.3 | 4 | 0.2 | 10 | LAB390 | 67020.3 | 3.8 | 0.04 | 27 |
| CONT. | — | 3.6 | — | — | CONT. | — | 3 | — | — |
| LAB575 | 66783.2 | 4.9 | 0.07 | 16 | LAB575 | 66783.2 | — | — | — |
| LAB508 | 66733.4 | — | — | — | LAB508 | 66733.4 | 4.7 | 0.28 | 12 |
| LAB476 | 66306.6 | 4.6 | 0.08 | 8 | LAB476 | 66306.6 | 4.8 | 0.14 | 14 |
| LAB476 | 66307.2 | 4.5 | 0.25 | 6 | LAB476 | 66307.2 | 5.5 | 0.15 | 32 |
| LAB424 | 66710.9 | 4.8 | 0.17 | 14 | LAB424 | 66710.9 | — | — | — |
| LAB424 | 66713.2 | — | — | — | LAB424 | 66713.2 | — | — | — |
| LAB422 | 65936.2 | — | — | — | LAB422 | 65936.2 | 5 | 0.03 | 19 |
| LAB422 | 65937.4 | — | — | — | LAB422 | 65937.4 | 5.1 | 0.02 | 22 |
| LAB422 | 65938.3 | 5 | 0.03 | 18 | LAB422 | 65938.3 | 5.6 | 0.03 | 35 |
| LAB418 | 66826.2 | — | — | — | LAB418 | 66826.2 | — | — | — |
| LAB412 | 66699.2 | 4.7 | 0.06 | 11 | LAB412 | 66699.2 | 5.3 | 0.07 | 26 |
| CONT. | — | 4.2 | — | — | CONT. | — | 4.2 | — | — |
| LAB607 | 65335.2 | 3.2 | 0.16 | 15 | LAB607 | 65335.2 | 2.6 | 0.12 | 52 |
| LAB607 | 65335.3 | 3.5 | 0.04 | 23 | LAB607 | 65335.3 | 2.3 | 0.11 | 38 |
| LAB600 | 65716.3 | 3.5 | 0.08 | 23 | LAB600 | 65716.3 | — | — | — |
| LAB600 | 65718.2 | 4 | L | 42 | LAB600 | 65718.2 | 3 | L | 78 |
| LAB600 | 65719.3 | 3.7 | 0.03 | 31 | LAB600 | 65719.3 | 2.4 | 0.08 | 40 |
| LAB542 | 65888.3 | — | — | — | LAB542 | 65888.3 | 2.2 | 0.23 | 31 |
| LAB542 | 65888.6 | 3.8 | L | 34 | LAB542 | 65888.6 | 2.9 | L | 72 |
| LAB536 | 65148.1 | 3.3 | 0.12 | 17 | LAB536 | 65148.1 | — | — | — |
| LAB536 | 65148.4 | 3.7 | 0.02 | 31 | LAB536 | 65148.4 | 2.1 | 0.22 | 26 |
| LAB536 | 65149.3 | 3.2 | 0.19 | 12 | LAB536 | 65149.3 | — | — | — |
| LAB501 | 65966.3 | 3.7 | 0.07 | 30 | LAB501 | 65966.3 | 2.2 | 0.27 | 29 |
| LAB501 | 65968.3 | 3.2 | 0.25 | 12 | LAB501 | 65968.3 | — | — | — |
| LAB501 | 65969.1 | 4 | L | 41 | LAB501 | 65969.1 | 3.1 | 0.02 | 86 |
| LAB501 | 65970.1 | 3.9 | L | 40 | LAB501 | 65970.1 | 3.3 | L | 94 |
| LAB501 | 65970.2 | 3.4 | 0.2 | 21 | LAB501 | 65970.2 | — | — | — |
| LAB490 | 65864.1 | 3.6 | 0.08 | 29 | LAB490 | 65864.1 | 2.5 | 0.1 | 47 |
| LAB490 | 65868.3 | 4.2 | L | 49 | LAB490 | 65868.3 | 3.1 | L | 84 |
| LAB490 | 65868.5 | 4.1 | 0.2 | 44 | LAB490 | 65868.5 | 3 | 0.16 | 81 |
| LAB482 | 66830.1 | 4.1 | 0.02 | 43 | LAB482 | 66830.1 | 3 | 0.02 | 81 |
| LAB451 | 66704.2 | 3.7 | 0.09 | 32 | LAB451 | 66704.2 | — | — | — |
| LAB451 | 66704.3 | 3.4 | 0.3 | 20 | LAB451 | 66704.3 | 2.4 | 0.22 | 42 |
| LAB451 | 66704.5 | 3.8 | L | 35 | LAB451 | 66704.5 | 3 | L | 78 |
| LAB451 | 66707.4 | 3.2 | 0.28 | 14 | LAB451 | 66707.4 | — | — | — |
| LAB451 | 66707.5 | 3.6 | 0.04 | 26 | LAB451 | 66707.5 | 2.5 | 0.13 | 46 |
| LAB445 | 66467.4 | 3.9 | 0.02 | 38 | LAB445 | 66467.4 | 2.4 | 0.15 | 43 |
| LAB445 | 66468.1 | 3.1 | 0.29 | 11 | LAB445 | 66468.1 | 2.1 | 0.29 | 25 |
| CONT. | — | 2.8 | — | — | CONT. | — | 1.7 | — | — |
| LAB451 | 66704.5 | — | — | — | LAB451 | 66704.5 | 5.5 | 0.23 | 10 |
| LAB451 | 66707.4 | 5.1 | 0.1 | 9 | LAB451 | 66707.4 | — | — | — |

TABLE 80-continued

Genes showing improved root performance and growth under high salinity conditions - assay 2 (T2 generation)

| Gene Name | Event # | Roots Length [cm] Ave. | p-Val. | % Incr. | Gene Name | Event # | Roots Coverage [cm²] Ave. | p-Val. | % Incr. |
|---|---|---|---|---|---|---|---|---|---|
| LAB445 | 66464.3 | — | — | — | LAB445 | 66464.3 | 5.6 | 0.27 | 14 |
| CONT. | — | 4.7 | — | — | CONT. | — | 5 | — | — |

"CONT."—Control;
"Ave."—Average;
"% Incr." = % increment;
"p-val."—p-value;
"L"—p < 0.01.

TABLE 81

Genes showing improved root performance and growth under high salinity conditions - assay 2 (T1 generation)

| Gene Name | Event # | Roots Length [cm] Ave. | p-val. | % | Gene Name | Event # | Roots Coverage [cm²] Ave. | p-val. | % |
|---|---|---|---|---|---|---|---|---|---|
| LAB469 | | 4.7 | 0.22 | 9 | LAB469 | | — | — | — |
| LAB435 | | 4.6 | 0.1 | 7 | LAB435 | | — | — | — |
| LAB417 | | 4.7 | 0.02 | 9 | LAB417 | | — | — | — |
| LAB415 | | — | — | — | LAB415 | | 4.5 | 0.28 | 13 |
| CONT. | | 4.3 | — | — | CONT. | | 4 | — | — |

Table 81.
"CONT."—Control;
"Ave."—Average;
"% Incr." = % increment;
"p-val."—p-value;
L—p < 0.01.

The genes listed in Tables 82-87 have improved plant growth rate (growth rate of the leaf area, root coverage and root length) when grown under osmotic stress conditions (assay 1) or high salinity conditions (assay 2), compared to control plants. Plants showing fast growth rate show a better plant establishment in soil under ABST conditions. Faster growth was observed when growth rate of leaf area and root length and coverage was measured. The genes were cloned under the regulation of a constitutive promoter (At6669; SEQ ID NO:7724). The evaluation of each gene was performed by testing the performance of different number of events. Some of the genes were evaluated in more than one tissue culture assay and the results obtained where to positive as well. Event with p-value <0.1 was considered statistically significant.

TABLE 82

Genes showing improved plant performance and growth rate under osmotic stress conditions - assay 1 (T2 generation)

| Gene Name | Event # | RGR Of Leaf Area Ave. | P-Val. | % Incr. | RGR Of Roots Coverage Ave. | P-Val. | % Incr. |
|---|---|---|---|---|---|---|---|
| LAB607 | 65335.1 | — | — | — | 0.7 | 0.23 | 20 |
| LAB607 | 65336.1 | 0 | 0.03 | 48 | 1 | L | 68 |
| LAB600 | 65718.2 | 0 | 0.09 | 43 | 0.8 | 0.03 | 39 |
| LAB600 | 65719.3 | 0 | L | 72 | 1 | L | 64 |
| LAB542 | 65888.2 | 0 | 0.03 | 53 | 0.7 | 0.1 | 27 |

TABLE 82-continued

Genes showing improved plant performance and growth rate under osmotic stress conditions - assay 1 (T2 generation)

| Gene Name | Event # | RGR Of Leaf Area Ave. | P-Val. | % Incr. | RGR Of Roots Coverage Ave. | P-Val. | % Incr. |
|---|---|---|---|---|---|---|---|
| LAB536 | 65148.1 | 0 | 0.03 | 50 | 0.7 | 0.3 | 15 |
| LAB501 | 65966.3 | 0 | L | 65 | 0.8 | 0.02 | 38 |
| LAB490 | 65868.5 | 0 | 0.02 | 54 | 0.8 | 0.02 | 38 |
| CONT. | — | 0 | — | — | 0.6 | — | — |
| LAB602 | 65828.1 | — | — | — | 0.6 | 0.29 | 19 |
| LAB602 | 65828.2 | 0 | 0.12 | 53 | 0.7 | 0.02 | 49 |
| LAB602 | 65829.4 | 0 | 0.03 | 65 | 1 | L | 94 |
| LAB602 | 65831.1 | — | — | — | 0.6 | 0.19 | 26 |
| LAB598 | 66081.2 | — | — | — | 0.7 | 0.09 | 34 |
| LAB598 | 66081.5 | — | — | — | 0.6 | 0.24 | 26 |
| LAB592 | 65816.1 | 0 | 0.3 | 25 | 0.6 | 0.21 | 23 |
| LAB592 | 65817.1 | — | — | — | 0.6 | 0.23 | 22 |
| LAB543 | 65896.1 | 0 | 0.28 | 27 | 0.7 | 0.05 | 39 |
| LAB486 | 65853.5 | — | — | — | 0.6 | 0.16 | 29 |
| LAB486 | 65855.1 | — | — | — | 0.6 | 0.24 | 22 |
| LAB486 | 65855.3 | 0 | 0.26 | 28 | 0.9 | L | 74 |
| LAB486 | 65856.2 | — | — | — | 0.6 | 0.15 | 27 |
| LAB431 | 65945.1 | — | — | — | 0.8 | L | 53 |
| LAB431 | 65945.2 | — | — | — | 0.7 | 0.01 | 48 |
| CONT. | — | 0 | — | — | 0.5 | — | — |
| LAB602 | 65828.1 | 0.1 | L | 75 | 1.3 | 0.05 | 44 |
| LAB602 | 65828.2 | 0.1 | 0.21 | 33 | 1.2 | 0.16 | 31 |
| LAB598 | 66081.2 | 0.1 | 0.22 | 37 | — | — | — |
| LAB598 | 66081.5 | — | — | — | 1.1 | 0.26 | 24 |
| LAB592 | 65819.3 | 0.1 | 0.07 | 43 | 1.2 | 0.16 | 31 |

TABLE 82-continued

Genes showing improved plant performance and growth rate under osmotic stress conditions - assay 1 (T2 generation)

| Gene Name | Event # | RGR Of Leaf Area | | | RGR Of Roots Coverage | | |
|---|---|---|---|---|---|---|---|
| | | Ave. | P-Val. | % Incr. | Ave. | P-Val. | % Incr. |
| LAB592 | 65820.1 | 0.1 | 0.09 | 40 | 1.3 | 0.06 | 43 |
| LAB543 | 65895.1 | 0.1 | 0.16 | 37 | — | — | — |
| LAB543 | 65897.2 | 0.1 | 0.06 | 44 | 1.2 | 0.13 | 34 |
| LAB543 | 65898.1 | 0.1 | 0.2 | 33 | — | — | — |
| LAB486 | 65855.1 | 0.1 | 0.03 | 64 | 1.4 | 0.07 | 47 |
| LAB486 | 65855.3 | 0.1 | 0.05 | 54 | 1.1 | 0.24 | 24 |
| LAB463 | 65989.2 | 0.1 | 0.02 | 57 | 1.2 | 0.17 | 30 |
| LAB431 | 65944.3 | 0.1 | L | 72 | 1.4 | 0.03 | 48 |
| LAB431 | 65944.6 | 0.1 | L | 90 | — | — | — |
| LAB398 | 65912.6 | 0.1 | 0.1 | 39 | 1.1 | 0.27 | 23 |
| LAB398 | 65914.2 | 0.1 | 0.05 | 54 | 1.2 | 0.26 | 25 |
| CONT. | — | 0 | — | — | 0.9 | — | — |
| LAB591 | 65627.1 | 0.1 | 0.02 | 42 | — | — | — |
| LAB582 | 66267.1 | 0.1 | L | 101 | 1.5 | L | 45 |
| LAB582 | 66268.2 | 0.1 | 0.09 | 37 | 1.2 | 0.21 | 18 |
| LAB551 | 65813.5 | 0.1 | 0.21 | 37 | — | — | — |
| LAB499 | 66044.1 | 0.1 | L | 57 | 1.2 | 0.18 | 15 |
| LAB499 | 66047.1 | 0.1 | 0.22 | 22 | — | — | — |
| LAB499 | 66048.1 | 0.1 | L | 56 | 1.3 | 0.04 | 26 |
| LAB491 | 65858.3 | 0.1 | 0.05 | 46 | 1.1 | 0.29 | 14 |
| LAB491 | 65859.1 | 0.1 | L | 121 | 1.6 | L | 62 |
| LAB491 | 65859.5 | 0.1 | L | 86 | 1.6 | L | 62 |
| LAB491 | 65861.2 | 0.1 | L | 95 | 1.5 | L | 51 |
| LAB481 | 66200.3 | 0.1 | L | 53 | 1.3 | 0.01 | 28 |
| LAB481 | 66202.2 | 0.1 | 0.04 | 38 | 1.2 | 0.14 | 15 |
| LAB408 | 65933.2 | 0.1 | L | 65 | 1.3 | 0.03 | 32 |
| CONT. | — | 0.1 | — | — | 1 | — | — |

Table 82.
"CONT."—Control;
"Ave."—Average;
"% Incr." = % increment;
"p-val."—p-value;
L—p < 0.01.

TABLE 83

Genes showing improved plant performance and growth rate under high salinity conditions - assay 2 (T2 generation)

| Gene Name | Event # | RGR Of Leaf Area | | | Gene Name | Event # | RGR Of Roots Coverage | | |
|---|---|---|---|---|---|---|---|---|---|
| | | Ave. | P-Val. | % Incr. | | | Ave. | P-Val. | % Incr. |
| LAB587 | 66639.3 | 0 | 0.29 | 33 | LAB587 | 66639.3 | 0.6 | 0.03 | 44 |
| LAB561 | 66632.2 | — | — | — | LAB561 | 66632.2 | 0.5 | 0.22 | 23 |
| LAB533 | 66428.1 | — | — | — | LAB533 | 66428.1 | 0.5 | 0.21 | 23 |
| LAB500 | 66485.2 | 0.1 | 0.11 | 50 | LAB500 | 66485.2 | — | — | — |
| LAB478 | 66311.1 | — | — | — | LAB478 | 66311.1 | 0.6 | 0.1 | 31 |
| LAB397 | 66356.2 | — | — | — | LAB397 | 66356.2 | 0.6 | 0.09 | 35 |
| CONT. | — | 0 | — | — | CONT. | — | 0.4 | — | — |
| LAB608 | 65906.1 | — | — | — | LAB608 | 65906.1 | 0.5 | 0.1 | 28 |
| LAB608 | 65907.2 | 0.1 | 0.09 | 25 | LAB608 | 65907.2 | — | — | — |
| LAB608 | 65907.3 | — | — | — | LAB608 | 65907.3 | 0.5 | 0.11 | 25 |
| LAB608 | 65909.1 | — | — | — | LAB608 | 65909.1 | 0.5 | 0.09 | 27 |
| LAB608 | 65909.2 | 0 | 0.17 | 19 | LAB608 | 65909.2 | 0.5 | 0.27 | 19 |
| LAB578 | 65581.2 | — | — | — | LAB578 | 65581.2 | 0.5 | 0.1 | 28 |
| LAB578 | 65581.3 | — | — | — | LAB578 | 65581.3 | 0.6 | 0.02 | 39 |
| LAB523 | 65660.3 | 0 | 0.17 | 19 | LAB523 | 65660.3 | — | — | — |
| LAB523 | 65661.2 | 0.1 | 0.1 | 25 | LAB523 | 65661.2 | 0.5 | 0.14 | 26 |
| LAB512 | 66739.1 | — | — | — | LAB512 | 66739.1 | 0.6 | L | 49 |
| LAB512 | 66739.4 | 0.1 | 0.1 | 24 | LAB512 | 66739.4 | — | — | — |
| LAB488 | 66822.4 | — | — | — | LAB488 | 66822.4 | 0.6 | 0.03 | 38 |
| LAB449 | 65098.4 | — | — | — | LAB449 | 65098.4 | 0.5 | 0.1 | 29 |
| LAB449 | 65098.5 | 0.1 | 0.04 | 30 | LB449 | 65098.5 | — | — | — |
| LAB428 | 65079.2 | 0.1 | 0.08 | 27 | LAB428 | 65079.2 | 0.6 | 0.02 | 38 |
| LAB420 | 66836.3 | — | — | — | LAB420 | 66836.3 | 0.5 | 0.1 | 26 |
| LAB420 | 66837.1 | — | — | — | LAB420 | 66837.1 | 0.6 | 0.03 | 37 |
| LAB420 | 66838.2 | — | — | — | LAB420 | 66838.2 | 0.6 | 0.05 | 34 |
| CONT. | — | 0 | — | — | CONT. | — | 0.4 | — | — |
| LAB493 | 66476.2 | — | — | — | LAB493 | 66476.2 | 0.7 | 0.1 | 38 |
| CONT. | — | — | — | — | CONT. | — | 0.5 | — | — |
| LAB472 | 66717.5 | 0 | 0.24 | 13 | LAB472 | 66717.5 | — | — | — |
| LAB470 | 66627.3 | 0 | 0.29 | 13 | LAB470 | 66627.3 | 0.7 | 0.29 | 18 |
| LAB470 | 66630.1 | 0 | 0.29 | 12 | LAB470 | 66630.1 | 0.7 | 0.3 | 15 |
| LAB470 | 66630.4 | 0.1 | L | 48 | LAB470 | 66630.4 | 0.7 | 0.1 | 28 |
| LAB466 | 66620.4 | — | — | — | LAB466 | 66620.4 | 0.7 | 0.13 | 24 |
| LAB466 | 66621.2 | 0.1 | 0.03 | 33 | LAB466 | 66621.2 | 0.9 | L | 59 |
| LAB466 | 66622.4 | 0 | 0.26 | 13 | LAB466 | 66622.4 | 0.7 | 0.07 | 28 |
| LAB466 | 66622.5 | 0 | 0.18 | 16 | LAB466 | 66622.5 | 0.8 | L | 46 |
| LAB462 | 66617.1 | 0 | 0.29 | 15 | LAB462 | 66617.1 | — | — | — |
| LAB412 | 66698.2 | 0 | 0.11 | 18 | LAB412 | 66698.2 | — | — | — |
| LAB412 | 66699.2 | 0 | 0.22 | 17 | LAB412 | 66699.2 | 0.7 | 0.19 | 22 |
| LAB404 | 66778.2 | 0 | 0.22 | 14 | LAB404 | 66778.2 | — | — | — |
| LAB404 | 66779.1 | 0 | 0.13 | 21 | LAB404 | 66779.1 | 0.7 | 0.06 | 26 |

TABLE 83-continued

Genes showing improved plant performance and growth rate under high salinity conditions - assay 2 (T2 generation)

| | | RGR Of Leaf Area | | | | | RGR Of Roots Coverage | | |
|---|---|---|---|---|---|---|---|---|---|
| Gene Name | Event # | Ave. | P-Val. | % Incr. | Gene Name | Event # | Ave. | P-Val. | % Incr. |
| LAB404 | 66780.6 | — | — | — | LAB404 | 66780.6 | 0.7 | 0.12 | 21 |
| LAB403 | 66802.6 | 0 | 0.19 | 14 | LAB403 | 66802.6 | 0.8 | L | 41 |
| LAB403 | 66804.5 | — | — | — | LAB403 | 66804.5 | 0.8 | 0.02 | 34 |
| CONT. | — | 0 | — | — | CONT. | — | 0.6 | — | — |
| LAB516 | 65870.2 | — | — | — | LAB516 | 65870.2 | 0.7 | 0.04 | 52 |
| LAB516 | 65870.3 | — | — | — | LAB516 | 65870.3 | 0.6 | 0.28 | 23 |
| LAB516 | 65875.2 | — | — | — | LAB516 | 65875.2 | 0.7 | 0.05 | 44 |
| LAB511 | 66258.4 | 0 | 0.25 | 27 | LAB511 | 66258.4 | 0.8 | 0.01 | 59 |
| LAB506 | 65114.2 | — | — | — | LAB506 | 65114.2 | 0.7 | 0.05 | 43 |
| LAB506 | 65115.4 | 0 | 0.25 | 27 | LAB506 | 65115.4 | 0.6 | 0.23 | 25 |
| LAB475 | 67390.2 | 0 | 0.28 | 23 | LAB475 | 67390.2 | 0.7 | 0.04 | 51 |
| LAB475 | 67391.1 | — | — | — | LAB475 | 67391.1 | 0.7 | 0.03 | 51 |
| LAB475 | 67391.6 | — | — | — | LAB475 | 67391.6 | 0.6 | 0.17 | 29 |
| LAB471 | 66188.2 | — | — | — | LAB471 | 66188.2 | 0.6 | 0.1 | 34 |
| LAB471 | 66192.1 | 0 | 0.29 | 24 | LAB471 | 66192.1 | 0.6 | 0.27 | 27 |
| LAB459 | 67376.3 | 0 | 0.23 | 26 | LAB459 | 67376.3 | 0.6 | 0.18 | 30 |
| LAB459 | 67376.7 | — | — | — | LAB459 | 67376.7 | 0.6 | 0.11 | 35 |
| LAB457 | 65100.1 | 0.1 | 0.11 | 35 | LAB457 | 65100.1 | — | — | — |
| LAB457 | 65100.2 | — | — | — | LAB457 | 65100.2 | 0.7 | 0.05 | 43 |
| LAB457 | 65104.2 | 0 | 0.18 | 29 | LAB457 | 65104.2 | 0.7 | 0.03 | 51 |
| CONT. | — | 0 | — | — | CONT. | — | 0.5 | — | — |
| LAB586 | 65587.2 | 0.1 | 0.03 | 24 | LAB586 | 65587.2 | — | — | — |
| LAB479 | 66346.2 | — | — | — | LAB479 | 66346.2 | 0.7 | 0.06 | 35 |
| LAB478 | 66311.1 | 0.1 | 0.29 | 15 | LAB478 | 66311.1 | 0.6 | 0.21 | 23 |
| CONT. | — | 0.1 | — | — | CONT. | — | 0.5 | — | — |
| LAB597 | 66273.1 | — | — | — | LAB597 | 66273.1 | 0.6 | 0.16 | 24 |
| LAB559 | 66789.3 | — | — | — | LAB559 | 66789.3 | 0.7 | 0.02 | 40 |
| LAB559 | 66790.3 | — | — | — | LAB559 | 66790.3 | 0.6 | 0.27 | 20 |
| LAB489 | 66723.1 | — | — | — | LAB489 | 66723.1 | 0.7 | 0.03 | 40 |
| LAB489 | 66723.4 | — | — | — | LAB489 | 66723.4 | 0.6 | 0.06 | 31 |
| LAB480 | 66248.5 | — | — | — | LAB480 | 66248.5 | 0.7 | L | 57 |
| LAB480 | 66250.2 | — | — | — | LAB480 | 66250.2 | 0.6 | 0.07 | 28 |
| LAB480 | 66252.3 | — | — | — | LAB480 | 66252.3 | 0.7 | 0.01 | 46 |
| LAB447 | 66350.3 | — | — | — | LAB447 | 66350.3 | 0.6 | 0.09 | 29 |
| LAB447 | 66351.2 | — | — | — | LAB447 | 66351.2 | 0.6 | 0.17 | 24 |
| LAB419 | 66164.2 | — | — | — | LAB419 | 66164.2 | 0.6 | 0.06 | 35 |
| LAB419 | 66165.4 | — | — | — | LAB419 | 66165.4 | 0.6 | 0.18 | 22 |
| LAB408 | 65930.2 | — | — | — | LAB408 | 65930.2 | 0.7 | 0.02 | 48 |
| LAB408 | 65932.2 | — | — | — | LAB408 | 65932.2 | 0.6 | 0.03 | 35 |
| LAB408 | 65933.2 | 0.1 | 0.07 | 39 | LAB408 | 65933.2 | 0.6 | 0.13 | 25 |
| LAB407 | 66244.2 | — | — | — | LAB407 | 66244.2 | 0.6 | 0.28 | 19 |
| CONT. | — | 0 | — | — | CONT. | — | 0.5 | — | — |
| LAB582 | 66267.1 | — | — | — | LAB582 | 66267.1 | 0.6 | 0.12 | 24 |
| LAB551 | 65813.2 | — | — | — | LAB551 | 65813.2 | 0.6 | 0.07 | 25 |
| LAB538 | 66225.1 | 0.1 | 0.17 | 20 | LAB538 | 66225.1 | 0.6 | 0.03 | 40 |
| LAB499 | 66044.1 | — | — | — | LAB499 | 66044.1 | 0.5 | 0.24 | 17 |
| LAB499 | 66045.1 | — | — | — | LAB499 | 66045.1 | 0.6 | 0.23 | 23 |
| LAB499 | 66048.4 | — | — | — | LAB499 | 66048.4 | 0.6 | 0.15 | 22 |
| LAB491 | 65859.5 | — | — | — | LAB491 | 65859.5 | 0.6 | 0.07 | 35 |
| LAB491 | 65861.2 | — | — | — | LAB491 | 65861.2 | 0.6 | 0.03 | 31 |
| LAB491 | 65861.3 | — | — | — | LAB491 | 65861.3 | 0.6 | 0.02 | 38 |
| LAB408 | 65932.2 | — | — | — | LAB408 | 65932.2 | 0.5 | 0.2 | 16 |
| LAB395 | 66232.1 | — | — | — | LAB395 | 66232.1 | 0.5 | 0.25 | 15 |
| CONT. | — | 0.1 | — | — | CONT. | — | 0.5 | — | — |
| LAB604 | 66494.1 | 0.1 | 0.11 | 24 | LAB604 | 66494.1 | 0.6 | 0.27 | 14 |
| LAB604 | 66495.4 | — | — | — | LAB604 | 66495.4 | 0.6 | 0.27 | 14 |
| LAB575 | 66784.6 | 0.1 | 0.01 | 42 | LAB575 | 66784.6 | 0.6 | 0.05 | 25 |
| LAB519 | 66323.1 | — | — | — | LAB519 | 66323.1 | 0.6 | 0.2 | 17 |
| LAB446 | 65090.3 | 0 | 0.25 | 19 | LAB446 | 65090.3 | 0.6 | 0.27 | 19 |
| LAB446 | 65091.2 | — | — | — | LAB446 | 65091.2 | 0.6 | 0.13 | 18 |
| LAB439 | 65949.3 | — | — | — | LAB439 | 65949.3 | 0.6 | 0.22 | 19 |
| LAB439 | 65950.1 | 0 | 0.25 | 16 | LAB439 | 65950.1 | 0.6 | 0.03 | 28 |
| LAB439 | 65950.2 | 0.1 | 0.06 | 41 | LAB439 | 65950.2 | 0.7 | 0.05 | 50 |
| LAB438 | 66461.5 | — | — | — | LAB438 | 66461.5 | 0.6 | 0.17 | 20 |
| LAB427 | 65539.12 | — | — | — | LAB427 | 65539.12 | 0.6 | 0.09 | 24 |
| LAB427 | 65539.6 | — | — | — | LAB427 | 65539.6 | 0.6 | 0.19 | 15 |
| LAB418 | 66827.5 | 0 | 0.23 | 18 | LAB418 | 66827.5 | — | — | — |
| LAB396 | 65924.1 | — | — | — | LAB396 | 65924.1 | 0.7 | 0.02 | 33 |
| LAB396 | 65926.1 | 0.1 | 0.01 | 38 | LAB396 | 65926.1 | 0.6 | 0.15 | 22 |
| CONT. | — | 0 | — | — | CONT. | — | 0.5 | — | — |
| LAB603 | 66490.2 | — | — | — | LAB603 | 66490.2 | 0.6 | 0.14 | 33 |

TABLE 83-continued

Genes showing improved plant performance and growth rate under high salinity conditions - assay 2 (T2 generation)

| Gene Name | Event # | RGR Of Leaf Area | | | Gene Name | Event # | RGR Of Roots Coverage | | |
|---|---|---|---|---|---|---|---|---|---|
| | | Ave. | P-Val. | % Incr. | | | Ave. | P-Val. | % Incr. |
| LAB587 | 66638.2 | 0.1 | 0.05 | 30 | LAB587 | 66638.2 | 0.6 | 0.07 | 38 |
| LAB587 | 66639.3 | — | — | — | LAB587 | 66639.3 | 0.5 | 0.2 | 26 |
| LAB587 | 66639.4 | 0.1 | 0.09 | 27 | LAB587 | 66639.4 | 0.5 | 0.17 | 28 |
| LAB561 | 66632.3 | 0.1 | 0.06 | 29 | LAB561 | 66632.3 | 0.7 | L | 67 |
| LAB561 | 66633.2 | — | — | — | LAB561 | 66633.2 | 0.6 | 0.06 | 40 |
| LAB561 | 66633.3 | 0.1 | 0.21 | 24 | LAB561 | 66633.3 | — | — | — |
| LAB561 | 66634.1 | 0 | 0.28 | 18 | LAB561 | 66634.1 | 0.5 | 0.15 | 29 |
| LAB559 | 66790.3 | — | — | — | LAB559 | 66790.3 | 0.5 | 0.29 | 21 |
| LAB559 | 66791.2 | — | — | — | LAB559 | 66791.2 | 0.5 | 0.18 | 28 |
| LAB500 | 66482.8 | 0 | 0.22 | 22 | LAB500 | 66482.8 | 0.6 | 0.13 | 36 |
| LAB500 | 66485.2 | 0.1 | 0.1 | 26 | LAB500 | 66485.2 | 0.5 | 0.12 | 30 |
| LAB489 | 66722.2 | — | — | — | LAB489 | 66722.2 | 0.5 | 0.15 | 31 |
| LAB489 | 66723.1 | 0 | 0.18 | 21 | LAB489 | 66723.1 | 0.5 | 0.19 | 27 |
| LAB477 | 66574.1 | 0.1 | 0.07 | 30 | LAB477 | 66574.1 | 0.6 | 0.01 | 53 |
| LAB394 | 66562.3 | 0 | 0.19 | 22 | LAB394 | 66562.3 | 0.5 | 0.25 | 23 |
| LAB394 | 66565.1 | 0.1 | 0.01 | 45 | LAB394 | 66565.1 | 0.6 | 0.07 | 42 |
| CONT. | — | 0 | — | — | CONT. | — | 0.4 | — | — |
| LAB563 | 67029.4 | 0 | L | 44 | LAB563 | 67029.4 | 0.5 | L | 48 |
| LAB563 | 67032.4 | 0 | 0.08 | 22 | LAB563 | 67032.4 | — | — | — |
| LAB537 | 66329.2 | 0 | 0.11 | 23 | LAB537 | 66329.2 | — | — | — |
| LAB537 | 66330.4 | 0 | 0.25 | 17 | LAB537 | 66330.4 | — | — | — |
| LAB485 | 67022.2 | — | — | — | LAB485 | 67022.2 | 0.5 | 0.19 | 25 |
| LAB485 | 67023.1 | 0 | L | 39 | LAB485 | 67023.1 | 0.4 | 0.18 | 21 |
| LAB485 | 67024.1 | 0 | 0.23 | 17 | LAB485 | 67024.1 | 0.5 | 0.09 | 26 |
| LAB473 | 66873.1 | 0 | 0.05 | 26 | LAB473 | 66873.1 | — | — | — |
| LAB473 | 66873.3 | 0 | 0.08 | 23 | LAB473 | 66873.3 | — | — | — |
| LAB433 | 67034.3 | 0 | 0.12 | 21 | LAB433 | 67034.3 | — | — | — |
| LAB433 | 67036.4 | — | — | — | LAB433 | 67036.4 | 0.5 | 0.02 | 33 |
| LAB433 | 67038.5 | 0 | L | 35 | LAB433 | 67038.5 | — | — | — |
| LAB400 | 65509.1 | 0 | 0.27 | 16 | LAB400 | 65509.1 | 0.6 | L | 55 |
| LAB400 | 65510.1 | 0 | 0.29 | 15 | LAB400 | 65510.1 | — | — | — |
| LAB400 | 65511.2 | 0 | 0.03 | 38 | LAB400 | 65511.2 | 0.5 | L | 45 |
| LAB393 | 66285.4 | 0 | 0.22 | 20 | LAB393 | 66285.4 | 0.5 | 0.06 | 27 |
| LAB393 | 66287.2 | 0 | 0.17 | 17 | LAB393 | 66287.2 | — | — | — |
| LAB393 | 66288.2 | 0 | 0.25 | 20 | LAB393 | 66288.2 | — | — | — |
| LAB390 | 67016.2 | — | — | — | LAB390 | 67016.2 | 0.4 | 0.16 | 22 |
| LAB390 | 67017.2 | 0 | 0.02 | 32 | LAB390 | 67017.2 | — | — | — |
| LAB390 | 67017.4 | 0 | L | 42 | LAB390 | 67017.4 | 0.5 | 0.08 | 38 |
| LAB390 | 67020.3 | 0 | 0.05 | 26 | LAB390 | 67020.3 | — | — | — |
| CONT. | — | 0 | — | — | CONT. | — | 0.4 | — | — |
| LAB610 | 65342.3 | 0.1 | L | 34 | LAB610 | 65342.3 | — | — | — |
| LAB595 | 65270.2 | 0.1 | L | 41 | LAB595 | 65270.2 | 0.5 | 0.25 | 21 |
| LAB595 | 65270.3 | — | — | — | LAB595 | 65270.3 | 0.5 | 0.17 | 24 |
| LAB595 | 65273.2 | 0 | 0.22 | 13 | LAB595 | 65273.2 | — | — | — |
| LAB577 | 65578.4 | — | — | — | LAB577 | 65578.4 | 0.4 | 0.26 | 18 |
| LAB562 | 65614.4 | 0 | 0.25 | 16 | LAB562 | 65614.4 | 0.5 | 0.09 | 29 |
| LAB459 | 67379.3 | — | — | — | LAB459 | 67379.3 | 0.5 | 0.19 | 23 |
| LAB423 | 65527.1 | — | — | — | LAB423 | 65527.1 | 0.5 | 0.05 | 38 |
| LAB423 | 65527.3 | — | — | — | LAB423 | 65527.3 | 0.5 | 0.21 | 20 |
| CONT. | — | 0 | — | — | CONT. | — | 0.4 | — | — |
| LAB572 | 66117.2 | 0.1 | L | 38 | LAB572 | 66117.2 | — | — | — |
| LAB572 | 66117.3 | 0 | 0.07 | 22 | LAB572 | 66117.3 | — | — | — |
| LAB569 | 65257.4 | 0.1 | L | 50 | LAB569 | 65257.4 | — | — | — |
| LAB569 | 65260.8 | 0 | 0.19 | 18 | LAB569 | 65260.8 | — | — | — |
| LAB567 | 66068.1 | 0.1 | L | 39 | LAB567 | 66068.1 | — | — | — |
| LAB567 | 66068.3 | 0.1 | L | 33 | LAB567 | 66068.3 | 0.6 | 0.13 | 31 |
| LAB567 | 66072.4 | 0.1 | 0.01 | 35 | LAB567 | 66072.4 | — | — | — |
| LAB548 | 65703.4 | 0.1 | L | 40 | LAB548 | 65703.4 | — | — | — |
| LAB526 | 65666.2 | 0 | 0.13 | 21 | LAB526 | 65666.2 | — | — | — |
| LAB526 | 65667.3 | 0 | 0.1 | 26 | LAB526 | 65667.3 | — | — | — |
| LAB526 | 65669.2 | 0 | 0.23 | 17 | LAB526 | 65669.2 | — | — | — |
| LAB526 | 65669.4 | 0 | 0.09 | 23 | LAB526 | 65669.4 | — | — | — |
| LAB518 | 66024.4 | 0 | 0.26 | 15 | LAB518 | 66024.4 | — | — | — |
| LAB467 | 66132.3 | 0 | 0.12 | 24 | LAB467 | 66132.3 | — | — | — |
| CONT. | — | 0 | — | — | CONT. | — | 0.5 | — | — |
| LAB563 | 67029.2 | 0 | 0.24 | 24 | LAB563 | 67029.2 | — | — | — |
| LAB524 | 65135.1 | 0 | 0.06 | 35 | LAB524 | 65135.1 | 0.5 | 0.05 | 49 |
| LAB524 | 65136.4 | 0 | 0.13 | 31 | LAB524 | 65136.4 | — | — | — |
| LAB485 | 67022.2 | 0 | 0.28 | 21 | LAB485 | 67022.2 | — | — | — |
| LAB485 | 67024.2 | 0 | 0.24 | 22 | LAB485 | 67024.2 | — | — | — |
| LAB473 | 66873.1 | 0 | 0.08 | 36 | LAB473 | 66873.1 | 0.4 | 0.13 | 28 |

TABLE 83-continued

Genes showing improved plant performance and growth rate under high salinity conditions - assay 2 (T2 generation)

| | | RGR Of Leaf Area | | | | | RGR Of Roots Coverage | | |
|---|---|---|---|---|---|---|---|---|---|
| Gene Name | Event # | Ave. | P-Val. | % Incr. | Gene Name | Event # | Ave. | P-Val. | % Incr. |
| LAB473 | 66874.2 | 0 | 0.3 | 19 | LAB473 | 66874.2 | 0.4 | 0.27 | 20 |
| LAB473 | 66875.1 | 0 | 0.2 | 30 | LAB473 | 66875.1 | 0.5 | 0.03 | 48 |
| LAB433 | 67036.3 | 0 | 0.15 | 26 | LAB433 | 67036.3 | 0.5 | 0.07 | 36 |
| LAB433 | 67036.4 | — | — | — | LAB433 | 67036.4 | 0.4 | 0.29 | 20 |
| LAB390 | 67020.3 | — | — | — | LAB390 | 67020.3 | 0.4 | 0.17 | 26 |
| CONT. | — | 0 | — | — | CONT. | — | 0.3 | — | — |
| LAB508 | 66729.2 | 0 | 0.27 | 10 | LAB508 | 66729.2 | — | — | — |
| LAB476 | 66305.1 | 0.1 | 0.05 | 19 | LAB476 | 66305.1 | — | — | — |
| LAB476 | 66306.6 | 0.1 | 0.12 | 20 | LAB476 | 66306.6 | 0.6 | 0.3 | 14 |
| LAB476 | 66307.2 | 0.1 | 0.02 | 21 | LAB476 | 66307.2 | 0.7 | 0.05 | 33 |
| LAB424 | 66713.2 | 0 | 0.3 | 9 | LAB424 | 66713.2 | — | — | — |
| LAB422 | 65936.2 | 0.1 | 0.09 | 15 | LAB422 | 65936.2 | 0.6 | 0.16 | 19 |
| LAB422 | 65937.4 | — | — | — | LAB422 | 65937.4 | 0.6 | 0.14 | 21 |
| LAB422 | 65938.3 | 0.1 | 0.21 | 14 | LAB422 | 65938.3 | 0.7 | 0.03 | 32 |
| LAB418 | 66826.2 | 0.1 | 0.1 | 19 | LAB418 | 66826.2 | — | — | — |
| LAB412 | 66699.2 | — | — | — | LAB412 | 66699.2 | 0.6 | 0.08 | 25 |
| CONT. | — | 0 | — | — | CONT. | — | 0.5 | — | — |
| LAB607 | 65335.2 | — | — | — | LAB607 | 65335.2 | 0.3 | 0.04 | 55 |
| LAB607 | 65335.3 | — | — | — | LAB607 | 65335.3 | 0.3 | 0.11 | 35 |
| LAB600 | 65718.2 | 0 | 0.09 | 24 | LAB600 | 65718.2 | 0.4 | L | 81 |
| LAB600 | 65719.3 | 0 | 0.28 | 17 | LAB600 | 65719.3 | 0.3 | 0.1 | 37 |
| LAB542 | 65888.3 | — | — | — | LAB542 | 65888.3 | 0.3 | 0.12 | 37 |
| LAB542 | 65888.6 | 0 | 0.16 | 24 | LAB542 | 65888.6 | 0.3 | L | 74 |
| LAB542 | 65892.6 | 0 | 0.02 | 35 | LAB542 | 65892.6 | — | — | — |
| LAB536 | 65148.4 | — | — | — | LAB536 | 65148.4 | 0.2 | 0.24 | 25 |
| LAB501 | 65966.3 | — | — | — | LAB501 | 65966.3 | 0.3 | 0.17 | 33 |
| LAB501 | 65968.3 | — | — | — | LAB501 | 65968.3 | 0.3 | 0.24 | 28 |
| LAB501 | 65969.1 | — | — | — | LAB501 | 65969.1 | 0.4 | L | 86 |
| LAB501 | 65970.1 | 0 | L | 49 | LAB501 | 65970.1 | 0.4 | L | 97 |
| LAB490 | 65864.1 | — | — | — | LAB490 | 65864.1 | 0.3 | 0.07 | 46 |
| LAB490 | 65868.3 | — | — | — | LAB490 | 65868.3 | 0.4 | L | 79 |
| LAB490 | 65868.5 | 0 | 0.05 | 29 | LAB490 | 65868.5 | 0.4 | 0.02 | 84 |
| LAB482 | 66830.1 | — | — | — | LAB482 | 66830.1 | 0.4 | L | 81 |
| LAB451 | 66704.3 | — | — | — | LAB451 | 66704.3 | 0.3 | 0.09 | 43 |
| LAB451 | 66704.5 | 0 | 0.21 | 18 | LAB451 | 66704.5 | 0.3 | L | 75 |
| LAB451 | 66707.5 | — | — | — | LAB451 | 66707.5 | 0.3 | 0.13 | 40 |
| LAB445 | 66466.1 | — | — | — | LAB445 | 66466.1 | 0.3 | 0.23 | 33 |
| LAB445 | 66467.4 | — | — | — | LAB445 | 66467.4 | 0.3 | 0.09 | 41 |
| LAB445 | 66468.1 | — | — | — | LAB445 | 66468.1 | 0.2 | 0.23 | 27 |
| CONT. | — | 0 | — | — | CONT. | — | 0.2 | — | — |
| LAB488 | 66819.1 | 0.1 | 0.28 | 13 | LAB488 | 66819.1 | — | — | — |
| LAB451 | 66704.3 | 0.1 | 0.21 | 14 | LAB451 | 66704.3 | — | — | — |
| LAB451 | 66707.5 | 0.1 | 0.1 | 19 | LAB451 | 66707.5 | — | — | — |
| LAB445 | 66464.3 | — | — | — | LAB445 | 66464.3 | 0.7 | 0.28 | 14 |
| LAB445 | 66468.1 | 0.1 | L | 30 | LAB445 | 66468.1 | — | — | — |
| CONT. | — | 0 | — | — | CONT. | — | 0.6 | — | — |

Table 83.
"CONT."—Control;
"Ave."—Average;
"% Incr." = % increment;
"p-val."—p-value.
L—p < 0.01.

TABLE 84

Genes showing improved plant performance and growth rate under osmotic stress conditions - assay 1 (T2 generation)

| | | RGR Of Roots Length | | |
|---|---|---|---|---|
| Gene Name | Event # | Ave. | P-Val. | % Incr. |
| LAB607 | 65335.1 | 0.7 | 0.19 | 13 |
| LAB607 | 65336.1 | 0.7 | 0.22 | 10 |
| LAB600 | 65718.2 | 0.7 | 0.18 | 12 |
| LAB600 | 65719.3 | 0.7 | 0.01 | 23 |
| LAB536 | 65149.3 | 0.7 | 0.16 | 13 |
| LAB501 | 65966.3 | 0.7 | 0.08 | 15 |
| LAB490 | 65868.5 | 0.7 | 0.1 | 15 |
| CONT. | — | 0.6 | — | — |
| LAB602 | 65828.1 | 0.6 | 0.24 | 15 |
| LAB602 | 65828.2 | 0.7 | L | 38 |

TABLE 84-continued

Genes showing improved plant performance and growth rate under osmotic stress conditions - assay 1 (T2 generation)

| Gene Name | Event # | RGR Of Roots Length | | |
|---|---|---|---|---|
| | | Ave. | P-Val. | % Incr. |
| LAB602 | 65829.4 | 0.7 | L | 36 |
| LAB602 | 65831.1 | 0.6 | 0.05 | 27 |
| LAB598 | 66080.4 | 0.6 | 0.17 | 20 |
| LAB598 | 66081.2 | 0.6 | 0.03 | 29 |
| LAB598 | 66081.5 | 0.6 | 0.12 | 24 |
| LAB598 | 66082.2 | 0.6 | 0.17 | 21 |
| LAB592 | 65816.1 | 0.6 | 0.03 | 27 |
| LAB592 | 65820.1 | 0.6 | 0.18 | 17 |
| LAB543 | 65894.1 | 0.6 | 0.12 | 21 |
| LAB543 | 65895.1 | 0.6 | 0.21 | 17 |
| LAB543 | 65896.1 | 0.6 | 0.07 | 26 |
| LAB543 | 65897.2 | 0.6 | 0.21 | 17 |
| LAB543 | 65898.1 | 0.6 | 0.2 | 18 |
| LAB486 | 65853.5 | 0.6 | 0.05 | 30 |
| LAB486 | 65855.1 | 0.6 | 0.15 | 20 |
| LAB486 | 65855.3 | 0.7 | L | 43 |
| LAB486 | 65856.2 | 0.7 | L | 43 |
| LAB431 | 65943.5 | 0.6 | 0.09 | 22 |
| LAB431 | 65944.6 | 0.6 | 0.1 | 21 |
| LAB431 | 65945.1 | 0.7 | L | 43 |
| LAB431 | 65945.2 | 0.7 | L | 51 |
| CONT. | — | 0.5 | — | — |
| LAB612 | 66282.4 | 0.8 | 0.24 | 14 |
| LAB602 | 65828.1 | 0.8 | 0.23 | 13 |
| LAB602 | 65828.2 | 0.8 | 0.22 | 15 |
| LAB592 | 65819.3 | 0.8 | 0.13 | 17 |
| LAB592 | 65820.1 | 0.9 | 0.06 | 23 |
| LAB543 | 65897.2 | 0.8 | 0.19 | 14 |
| LAB486 | 65855.1 | 0.9 | 0.11 | 19 |
| LAB486 | 65856.2 | 0.8 | 0.24 | 15 |
| LAB431 | 65944.3 | 0.8 | 0.17 | 16 |
| LAB398 | 65912.6 | 0.9 | 0.04 | 24 |
| LAB398 | 65913.3 | 0.9 | 0.1 | 20 |
| LAB398 | 65914.2 | 0.8 | 0.2 | 15 |
| CONT. | — | 0.7 | — | — |
| LAB582 | 66267.1 | 0.8 | 0.22 | 11 |
| LAB582 | 66268.2 | 0.8 | 0.15 | 13 |
| LAB582 | 66270.1 | 0.8 | 0.28 | 8 |
| LAB499 | 66044.1 | 0.8 | 0.24 | 11 |
| LAB499 | 66047.1 | 0.8 | 0.09 | 13 |
| LAB499 | 66048.1 | 0.8 | 0.24 | 10 |
| LAB491 | 65859.1 | 0.8 | 0.2 | 13 |
| LAB491 | 65859.5 | 0.9 | L | 25 |
| LAB491 | 65861.2 | 0.8 | 0.11 | 13 |
| LAB481 | 66200.3 | 0.8 | 0.11 | 15 |
| LAB408 | 65933.2 | 0.8 | 0.22 | 11 |
| LAB395 | 66232.1 | 0.8 | 0.23 | 10 |
| CONT. | — | 0.7 | — | — |

Table 84.
"CONT."—Control;
"Ave."—Average;
"% Incr." = % increment;
"p-val."—p-value;
L-p < 0.01.

TABLE 85

Genes showing improved plant performance and growth rate under high salinity conditions - assay 2 (T2 generation)

| Gene Name | Event # | RGR Of Roots Length | | |
|---|---|---|---|---|
| | | Ave. | P-Val. | % Incr. |
| LAB603 | 66488.2 | 0.4 | 0.1 | 24 |
| LAB587 | 66638.1 | 0.4 | 0.04 | 32 |
| LAB587 | 66639.3 | 0.4 | 0.15 | 23 |
| LAB587 | 66639.4 | 0.3 | 0.27 | 18 |
| LAB587 | 66641.2 | 0.4 | 0.05 | 29 |
| LAB561 | 66634.1 | 0.4 | 0.18 | 21 |
| LAB533 | 66429.1 | 0.4 | 0.08 | 29 |
| LAB500 | 66482.8 | 0.4 | 0.22 | 19 |
| LAB500 | 66484.1 | 0.3 | 0.21 | 19 |
| LAB478 | 66310.5 | 0.4 | 0.12 | 24 |
| LAB397 | 66356.2 | 0.3 | 0.25 | 17 |
| CONT. | — | 0.3 | — | — |
| LAB608 | 65906.1 | 0.4 | 0.17 | 18 |
| LAB608 | 65909.2 | 0.4 | 0.04 | 26 |
| LAB523 | 65663.5 | 0.4 | 0.08 | 22 |
| LAB512 | 66734.5 | 0.4 | 0.07 | 24 |
| LAB512 | 66739.1 | 0.4 | 0.14 | 19 |
| LAB488 | 66822.4 | 0.4 | 0.12 | 21 |
| LAB450 | 65305.3 | 0.4 | 0.18 | 20 |
| LAB450 | 65309.1 | 0.4 | 0.12 | 22 |
| LAB449 | 65098.4 | 0.4 | 0.07 | 25 |
| LAB428 | 65078.2 | 0.4 | 0.21 | 16 |
| LAB428 | 65079.2 | 0.4 | 0.07 | 23 |
| LAB428 | 65082.3 | 0.4 | 0.19 | 18 |
| LAB420 | 66837.1 | 0.4 | 0.19 | 21 |
| LAB420 | 66838.2 | 0.4 | 0.09 | 22 |
| CONT. | — | 0.4 | — | — |
| LAB586 | 65588.2 | 0.4 | 0.25 | 16 |
| LAB472 | 66717.5 | 0.4 | 0.12 | 20 |
| LAB466 | 66621.2 | 0.5 | 0.1 | 24 |
| LAB466 | 66622.2 | 0.5 | 0.03 | 28 |
| LAB466 | 66622.5 | 0.4 | 0.2 | 17 |
| LAB454 | 66815.1 | 0.4 | 0.12 | 20 |
| LAB404 | 66780.6 | 0.4 | 0.18 | 17 |
| LAB403 | 66802.6 | 0.4 | 0.25 | 14 |
| LAB516 | 65870.2 | 0.4 | 0.14 | 25 |
| LAB516 | 65870.3 | 0.4 | 0.02 | 36 |
| LAB516 | 65871.3 | 0.4 | 0.13 | 24 |
| LAB516 | 65874.3 | 0.4 | 0.2 | 19 |
| LAB516 | 65875.2 | 0.5 | L | 47 |
| LAB511 | 66258.4 | 0.4 | 0.03 | 33 |
| LAB506 | 65111.4 | 0.4 | 0.14 | 21 |
| LAB506 | 65111.7 | 0.4 | 0.06 | 29 |
| LAB506 | 65114.2 | 0.4 | 0.02 | 35 |
| LAB506 | 65115.4 | 0.4 | 0.04 | 32 |
| LAB475 | 67390.1 | 0.4 | 0.2 | 19 |
| LAB475 | 67390.2 | 0.4 | 0.05 | 32 |
| LAB475 | 67391.1 | 0.4 | 0.1 | 25 |
| LAB475 | 67391.6 | 0.4 | 0.03 | 36 |
| LAB474 | 66470.4 | 0.4 | 0.12 | 26 |
| LAB474 | 66475.3 | 0.4 | 0.08 | 27 |
| LAB471 | 66188.2 | 0.4 | 0.05 | 30 |
| LAB471 | 66191.2 | 0.4 | 0.06 | 29 |
| LAB471 | 66192.1 | 0.4 | 0.22 | 24 |
| LAB459 | 67376.3 | 0.4 | 0.05 | 31 |
| LAB459 | 67376.7 | 0.4 | 0.12 | 23 |
| LAB459 | 67380.1 | 0.4 | 0.14 | 25 |
| LAB457 | 65100.2 | 0.4 | 0.05 | 29 |
| LAB457 | 65104.2 | 0.4 | 0.02 | 37 |
| LAB435 | 67374.1 | 0.4 | 0.03 | 35 |
| LAB435 | 67374.3 | 0.4 | 0.14 | 22 |
| CONT. | — | 0.3 | — | — |
| LAB537 | 66330.6 | 0.4 | 0.29 | 14 |
| LAB487 | 66502.4 | 0.4 | 0.2 | 17 |
| LAB479 | 66346.2 | 0.4 | 0.21 | 16 |
| CONT. | — | 0.4 | — | — |
| LAB597 | 66272.3 | 0.4 | 0.14 | 21 |
| LAB597 | 66273.2 | 0.4 | 0.29 | 15 |
| LAB559 | 66789.3 | 0.4 | 0.21 | 19 |
| LAB489 | 66723.1 | 0.4 | 0.29 | 19 |
| LAB480 | 66248.5 | 0.4 | 0.16 | 22 |
| LAB480 | 66252.3 | 0.4 | 0.18 | 20 |
| LAB447 | 66351.2 | 0.4 | 0.3 | 15 |
| LAB394 | 66561.2 | 0.4 | 0.27 | 16 |
| CONT. | — | 0.4 | — | — |
| LAB582 | 66267.1 | 0.4 | 0.26 | 12 |
| CONT. | — | 0.4 | — | — |
| LAB575 | 66784.6 | 0.5 | 0.11 | 16 |

TABLE 85-continued

Genes showing improved plant performance and growth rate under high salinity conditions - assay 2 (T2 generation)

| Gene Name | Event # | RGR Of Roots Length Ave. | P-Val. | % Incr. |
|---|---|---|---|---|
| LAB439 | 65950.2 | 0.5 | 0.23 | 19 |
| LAB418 | 66827.5 | 0.4 | 0.17 | 14 |
| CONT. | — | 0.4 | — | — |
| LAB587 | 66638.2 | 0.5 | 0.08 | 28 |
| LAB561 | 66632.3 | 0.5 | 0.2 | 22 |
| LAB561 | 66633.2 | 0.5 | 0.21 | 19 |
| LAB561 | 66634.1 | 0.5 | 0.14 | 23 |
| LAB500 | 66484.1 | 0.5 | 0.21 | 20 |
| LAB500 | 66485.2 | 0.5 | 0.05 | 30 |
| LAB489 | 66722.2 | 0.5 | 0.13 | 24 |
| LAB477 | 66574.1 | 0.5 | 0.18 | 21 |
| LAB394 | 66562.3 | 0.4 | 0.27 | 17 |
| CONT. | — | 0.4 | — | — |
| LAB611 | 65997.9 | 0.4 | 0.19 | 25 |
| LAB563 | 67029.4 | 0.4 | 0.25 | 22 |
| LAB537 | 66329.2 | 0.4 | 0.16 | 27 |
| LAB485 | 67023.1 | 0.4 | 0.18 | 26 |
| LAB485 | 67024.2 | 0.4 | 0.3 | 20 |
| LAB485 | 67026.2 | 0.4 | 0.13 | 30 |
| LAB473 | 66873.1 | 0.4 | 0.15 | 27 |
| LAB473 | 66873.3 | 0.4 | 0.24 | 22 |
| LAB473 | 66874.1 | 0.4 | 0.22 | 24 |
| LAB433 | 67038.5 | 0.4 | 0.25 | 22 |
| LAB400 | 65509.1 | 0.4 | 0.15 | 28 |
| LAB400 | 65511.2 | 0.4 | 0.11 | 32 |
| LAB393 | 66285.4 | 0.4 | 0.27 | 22 |
| LAB390 | 67016.2 | 0.4 | 0.12 | 30 |
| LAB390 | 67017.2 | 0.4 | 0.3 | 22 |
| LAB390 | 67017.4 | 0.4 | 0.13 | 32 |
| CONT. | — | 0.3 | — | — |
| LAB595 | 65270.3 | 0.4 | 0.12 | 21 |
| LAB577 | 65578.4 | 0.4 | 0.15 | 20 |
| LAB423 | 65527.1 | 0.4 | 0.08 | 24 |
| LAB423 | 65527.3 | 0.4 | 0.04 | 27 |
| CONT. | — | 0.3 | — | — |
| LAB563 | 67029.2 | 0.4 | 0.18 | 25 |
| LAB524 | 65135.1 | 0.4 | 0.1 | 28 |
| LAB524 | 65136.4 | 0.3 | 0.2 | 22 |
| LAB512 | 66739.1 | 0.3 | 0.22 | 21 |
| LAB485 | 67023.1 | 0.4 | 0.15 | 27 |
| LAB485 | 67026.2 | 0.4 | 0.16 | 26 |
| LAB473 | 66873.1 | 0.4 | 0.03 | 36 |
| LAB473 | 66874.2 | 0.4 | 0.06 | 33 |
| LAB473 | 66875.1 | 0.4 | 0.17 | 24 |
| LAB433 | 67036.3 | 0.4 | 0.1 | 27 |
| LAB433 | 67036.4 | 0.4 | 0.17 | 24 |
| LAB433 | 67038.5 | 0.3 | 0.19 | 22 |
| CONT. | — | 0.3 | — | — |
| LAB476 | 66307.2 | 0.4 | 0.27 | 13 |
| CONT. | — | 0.4 | — | — |
| LAB607 | 65335.2 | 0.3 | 0.19 | 24 |
| LAB600 | 65718.2 | 0.4 | L | 56 |
| LAB600 | 65719.3 | 0.3 | 0.14 | 26 |
| LAB542 | 65888.2 | 0.3 | 0.13 | 27 |
| LAB542 | 65888.3 | 0.3 | 0.03 | 44 |
| LAB542 | 65888.6 | 0.4 | L | 50 |
| LAB536 | 65148.1 | 0.3 | 0.18 | 23 |
| LAB536 | 65148.4 | 0.3 | 0.09 | 29 |
| LAB501 | 65966.3 | 0.4 | L | 54 |
| LAB501 | 65968.3 | 0.3 | 0.04 | 35 |
| LAB501 | 65969.1 | 0.3 | 0.03 | 40 |
| LAB501 | 65970.1 | 0.3 | 0.03 | 39 |
| LAB501 | 65970.2 | 0.3 | 0.23 | 25 |
| LAB490 | 65864.1 | 0.3 | 0.16 | 27 |
| LAB490 | 65868.3 | 0.3 | 0.03 | 46 |
| LAB490 | 65868.5 | 0.4 | 0.08 | 49 |
| LAB482 | 66830.1 | 0.3 | 0.17 | 26 |
| LAB482 | 66834.3 | 0.3 | 0.23 | 20 |
| LAB451 | 66704.5 | 0.3 | 0.21 | 22 |
| LAB445 | 66467.4 | 0.3 | 0.04 | 40 |
| LAB445 | 66468.1 | 0.3 | 0.11 | 27 |
| CONT. | — | 0.2 | — | — |

Table 85.
"CONT."—Control;
"Ave."—Average;
"% Incr." = % increment;
"p-val."—p-value;
L—p < 0.01.

TABLE 86

Genes showing improved plant performance and growth rate under high salinity conditions - assay 2 (T1 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB448 | — | 0 | 0.16 | 17 | LAB448 | — | — | — | — |
| LAB391 | — | 0 | 0.29 | 13 | LAB391 | — | — | — | — |
| CONT. | — | 0 | — | — | CONT. | — | — | — | — |
| LAB415 | — | — | — | — | LAB415 | — | 0.6 | 0.27 | 14 |
| CONT. | — | — | — | — | CONT. | — | 0.5 | — | — |

Table 86.
"CONT."—Control;
"Ave."—Average;
"% Incr." = % increment;
"p-val."—p-value;
L—p < 0.01.

TABLE 87

Genes showing improved plant performance and growth rate under high salinity conditions - assay 2 (T1 generation)

| | | RGR Of Roots Length | | |
|---|---|---|---|---|
| Gene Name | Event # | Average | p-value | % |
| LAB469 | | 0.5 | 0.21 | 10 |
| LAB435 | | 0.5 | 0.22 | 9 |
| LAB417 | | 0.5 | 0.09 | 13 |
| CONT. | | 0.5 | — | — |

Table 87.
"CONT."—Control;
"Ave."—Average;
"% Incr." = % increment;
"p-val."—p-value;
L—p < 0.01.

The genes listed in Tables 88-91 improved plant biomass when grown at standard conditions. These genes produced larger plant biomass (plant fresh and dry weight and leaf area) when grown under standard conditions, compared to control plants. Larger plant biomass under this growth conditions indicates the high ability of the plant to better metabolize the nutrients present in the medium. The genes were cloned under the regulation of a constitutive promoter (At6669; SEQ ID NO:7724). The evaluation of each gene was performed by testing the performance of different number of events. Some of the genes were evaluated in more than one tissue culture assay and the results obtained where positive as well. Event with p-value <0.1 was considered statistically significant.

TABLE 88

Genes showing improved plant performance at standard growth conditions (T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| LAB607 | 65335.1 | 119.8 | 0.03 | 87 | LAB607 | 65335.1 | 7 | 0.04 | 75 |
| LAB607 | 65336.1 | 78.1 | 0.22 | 22 | LAB607 | 65336.1 | 4.8 | 0.23 | 21 |
| LAB600 | 65717.5 | 93.3 | 0.05 | 45 | LAB600 | 65717.5 | 5.2 | 0.23 | 29 |
| LAB600 | 65718.2 | 90.5 | 0.04 | 41 | LAB600 | 65718.2 | 5.1 | 0.13 | 28 |
| LAB600 | 65719.3 | 109.9 | L | 71 | LAB600 | 65719.3 | 6.3 | L | 58 |
| LAB542 | 65888.2 | 91.5 | 0.03 | 43 | LAB542 | 65888.2 | 5.3 | 0.09 | 32 |
| LAB536 | 65148.1 | 99.9 | 0.02 | 56 | LAB536 | 65148.1 | 5.1 | 0.22 | 28 |
| LAB501 | 65966.3 | 98.6 | 0.02 | 54 | LAB501 | 65966.3 | 6 | 0.02 | 50 |
| CONT. | — | 64.2 | — | — | CONT. | — | 4 | — | — |
| LAB591 | 65624.1 | — | — | — | LAB591 | 65624.1 | 8.6 | 0.19 | 13 |
| LAB591 | 65624.4 | 153.2 | 0.11 | 13 | LAB591 | 65624.4 | 9.3 | 0.09 | 22 |
| LAB591 | 65627.1 | 169.3 | 0.1 | 25 | LAB591 | 65627.1 | 10.2 | 0.02 | 34 |
| LAB582 | 66267.1 | 230.8 | 0.16 | 71 | LAB582 | 66267.1 | 12.4 | 0.1 | 63 |
| LAB551 | 65813.2 | 166.8 | 0.15 | 23 | LAB551 | 65813.2 | 9 | 0.29 | 19 |
| LAB551 | 65813.5 | 221.6 | 0.28 | 64 | LAB551 | 65813.5 | 11.4 | 0.23 | 50 |
| LAB538 | 66225.1 | 171.1 | 0.16 | 27 | LAB538 | 66225.1 | 10.1 | 0.16 | 33 |
| LAB499 | 66044.1 | — | — | — | LAB499 | 66044.1 | 9.5 | 0.15 | 25 |
| LAB499 | 66047.1 | 171.9 | 0.3 | 27 | LAB499 | 66047.1 | — | — | — |
| LAB499 | 66048.1 | 180.5 | 0.14 | 34 | LAB499 | 66048.1 | 9.7 | 0.05 | 28 |
| LAB491 | 65858.3 | 171.3 | 0.04 | 27 | LAB491 | 65858.3 | 10.3 | L | 35 |
| LAB491 | 65859.1 | 267.1 | 0.05 | 98 | LAB491 | 65859.1 | 15.8 | 0.05 | 108 |
| LAB491 | 65859.5 | 227.5 | L | 68 | LAB491 | 65859.5 | 12.5 | 0.04 | 65 |
| LAB491 | 65861.2 | 280.2 | 0.01 | 107 | LAB491 | 65861.2 | 16.6 | L | 118 |
| LAB481 | 66202.2 | 211.2 | L | 56 | LAB481 | 66202.2 | 12.3 | L | 62 |
| LAB408 | 65930.4 | 166.6 | L | 23 | LAB408 | 65930.4 | 9.4 | 0.01 | 24 |
| LAB408 | 65932.2 | 144.5 | 0.29 | 7 | LAB408 | 65932.2 | 8.7 | 0.12 | 14 |
| LAB408 | 65933.1 | 179.9 | 0.14 | 33 | LAB408 | 65933.1 | 9.7 | 0.25 | 27 |
| LAB408 | 65933.2 | 207.9 | 0.17 | 54 | LAB408 | 65933.2 | 11.7 | 0.2 | 53 |
| LAB395 | 66234.1 | 204.6 | 0.01 | 51 | LAB395 | 66234.1 | 12.1 | L | 60 |
| CONT. | — | 135.1 | — | — | CONT. | — | 7.6 | — | — |
| LAB603 | 66489.1 | 161.7 | 0.17 | 40 | LAB603 | 66489.1 | 8.8 | 0.22 | 40 |
| LAB587 | 66638.1 | 158.6 | 0.13 | 38 | LAB587 | 66638.1 | 8.8 | 0.07 | 41 |
| LAB587 | 66638.2 | 146 | 0.04 | 27 | LAB587 | 66638.2 | 7.7 | 0.16 | 24 |
| LAB587 | 66639.3 | 150.4 | 0.14 | 31 | LAB587 | 66639.3 | 8.3 | 0.03 | 32 |
| LAB561 | 66632.2 | 138.3 | 0.04 | 20 | LAB561 | 66632.2 | 7.6 | 0.12 | 22 |
| LAB561 | 66632.3 | 235.3 | 0.13 | 104 | LAB561 | 66632.3 | 12.2 | 0.15 | 95 |
| LAB561 | 66633.3 | 145.1 | 0.16 | 26 | LAB561 | 66633.3 | — | — | — |
| LAB533 | 66428.1 | 135.2 | 0.18 | 17 | LAB533 | 66428.1 | 7.5 | 0.18 | 19 |
| LAB533 | 66429.1 | 219.9 | 0.08 | 91 | LAB533 | 66429.1 | 11.4 | 0.11 | 83 |
| LAB533 | 66430.1 | 150 | 0.04 | 30 | LAB533 | 66430.1 | 7.3 | 0.3 | 18 |
| LAB533 | 66430.5 | 154.2 | L | 34 | LAB533 | 66430.5 | 7.9 | 0.03 | 26 |
| LAB533 | 66431.2 | 153 | 0.17 | 33 | LAB533 | 66431.2 | 8.8 | 0.1 | 42 |
| LAB500 | 66485.2 | 195.1 | 0.04 | 69 | LAB500 | 66485.2 | 11.5 | 0.02 | 85 |
| LAB479 | 66346.4 | 176 | 0.28 | 53 | LAB479 | 66346.4 | — | — | — |
| LAB478 | 66310.3 | 203.2 | 0.06 | 76 | LAB478 | 66310.3 | 10.1 | 0.05 | 62 |
| LAB477 | 66573.3 | 142.1 | 0.23 | 23 | LAB477 | 66573.3 | 8.6 | 0.08 | 38 |
| LAB477 | 66576.1 | 134.7 | 0.09 | 17 | LAB477 | 66576.1 | 8.1 | 0.07 | 30 |
| LAB397 | 66356.2 | 211.3 | 0.08 | 83 | LAB397 | 66356.2 | 10.9 | 0.11 | 75 |
| LAB397 | 66360.5 | 196 | 0.04 | 70 | LAB397 | 66360.5 | 11 | 0.05 | 75 |

TABLE 88-continued

Genes showing improved plant performance at standard growth conditions (T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| CONT. | — | 115.2 | — | — | CONT. | — | 6.2 | — | — |
| LAB608 | 65907.2 | 136 | 0.02 | 43 | LAB608 | 65907.2 | 7.6 | 0.09 | 31 |
| LAB608 | 65907.3 | 189.6 | 0.08 | 100 | LAB608 | 65907.3 | 11.5 | 0.02 | 100 |
| LAB578 | 65581.2 | 220.7 | 0.03 | 133 | LAB578 | 65581.2 | 11.4 | L | 99 |
| LAB578 | 65582.6 | 113.1 | 0.12 | 19 | LAB578 | 65582.6 | — | — | — |
| LAB523 | 65660.3 | 169 | 0.06 | 78 | LAB523 | 65660.3 | 9.6 | 0.02 | 67 |
| LAB523 | 65661.2 | 203.8 | 0.01 | 115 | LAB523 | 65661.2 | 9.1 | 0.04 | 59 |
| LAB512 | 66739.1 | 124.6 | 0.28 | 31 | LAB512 | 66739.1 | 8.1 | 0.18 | 40 |
| LAB512 | 66739.4 | — | — | — | LAB512 | 66739.4 | 6.6 | 0.29 | 16 |
| LAB488 | 66822.4 | 157 | L | 66 | LAB488 | 66822.4 | 9.5 | L | 65 |
| LAB488 | 66822.5 | 129.3 | 0.13 | 36 | LAB488 | 66822.5 | 7.8 | 0.14 | 35 |
| LAB449 | 65098.5 | — | — | — | LAB449 | 65098.5 | 6.9 | 0.21 | 19 |
| LAB449 | 65099.4 | 126.7 | 0.23 | 34 | LAB449 | 65099.4 | 7.5 | 0.27 | 31 |
| LAB428 | 65079.2 | 202.6 | 0.09 | 114 | LAB428 | 65079.2 | 10.7 | 0.14 | 86 |
| LAB420 | 66837.1 | 141.6 | 0.1 | 49 | LAB420 | 66837.1 | 7.4 | 0.25 | 29 |
| LAB420 | 66837.2 | 168.9 | 0.09 | 78 | LAB420 | 66837.2 | 9.2 | 0.13 | 60 |
| CONT. | — | 94.8 | — | — | CONT. | — | 5.8 | — | — |
| LAB601 | 66509.1 | 149.4 | 0.28 | 23 | LAB601 | 66509.1 | — | — | — |
| LAB601 | 66510.4 | 167.4 | 0.06 | 38 | LAB601 | 66510.4 | 8.8 | 0.2 | 29 |
| LAB586 | 65590.2 | 255.1 | 0.11 | 110 | LAB586 | 65590.2 | 14.1 | 0.09 | 108 |
| LAB487 | 66501.1 | 172.1 | 0.16 | 42 | LAB487 | 66501.1 | 9.2 | 0.08 | 36 |
| LAB393 | 66285.4 | 226.4 | 0.15 | 86 | LAB393 | 66285.4 | 10.3 | 0.12 | 51 |
| CONT. | — | 121.6 | — | — | CONT. | — | 6.8 | — | — |
| LAB470 | 66630.1 | 202.2 | 0.14 | 58 | LAB470 | 66630.1 | 10.1 | 0.13 | 51 |
| LAB470 | 66630.4 | 227.6 | 0.1 | 78 | LAB470 | 66630.4 | 11 | 0.19 | 65 |
| LAB466 | 66621.2 | 269.3 | 0.04 | 111 | LAB466 | 66621.2 | 13.8 | 0.07 | 108 |
| LAB466 | 66622.2 | 182 | 0.03 | 43 | LAB466 | 66622.2 | 10 | 0.02 | 50 |
| LAB462 | 66615.11 | — | — | — | LAB462 | 66615.11 | 7.8 | 0.3 | 18 |
| LAB462 | 66618.2 | 151.9 | 0.22 | 19 | LAB462 | 66618.2 | 7.7 | 0.27 | 15 |
| LAB454 | 66813.4 | 180.4 | 0.02 | 41 | LAB454 | 66813.4 | 8.5 | 0.21 | 27 |
| LAB412 | 66699.2 | 200.1 | 0.17 | 57 | LAB412 | 66699.2 | 11.2 | 0.12 | 68 |
| LAB412 | 66701.2 | 194.8 | 0.14 | 53 | LAB412 | 66701.2 | 10.5 | 0.07 | 58 |
| LAB403 | 66802.6 | 163.3 | 0.26 | 28 | LAB403 | 66802.6 | — | — | — |
| LAB403 | 66804.5 | — | — | — | LAB403 | 66804.5 | 9 | 0.26 | 35 |
| CONT. | — | 127.6 | — | — | CONT. | — | 6.7 | — | — |
| LAB516 | 65870.2 | 187.8 | L | 75 | LAB516 | 65870.2 | 10.4 | L | 86 |
| LAB516 | 65871.3 | 134.8 | 0.15 | 25 | LAB516 | 65871.3 | 6.9 | 0.27 | 22 |
| LAB506 | 65111.7 | 131.9 | 0.21 | 23 | LAB506 | 65111.7 | — | — | — |
| LAB475 | 67390.1 | 158.8 | 0.1 | 48 | LAB475 | 67390.1 | — | — | — |
| LAB475 | 67390.2 | 133.2 | 0.28 | 24 | LAB475 | 67390.2 | — | — | — |
| LAB474 | 66470.4 | 156 | 0.06 | 45 | LAB474 | 66470.4 | 8 | 0.22 | 43 |
| LAB474 | 66470.8 | 162.7 | 0.14 | 51 | LAB474 | 66470.8 | 8.1 | 0.19 | 45 |
| LAB459 | 67379.3 | 136.6 | 0.15 | 27 | LAB459 | 67379.3 | 7.2 | 0.21 | 29 |
| LAB457 | 65100.1 | 190.4 | 0.02 | 77 | LAB457 | 65100.1 | 10.2 | 0.02 | 82 |
| LAB457 | 65100.2 | 126.4 | 0.28 | 18 | LAB457 | 65100.2 | — | — | — |
| CONT. | — | 107.5 | — | — | CONT. | — | 5.6 | — | — |
| LAB586 | 65587.2 | 240.9 | 0.13 | 44 | LAB586 | 65587.2 | 13 | 0.12 | 36 |
| LAB586 | 65588.2 | 201.2 | 0.18 | 20 | LAB586 | 65588.2 | 11.5 | 0.23 | 20 |
| LAB537 | 66329.2 | 201.3 | 0.29 | 20 | LAB537 | 66329.2 | — | — | — |
| LAB537 | 66330.6 | 230.7 | 0.14 | 38 | LAB537 | 66330.6 | 13 | 0.12 | 36 |
| LAB487 | 66501.1 | 192.2 | 0.18 | 15 | LAB487 | 66501.1 | 11.4 | 0.11 | 19 |
| LAB479 | 66346.4 | 231.6 | 0.02 | 38 | LAB479 | 66346.4 | 12.7 | 0.05 | 33 |
| LAB478 | 66311.1 | 233.3 | L | 39 | LAB478 | 66311.1 | 13.5 | L | 41 |
| LAB397 | 66359.1 | 214.8 | 0.13 | 28 | LAB397 | 66359.1 | 12.6 | 0.14 | 32 |
| CONT. | — | 167.6 | — | — | CONT. | — | 9.6 | — | — |
| LAB597 | 66272.8 | 244.1 | 0.07 | 50 | LAB597 | 66272.8 | 13.6 | 0.04 | 41 |
| LAB597 | 66273.1 | 297.9 | L | 83 | LAB597 | 66273.1 | 17.1 | L | 77 |
| LAB408 | 65933.2 | 208.9 | 0.29 | 28 | LAB408 | 65933.2 | 12.8 | 0.24 | 33 |
| LAB407 | 66244.2 | 214.9 | 0.07 | 32 | LAB407 | 66244.2 | 12.7 | 0.03 | 31 |
| LAB407 | 66245.2 | 218.8 | 0.16 | 34 | LAB407 | 66245.2 | 12.3 | 0.26 | 28 |
| CONT. | — | 162.8 | — | — | CONT. | — | 9.7 | — | — |
| LAB591 | 65623.1 | 210.7 | 0.03 | 53 | LAB591 | 65623.1 | 11.7 | L | 60 |
| LAB591 | 65624.4 | 188.8 | 0.14 | 37 | LAB591 | 65624.4 | 9.8 | 0.21 | 35 |
| LAB582 | 66267.1 | 295.8 | L | 115 | LAB582 | 66267.1 | 16 | 0.02 | 120 |
| LAB582 | 66268.2 | 224 | 0.07 | 63 | LAB582 | 66268.2 | 11.4 | 0.07 | 56 |
| LAB582 | 66270.1 | 227.5 | 0.12 | 65 | LAB582 | 66270.1 | 10.5 | 0.05 | 44 |
| LAB582 | 66270.2 | 174 | 0.23 | 26 | LAB582 | 66270.2 | 8.6 | 0.22 | 18 |
| LAB551 | 65811.5 | 172.2 | 0.11 | 25 | LAB551 | 65811.5 | — | — | — |
| LAB551 | 65813.2 | 194.5 | 0.05 | 41 | LAB551 | 65813.2 | 10.3 | 0.07 | 41 |
| LAB538 | 66225.1 | 186.5 | 0.05 | 35 | LAB538 | 66225.1 | 10.2 | 0.02 | 41 |
| LAB538 | 66226.4 | 223.8 | 0.04 | 62 | LAB538 | 66226.4 | 13.6 | 0.08 | 87 |
| LAB538 | 66227.2 | 266.5 | 0.06 | 94 | LAB538 | 66227.2 | 13.8 | 0.12 | 89 |

TABLE 88-continued

Genes showing improved plant performance at standard growth conditions
(T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| LAB538 | 66228.2 | 198.9 | 0.02 | 44 | LAB538 | 66228.2 | 10.8 | 0.02 | 49 |
| LAB538 | 66228.3 | 185.8 | 0.28 | 35 | LAB538 | 66228.3 | — | — | — |
| LAB499 | 66044.3 | 164.3 | 0.28 | 19 | LAB499 | 66044.3 | — | — | — |
| LAB499 | 66045.1 | 153.5 | 0.26 | 11 | LAB499 | 66045.1 | 8.4 | 0.16 | 15 |
| LAB499 | 66048.1 | 190.5 | 0.19 | 38 | LAB499 | 66048.1 | 9.8 | 0.25 | 34 |
| LAB499 | 66048.4 | 238.7 | 0.03 | 73 | LAB499 | 66048.4 | 13.4 | 0.02 | 83 |
| LAB491 | 65858.3 | 174.1 | 0.06 | 26 | LAB491 | 65858.3 | 8.9 | 0.11 | 22 |
| LAB491 | 65859.2 | 192.1 | L | 39 | LAB491 | 65859.2 | 10.6 | 0.01 | 46 |
| LAB491 | 65859.5 | 376.3 | 0.03 | 173 | LAB491 | 65859.5 | 20.1 | 0.03 | 175 |
| LAB491 | 65861.2 | 226.7 | L | 65 | LAB491 | 65861.2 | 11.7 | 0.01 | 61 |
| LAB491 | 65861.3 | 274.8 | L | 100 | LAB491 | 65861.3 | 13.9 | L | 90 |
| LAB481 | 66200.2 | 270.3 | 0.12 | 96 | LAB481 | 66200.2 | 13.1 | 0.14 | 79 |
| LAB481 | 66202.1 | 218.8 | 0.07 | 59 | LAB481 | 66202.1 | 11.1 | 0.09 | 52 |
| LAB481 | 66202.2 | 170.9 | 0.12 | 24 | LAB481 | 66202.2 | 9.2 | 0.06 | 27 |
| LAB481 | 66203.4 | 201.1 | 0.05 | 46 | LAB481 | 66203.4 | 10 | 0.14 | 38 |
| LAB408 | 65930.4 | 199.7 | 0.01 | 45 | LAB408 | 65930.4 | 9.1 | 0.26 | 24 |
| LAB395 | 66230.1 | 178.4 | 0.29 | 30 | LAB395 | 66230.1 | — | — | — |
| LAB395 | 66232.1 | 168.1 | 0.17 | 22 | LAB395 | 66232.1 | 8.8 | 0.14 | 20 |
| LAB395 | 66234.1 | 159.2 | 0.23 | 16 | LAB395 | 66234.1 | 8.6 | 0.28 | 17 |
| CONT. | — | 137.7 | — | — | CONT. | — | 7.3 | — | — |
| LAB604 | 66496.1 | 176.7 | 0.11 | 40 | LAB604 | 66496.1 | 9.3 | 0.1 | 42 |
| LAB575 | 66783.4 | 189.7 | 0.01 | 51 | LAB575 | 66783.4 | 10.9 | L | 66 |
| LAB519 | 66324.1 | 198.7 | 0.12 | 58 | LAB519 | 66324.1 | 10.1 | 0.12 | 54 |
| LAB446 | 65090.3 | 188.3 | 0.24 | 49 | LAB446 | 65090.3 | 9.2 | 0.21 | 41 |
| LAB439 | 65948.2 | 188 | 0.11 | 49 | LAB439 | 65948.2 | 10.3 | 0.08 | 57 |
| LAB439 | 65949.3 | — | — | — | LAB439 | 65949.3 | 9.6 | 0.27 | 46 |
| LAB427 | 65539.12 | 198.7 | L | 58 | LAB427 | 65539.12 | 10.2 | 0.05 | 55 |
| LAB427 | 65539.3 | 220.2 | L | 75 | LAB427 | 65539.3 | 13.1 | 0.01 | 99 |
| LAB418 | 66825.1 | — | — | — | LAB418 | 66825.1 | 7.8 | 0.25 | 18 |
| LAB418 | 66825.8 | 200.2 | 0.23 | 59 | LAB418 | 66825.8 | 10.3 | 0.26 | 57 |
| LAB396 | 65926.1 | — | — | — | LAB396 | 65926.1 | 9.2 | 0.25 | 40 |
| CONT. | — | 126 | — | — | CONT. | — | 6.6 | — | — |
| LAB603 | 66488.1 | 117.1 | 0.24 | 17 | LAB603 | 66488.1 | — | — | — |
| LAB603 | 66490.2 | — | — | — | LAB603 | 66490.2 | 6.1 | 0.26 | 18 |
| LAB587 | 66638.1 | 128.5 | 0.23 | 28 | LAB587 | 66638.1 | 6.9 | 0.22 | 34 |
| LAB587 | 66638.2 | 167.6 | 0.05 | 67 | LAB587 | 66638.2 | 7.9 | 0.14 | 54 |
| LAB587 | 66639.4 | 132.8 | 0.25 | 32 | LAB587 | 66639.4 | 6.9 | 0.24 | 35 |
| LAB561 | 66632.3 | 144.2 | 0.04 | 44 | LAB561 | 66632.3 | 7.2 | 0.02 | 41 |
| LAB561 | 66633.2 | 157.2 | 0.18 | 57 | LAB561 | 66633.2 | — | — | — |
| LAB559 | 66789.2 | 127.3 | 0.14 | 27 | LAB559 | 66789.2 | 6.2 | 0.28 | 20 |
| LAB559 | 66789.3 | 126.2 | 0.13 | 26 | LAB559 | 66789.3 | 6.5 | 0.19 | 25 |
| LAB559 | 66791.3 | 125 | 0.17 | 24 | LAB559 | 66791.3 | — | — | — |
| LAB533 | 66430.5 | 125.8 | 0.1 | 25 | LAB533 | 66430.5 | 6.4 | 0.19 | 25 |
| LAB489 | 66722.2 | 126.3 | 0.26 | 26 | LAB489 | 66722.2 | 7.2 | 0.13 | 40 |
| LAB489 | 66723.1 | 141.6 | 0.24 | 41 | LAB489 | 66723.1 | 7.3 | 0.1 | 42 |
| LAB477 | 66572.1 | — | — | — | LAB477 | 66572.1 | 6.2 | 0.13 | 20 |
| LAB477 | 66574.1 | 112.6 | 0.27 | 12 | LAB477 | 66574.1 | 5.9 | 0.28 | 14 |
| LAB394 | 66565.1 | 125.1 | 0.22 | 25 | LAB394 | 66565.1 | — | — | — |
| CONT. | — | 100.5 | — | — | CONT. | — | 5.2 | — | — |
| LAB602 | 65828.2 | 106.2 | 0.11 | 36 | LAB602 | 65828.2 | 5.8 | 0.26 | 33 |
| LAB602 | 65829.4 | — | — | — | LAB602 | 65829.4 | 6.9 | 0.25 | 60 |
| LAB543 | 65895.1 | 105.1 | 0.23 | 35 | LAB543 | 65895.1 | — | — | — |
| LAB486 | 65855.3 | 111.4 | 0.27 | 43 | LAB486 | 65855.3 | 6.8 | 0.24 | 56 |
| LAB431 | 65943.5 | 94 | 0.24 | 20 | LAB431 | 65943.5 | 5.3 | 0.27 | 21 |
| LAB431 | 65944.6 | 109.1 | 0.24 | 40 | LAB431 | 65944.6 | — | — | — |
| CONT. | — | 78.2 | — | — | CONT. | — | 4.3 | — | — |
| LAB611 | 65997.11 | 120.8 | 0.22 | 58 | LAB611 | 65997.11 | 6.5 | 0.23 | 55 |
| LAB611 | 65997.7 | 130 | 0.01 | 70 | LAB611 | 65997.7 | 7.2 | L | 74 |
| LAB563 | 67029.4 | 92.4 | 0.1 | 21 | LAB563 | 67029.4 | 5.2 | 0.03 | 23 |
| LAB563 | 67032.4 | — | — | — | LAB563 | 67032.4 | 4.9 | 0.1 | 17 |
| LAB537 | 66329.2 | 103 | 0.03 | 35 | LAB537 | 66329.2 | 5.4 | 0.09 | 29 |
| LAB537 | 66330.6 | 108.1 | 0.2 | 42 | LAB537 | 66330.6 | 6.6 | 0.12 | 57 |
| LAB485 | 67022.2 | 87.4 | 0.15 | 14 | LAB485 | 67022.2 | 4.9 | 0.1 | 16 |
| LAB485 | 67023.1 | — | — | — | LAB485 | 67023.1 | 4.7 | 0.09 | 13 |
| LAB485 | 67024.2 | 102.5 | 0.13 | 34 | LAB485 | 67024.2 | 5.3 | 0.13 | 28 |
| LAB485 | 67026.2 | 113.7 | 0.08 | 49 | LAB485 | 67026.2 | 6.9 | 0.07 | 64 |
| LAB473 | 66872.3 | 88.8 | 0.08 | 16 | LAB473 | 66872.3 | 4.5 | 0.26 | 8 |
| LAB473 | 66873.3 | 97.5 | 0.25 | 28 | LAB473 | 66873.3 | 5.3 | 0.27 | 28 |
| LAB433 | 67036.4 | — | — | — | LAB433 | 67036.4 | 5.5 | 0.25 | 31 |
| LAB433 | 67038.4 | 86.8 | 0.2 | 14 | LAB433 | 67038.4 | 4.8 | 0.22 | 14 |
| LAB433 | 67038.5 | 97.4 | 0.14 | 28 | LAB433 | 67038.5 | 5.9 | 0.07 | 42 |
| LAB400 | 65510.1 | 95 | 0.08 | 24 | LAB400 | 65510.1 | — | — | — |

TABLE 88-continued

Genes showing improved plant performance at standard growth conditions (T2 generation)

| | | Fresh Weight [mg] | | | | | Dry Weight [mg] | | |
|---|---|---|---|---|---|---|---|---|---|
| Gene Name | Event # | Ave. | P-Val. | % Incr. | Gene Name | Event # | Ave. | P-Val. | % Incr. |
| LAB393 | 66286.1 | 96.7 | 0.05 | 27 | LAB393 | 66286.1 | 5.7 | 0.06 | 37 |
| LAB393 | 66288.2 | 120.8 | 0.06 | 58 | LAB393 | 66288.2 | 5.9 | 0.24 | 40 |
| LAB390 | 67016.2 | 109.3 | 0.11 | 43 | LAB390 | 67016.2 | 5.9 | 0.11 | 41 |
| LAB390 | 67017.2 | 118.1 | 0.17 | 55 | LAB390 | 67017.2 | 6.3 | 0.18 | 50 |
| LAB390 | 67017.4 | — | — | — | LAB390 | 67017.4 | 5.2 | 0.21 | 24 |
| CONT. | — | 76.4 | — | — | CONT. | — | 4.2 | — | — |
| LAB610 | 65342.3 | 119.2 | 0.21 | 27 | LAB610 | 65342.3 | — | — | — |
| LAB610 | 65343.3 | 144.8 | 0.02 | 54 | LAB610 | 65343.3 | 7.6 | 0.05 | 50 |
| LAB595 | 65270.2 | 144.8 | 0.02 | 54 | LAB595 | 65270.2 | 8.6 | L | 69 |
| LAB595 | 65273.2 | 120.8 | 0.12 | 29 | LAB595 | 65273.2 | 6.8 | 0.1 | 32 |
| LAB595 | 65273.3 | 172.6 | L | 84 | LAB595 | 65273.3 | 9.5 | 0.01 | 86 |
| LAB577 | 65575.2 | — | — | — | LAB577 | 65575.2 | 6.9 | 0.26 | 34 |
| LAB577 | 65578.4 | — | — | — | LAB577 | 65578.4 | 6.4 | 0.23 | 25 |
| LAB562 | 65612.3 | 128 | 0.28 | 36 | LAB562 | 65612.3 | 6.6 | 0.27 | 29 |
| LAB505 | 65105.1 | 129.8 | 0.16 | 38 | LAB505 | 65105.1 | 7.4 | 0.09 | 46 |
| LAB505 | 65108.3 | 156.3 | 0.14 | 67 | LAB505 | 65108.3 | 8.1 | 0.16 | 59 |
| LAB505 | 65110.4 | 126 | 0.16 | 34 | LAB505 | 65110.4 | 6.5 | 0.16 | 27 |
| LAB459 | 67379.3 | 118.2 | 0.26 | 26 | LAB459 | 67379.3 | — | — | — |
| LAB435 | 67374.1 | 132.6 | 0.08 | 41 | LAB435 | 67374.1 | 7.6 | 0.07 | 49 |
| LAB423 | 65528.2 | 126.3 | 0.09 | 35 | LAB423 | 65528.2 | 6.4 | 0.24 | 26 |
| LAB423 | 65528.3 | 214 | L | 128 | LAB423 | 65528.3 | 11.7 | 0.01 | 129 |
| CONT. | — | 93.8 | — | — | CONT. | — | 5.1 | — | — |
| LAB612 | 66278.4 | 217.3 | L | 41 | LAB612 | 66278.4 | 10 | L | 39 |
| LAB602 | 65828.2 | — | — | — | LAB602 | 65828.2 | 10.1 | 0.24 | 42 |
| LAB598 | 66081.2 | 203.6 | 0.23 | 32 | LAB598 | 66081.2 | 10.5 | 0.1 | 46 |
| LAB598 | 66082.2 | — | — | — | LAB598 | 66082.2 | 8.2 | 0.14 | 14 |
| LAB592 | 65819.3 | 209 | 0.08 | 35 | LAB592 | 65819.3 | 10.7 | 0.03 | 49 |
| LAB592 | 65820.1 | — | — | — | LAB592 | 65820.1 | 8.8 | 0.17 | 23 |
| LAB543 | 65897.2 | — | — | — | LAB543 | 65897.2 | 10 | 0.11 | 39 |
| LAB543 | 65898.1 | 238.8 | 0.01 | 55 | LAB543 | 65898.1 | 11.8 | L | 64 |
| LAB486 | 65855.1 | 196.5 | 0.2 | 27 | LAB486 | 65855.1 | — | — | — |
| LAB486 | 65855.3 | 300.7 | 0.02 | 95 | LAB486 | 65855.3 | 14.8 | 0.01 | 107 |
| LAB463 | 65988.3 | 200.3 | 0.23 | 30 | LAB463 | 65988.3 | 10.2 | 0.13 | 42 |
| LAB431 | 65944.3 | 185.7 | 0.25 | 20 | LAB431 | 65944.3 | 8.9 | 0.2 | 24 |
| LAB398 | 65914.2 | — | — | — | LAB398 | 65914.2 | 9.8 | 0.09 | 36 |
| CONT. | — | 154.3 | — | — | CONT. | — | 7.2 | — | — |
| LAB451 | 66704.2 | 220.2 | 0.19 | 48 | LAB451 | 66704.2 | 10.9 | 0.26 | 41 |
| LAB451 | 66704.5 | 188 | 0.26 | 26 | LAB451 | 66704.5 | 10.2 | 0.2 | 33 |
| LAB451 | 66707.5 | — | — | — | LAB451 | 66707.5 | 9.1 | 0.25 | 18 |
| LAB445 | 66464.3 | — | — | — | LAB445 | 66464.3 | 8.8 | 0.3 | 14 |
| CONT. | — | 148.7 | — | — | CONT. | — | 7.7 | — | — |
| LAB524 | 65135.1 | 188.9 | 0.27 | 83 | LAB524 | 65135.1 | 10.2 | 0.27 | 77 |
| LAB524 | 65136.4 | 172.5 | 0.17 | 67 | LAB524 | 65136.4 | 9.5 | 0.22 | 66 |
| LAB512 | 66735.2 | 155.8 | 0.08 | 51 | LAB512 | 66735.2 | 9.2 | 0.08 | 59 |
| LAB485 | 67026.2 | 114.6 | 0.25 | 11 | LAB485 | 67026.2 | 6.9 | 0.11 | 19 |
| LAB473 | 66874.2 | 178.9 | 0.05 | 74 | LAB473 | 66874.2 | 9.9 | 0.03 | 72 |
| LAB473 | 66875.1 | 178.2 | 0.05 | 73 | LAB473 | 66875.1 | 8.8 | 0.08 | 54 |
| LAB390 | 67020.1 | 130.2 | 0.11 | 26 | LAB390 | 67020.1 | 7.9 | 0.06 | 37 |
| CONT. | — | 103.1 | — | — | CONT. | — | 5.8 | — | — |
| LAB593 | 66341.1 | 202 | 0.15 | 67 | LAB593 | 66341.1 | 10 | 0.16 | 54 |
| LAB575 | 66784.6 | 170 | 0.24 | 40 | LAB575 | 66784.6 | — | — | — |
| LAB508 | 66729.1 | 154.7 | 0.27 | 28 | LAB508 | 66729.1 | — | — | — |
| LAB508 | 66730.5 | 163.1 | 0.08 | 35 | LAB508 | 66730.5 | 8.9 | 0.03 | 38 |
| LAB508 | 66733.4 | 158.8 | 0.2 | 31 | LAB508 | 66733.4 | — | — | — |
| LAB507 | 66794.5 | 145.6 | 0.15 | 20 | LAB507 | 66794.5 | — | — | — |
| LAB507 | 66794.7 | 242.4 | L | 100 | LAB507 | 66794.7 | 12.4 | 0.03 | 93 |
| LAB507 | 66798.1 | 164.3 | 0.08 | 36 | LAB507 | 66798.1 | 8.9 | 0.1 | 38 |
| LAB476 | 66305.1 | 211.5 | 0.19 | 75 | LAB476 | 66305.1 | 10.5 | 0.23 | 62 |
| LAB476 | 66306.6 | 270.6 | 0.02 | 123 | LAB476 | 66306.6 | 14 | 0.03 | 116 |
| LAB476 | 66307.2 | 175.6 | 0.07 | 45 | LAB476 | 66307.2 | 9.8 | 0.03 | 51 |
| LAB424 | 66710.7 | 188.7 | 0.07 | 56 | LAB424 | 66710.7 | 10.6 | 0.02 | 64 |
| LAB424 | 66713.2 | 201.7 | 0.03 | 67 | LAB424 | 66713.2 | 10.3 | 0.07 | 60 |
| LAB422 | 65936.2 | 189.3 | 0.1 | 56 | LAB422 | 65936.2 | 8.9 | 0.16 | 37 |
| LAB422 | 65938.3 | 234.5 | L | 94 | LAB422 | 65938.3 | 12 | L | 85 |
| LAB422 | 65939.2 | 232.2 | L | 92 | LAB422 | 65939.2 | 13.1 | L | 102 |
| LAB418 | 66825.1 | 169.2 | 0.23 | 40 | LAB418 | 66825.1 | 8.4 | 0.29 | 30 |
| LAB412 | 66699.1 | 152.7 | 0.1 | 26 | LAB412 | 66699.1 | — | — | — |
| LAB412 | 66701.2 | 231.6 | 0.04 | 91 | LAB412 | 66701.2 | 12.4 | 0.04 | 93 |
| CONT. | — | 121.1 | — | — | CONT. | — | 6.5 | — | — |
| LAB600 | 65717.5 | 106.9 | 0.29 | 26 | LAB600 | 65717.5 | 6.3 | 0.18 | 29 |
| LAB600 | 65718.2 | 102.9 | 0.29 | 21 | LAB600 | 65718.2 | — | — | — |
| LAB501 | 65969.1 | 110.2 | 0.25 | 30 | LAB501 | 65969.1 | — | — | — |

TABLE 88-continued

Genes showing improved plant performance at standard growth conditions (T2 generation)

| | Fresh Weight [mg] | | | | | Dry Weight [mg] | | | |
|---|---|---|---|---|---|---|---|---|---|
| Gene Name | Event # | Ave. | P-Val. | % Incr. | Gene Name | Event # | Ave. | P-Val. | % Incr. |
| LAB501 | 65970.1 | 147.3 | 0.08 | 74 | LAB501 | 65970.1 | 8.3 | 0.1 | 70 |
| LAB451 | 66704.3 | 113.8 | 0.12 | 34 | LAB451 | 66704.3 | — | — | — |
| CONT. | — | 84.8 | — | — | CONT. | — | 4.9 | — | — |

Table 88.
"CONT."—Control;
"Ave."—Average;
"% Incr." = % increment;
"p-val."—p-value;
L - p < 0.01.

TABLE 89

Genes showing improved plant performance at standard growth conditions (T2 generation)

| | | Leaf Area [cm²] | | |
|---|---|---|---|---|
| Gene Name | Event # | Ave. | P-Val. | % Incr. |
| LAB607 | 65335.1 | 0.6 | 0.01 | 43 |
| LAB600 | 65719.3 | 0.6 | 0.01 | 35 |
| LAB536 | 65148.1 | 0.5 | 0.1 | 21 |
| LAB501 | 65966.3 | 0.6 | L | 36 |
| CONT. | — | 0.5 | — | — |
| LAB538 | 66225.1 | 0.9 | 0.06 | 19 |
| LAB499 | 66044.1 | 0.8 | 0.15 | 9 |
| LAB499 | 66048.1 | 0.8 | 0.06 | 11 |
| LAB491 | 65859.1 | 1.1 | 0.04 | 55 |
| LAB491 | 65859.5 | 1.1 | 0.02 | 47 |
| LAB491 | 65861.2 | 1.3 | 0.01 | 73 |
| LAB481 | 66202.2 | 0.9 | L | 26 |
| LAB408 | 65930.4 | 0.8 | 0.03 | 11 |
| LAB408 | 65933.1 | 0.9 | 0.03 | 18 |
| LAB408 | 65933.2 | 0.9 | 0.13 | 26 |
| LAB395 | 66234.1 | 0.9 | L | 26 |
| CONT. | — | 0.7 | — | — |
| LAB603 | 66488.1 | 0.7 | 0.2 | 14 |
| LAB603 | 66489.1 | 0.8 | 0.11 | 34 |
| LAB587 | 66638.1 | 0.7 | 0.11 | 26 |
| LAB587 | 66638.2 | 0.7 | 0.04 | 29 |
| LAB587 | 66639.3 | 0.8 | L | 34 |
| LAB561 | 66632.2 | 0.7 | 0.14 | 22 |
| LAB561 | 66632.3 | 0.9 | 0.05 | 55 |
| LAB561 | 66633.3 | 0.7 | 0.28 | 17 |
| LAB533 | 66429.1 | 0.8 | 0.13 | 47 |
| LAB533 | 66430.1 | 0.7 | 0.09 | 23 |
| LAB533 | 66430.5 | 0.7 | 0.13 | 19 |
| LAB533 | 66431.2 | 0.8 | 0.07 | 38 |
| LAB500 | 66485.2 | 0.8 | L | 42 |
| LAB478 | 66310.3 | 0.8 | 0.05 | 40 |
| LAB477 | 66573.3 | 0.6 | 0.26 | 13 |
| LAB477 | 66576.1 | 0.7 | 0.1 | 21 |
| LAB477 | 66576.2 | 0.7 | 0.22 | 16 |
| LAB397 | 66356.2 | 0.8 | 0.04 | 47 |
| LAB397 | 66359.2 | 0.7 | 0.23 | 14 |
| LAB397 | 66360.5 | 0.8 | 0.04 | 39 |
| CONT. | — | 0.6 | — | — |
| LAB608 | 65907.2 | 0.7 | 0.04 | 38 |
| LAB608 | 65907.3 | 1 | L | 97 |
| LAB578 | 65581.2 | 0.9 | L | 79 |
| LAB523 | 65660.3 | 0.8 | L | 66 |
| LAB523 | 65661.2 | 0.8 | L | 56 |
| LAB512 | 66734.5 | 0.6 | 0.28 | 30 |
| LAB512 | 66739.1 | 0.7 | 0.03 | 46 |
| LAB512 | 66739.4 | 0.7 | 0.01 | 34 |
| LAB488 | 66822.4 | 0.8 | L | 67 |
| LAB488 | 66822.5 | 0.7 | 0.08 | 36 |
| LAB449 | 65098.5 | 0.6 | 0.03 | 26 |
| LAB449 | 65099.4 | 0.6 | 0.17 | 26 |
| LAB428 | 65079.2 | 0.8 | 0.08 | 68 |
| LAB420 | 66837.1 | 0.7 | 0.07 | 35 |
| LAB420 | 66837.2 | 0.7 | 0.12 | 41 |
| CONT. | — | 0.5 | — | — |
| LAB601 | 66510.4 | 0.8 | 0.05 | 31 |
| LAB586 | 65590.2 | 0.9 | 0.09 | 57 |
| LAB487 | 66501.1 | 0.7 | 0.19 | 17 |
| LAB393 | 66285.4 | 0.9 | 0.04 | 49 |
| CONT. | — | 0.6 | — | — |
| LAB470 | 66627.3 | 0.8 | 0.27 | 17 |
| LAB470 | 66630.1 | 0.9 | 0.17 | 35 |
| LAB470 | 66630.4 | 0.9 | 0.06 | 32 |
| LAB466 | 66621.2 | 1.2 | L | 80 |
| LAB466 | 66622.2 | 0.8 | 0.03 | 29 |
| LAB462 | 66617.1 | 0.8 | 0.29 | 19 |
| LAB462 | 66618.2 | 0.7 | 0.24 | 12 |
| LAB454 | 66813.4 | 0.8 | 0.03 | 26 |
| LAB454 | 66815.1 | 0.7 | 0.24 | 14 |
| LAB412 | 66699.2 | 0.9 | 0.12 | 41 |
| LAB412 | 66701.2 | 0.9 | 0.05 | 34 |
| LAB403 | 66804.5 | 0.9 | 0.15 | 35 |
| CONT. | — | 0.6 | — | — |
| LAB516 | 65870.2 | 0.8 | L | 50 |
| LAB516 | 65871.3 | 0.7 | 0.02 | 32 |
| LAB511 | 66257.1 | 0.8 | 0.22 | 49 |
| LAB511 | 66258.4 | 0.6 | 0.2 | 16 |
| LAB506 | 65111.7 | 0.7 | 0.07 | 26 |
| LAB475 | 67390.1 | 0.8 | 0.02 | 45 |
| LAB475 | 67390.2 | 0.6 | 0.27 | 19 |
| LAB474 | 66470.4 | 0.8 | 0.02 | 50 |
| LAB474 | 66470.8 | 0.8 | 0.05 | 51 |
| LAB459 | 67376.3 | 0.6 | 0.11 | 23 |
| LAB459 | 67376.7 | 0.7 | 0.03 | 31 |
| LAB459 | 67379.3 | 0.7 | 0.08 | 24 |
| LAB457 | 65100.1 | 0.8 | L | 60 |
| CONT. | — | 0.5 | — | — |
| LAB586 | 65587.2 | 1 | 0.05 | 27 |
| LAB586 | 65588.2 | 0.9 | 0.11 | 12 |
| LAB537 | 66329.2 | 0.9 | 0.22 | 10 |
| LAB537 | 66330.6 | 0.9 | 0.28 | 13 |
| LAB487 | 66501.1 | 0.8 | 0.23 | 9 |
| LAB479 | 66346.4 | 0.9 | 0.21 | 14 |
| LAB478 | 66310.5 | 0.9 | 0.23 | 11 |
| LAB478 | 66311.1 | 1 | 0.05 | 23 |
| LAB397 | 66359.1 | 0.9 | 0.24 | 16 |
| CONT. | — | 0.8 | — | — |
| LAB597 | 66273.1 | 1 | L | 32 |
| LAB408 | 65933.2 | 0.9 | 0.27 | 18 |
| LAB407 | 66244.2 | 0.9 | 0.28 | 9 |
| CONT. | — | 0.8 | — | — |

TABLE 89-continued

Genes showing improved plant performance at standard growth conditions (T2 generation)

| Gene Name | Event # | Leaf Area [cm²] Ave. | P-Val. | % Incr. |
|---|---|---|---|---|
| LAB591 | 65623.1 | 0.8 | 0.08 | 13 |
| LAB591 | 65624.4 | 0.8 | 0.15 | 10 |
| LAB582 | 66267.1 | 1.1 | L | 55 |
| LAB582 | 66268.2 | 0.9 | 0.17 | 22 |
| LAB582 | 66270.1 | 0.9 | 0.03 | 19 |
| LAB551 | 65813.2 | 0.9 | 0.03 | 22 |
| LAB538 | 66225.1 | 0.8 | 0.18 | 14 |
| LAB538 | 66226.4 | 1 | 0.08 | 39 |
| LAB538 | 66227.2 | 1 | 0.06 | 39 |
| LAB538 | 66228.2 | 0.9 | L | 20 |
| LAB499 | 66045.1 | 0.8 | 0.19 | 11 |
| LAB499 | 66048.4 | 1 | 0.01 | 34 |
| LAB491 | 65858.3 | 0.8 | 0.06 | 16 |
| LAB491 | 65859.2 | 0.9 | L | 24 |
| LAB491 | 65859.5 | 1.4 | L | 85 |
| LAB491 | 65861.2 | 1 | L | 33 |
| LAB491 | 65861.3 | 1.1 | L | 53 |
| LAB481 | 66200.2 | 0.9 | 0.08 | 29 |
| LAB481 | 66202.1 | 0.9 | 0.12 | 28 |
| LAB481 | 66202.2 | 0.8 | 0.17 | 14 |
| LAB481 | 66203.4 | 1 | 0.07 | 33 |
| LAB408 | 65930.4 | 0.9 | 0.02 | 23 |
| LAB395 | 66230.1 | 0.9 | 0.28 | 24 |
| LAB395 | 66232.1 | 0.8 | 0.26 | 16 |
| CONT. | — | 0.7 | — | — |
| LAB604 | 66496.1 | 0.8 | 0.16 | 22 |
| LAB575 | 66783.4 | 0.9 | L | 45 |
| LAB519 | 66324.1 | 0.9 | 0.07 | 35 |
| LAB446 | 65090.3 | 0.8 | 0.28 | 24 |
| LAB439 | 65948.2 | 0.7 | 0.3 | 16 |
| LAB439 | 65949.3 | 0.8 | 0.19 | 21 |
| LAB438 | 66460.2 | 0.8 | 0.13 | 27 |
| LAB427 | 65539.12 | 0.8 | 0.11 | 26 |
| LAB427 | 65539.3 | 0.9 | 0.01 | 45 |
| LAB418 | 66825.8 | 0.8 | 0.29 | 29 |
| LAB396 | 65926.1 | 0.8 | 0.19 | 25 |
| CONT. | — | 0.6 | — | — |
| LAB603 | 66490.2 | 0.6 | 0.3 | 13 |
| LAB603 | 66491.3 | — | — | — |
| LAB587 | 66638.1 | 0.7 | 0.14 | 24 |
| LAB587 | 66638.2 | 0.8 | 0.03 | 49 |
| LAB561 | 66632.3 | 0.7 | 0.08 | 19 |
| LAB561 | 66633.2 | 0.8 | 0.16 | 38 |
| LAB559 | 66789.2 | 0.7 | 0.26 | 16 |
| LAB559 | 66789.3 | 0.7 | 0.07 | 23 |
| LAB559 | 66790.3 | 0.7 | 0.24 | 16 |
| LAB559 | 66791.3 | 0.7 | 0.13 | 17 |
| LAB533 | 66430.5 | 0.7 | 0.18 | 16 |
| LAB500 | 66482.3 | 0.7 | 0.04 | 23 |
| LAB500 | 66482.8 | 0.7 | 0.03 | 24 |
| LAB489 | 66722.2 | 0.7 | 0.02 | 31 |
| LAB489 | 66723.1 | 0.8 | 0.19 | 36 |
| LAB477 | 66572.1 | 0.6 | 0.25 | 13 |
| LAB477 | 66574.1 | 0.6 | 0.26 | 13 |
| CONT. | — | 0.6 | — | — |
| LAB602 | 65828.2 | 0.5 | 0.24 | 21 |
| LAB602 | 65829.4 | 0.6 | 0.22 | 36 |
| LAB592 | 65816.3 | 0.5 | 0.23 | 20 |
| LAB543 | 65895.1 | 0.6 | 0.23 | 26 |
| LAB486 | 65855.3 | 0.6 | 0.22 | 42 |
| LAB431 | 65944.6 | 0.5 | 0.27 | 18 |
| CONT. | — | 0.4 | — | — |
| LAB563 | 67029.4 | 0.5 | 0.04 | 17 |
| LAB563 | 67032.4 | 0.5 | 0.21 | 10 |
| LAB537 | 66329.2 | 0.5 | 0.1 | 13 |
| LAB537 | 66330.6 | 0.6 | L | 41 |
| LAB485 | 67022.2 | 0.5 | 0.26 | 11 |
| LAB485 | 67023.1 | 0.5 | 0.15 | 11 |
| LAB485 | 67026.2 | 0.6 | 0.02 | 44 |
| LAB473 | 66873.3 | 0.5 | 0.22 | 20 |
| LAB433 | 67034.3 | 0.6 | 0.02 | 31 |
| LAB433 | 67038.5 | 0.6 | 0.01 | 30 |
| LAB393 | 66286.1 | 0.6 | L | 34 |
| LAB390 | 67016.2 | 0.5 | 0.2 | 18 |
| LAB390 | 67017.2 | 0.6 | 0.05 | 37 |
| LAB390 | 67017.4 | 0.5 | 0.24 | 13 |
| LAB390 | 67020.1 | 0.5 | 0.22 | 16 |
| CONT. | — | 0.4 | — | — |
| LAB610 | 65342.3 | 0.6 | 0.09 | 21 |
| LAB610 | 65343.3 | 0.6 | 0.1 | 25 |
| LAB595 | 65270.2 | 0.7 | L | 43 |
| LAB595 | 65273.2 | 0.6 | 0.1 | 20 |
| LAB595 | 65273.3 | 0.7 | 0.02 | 40 |
| LAB577 | 65575.2 | 0.6 | 0.15 | 23 |
| LAB577 | 65578.4 | 0.6 | 0.15 | 21 |
| LAB562 | 65612.3 | 0.7 | 0.02 | 31 |
| LAB505 | 65108.3 | 0.7 | 0.06 | 40 |
| LAB505 | 65110.4 | 0.6 | 0.28 | 16 |
| LAB459 | 67379.3 | 0.7 | 0.03 | 32 |
| LAB435 | 67374.1 | 0.7 | 0.04 | 35 |
| LAB435 | 67374.3 | 0.6 | 0.11 | 19 |
| LAB423 | 65528.3 | 0.8 | L | 61 |
| CONT. | — | 0.5 | — | — |
| LAB612 | 66278.4 | 0.8 | 0.1 | 16 |
| LAB602 | 65828.1 | 0.8 | 0.19 | 18 |
| LAB602 | 65828.2 | 0.8 | 0.12 | 16 |
| LAB602 | 65829.4 | 0.8 | 0.13 | 16 |
| LAB598 | 66081.2 | 0.9 | 0.16 | 25 |
| LAB598 | 66082.2 | 0.8 | 0.09 | 15 |
| LAB592 | 65819.3 | 0.9 | 0.04 | 26 |
| LAB543 | 65897.2 | 1 | L | 43 |
| LAB543 | 65898.1 | 0.9 | L | 37 |
| LAB486 | 65855.1 | 0.9 | 0.05 | 28 |
| LAB486 | 65855.3 | 1.1 | 0.02 | 54 |
| LAB463 | 65988.3 | 0.9 | 0.04 | 30 |
| LAB463 | 65989.2 | 1 | 0.12 | 47 |
| LAB431 | 65944.3 | 0.9 | 0.04 | 26 |
| LAB398 | 65913.3 | 0.8 | 0.13 | 15 |
| LAB398 | 65914.2 | 0.8 | 0.07 | 21 |
| CONT. | — | 0.7 | — | — |
| LAB451 | 66707.5 | 0.8 | 0.22 | 15 |
| LAB563 | 67028.3 | 0.6 | 0.26 | 15 |
| LAB524 | 65135.1 | 0.7 | 0.27 | 34 |
| LAB524 | 65136.4 | 0.7 | 0.12 | 30 |
| LAB512 | 66734.5 | 0.6 | 0.28 | 10 |
| LAB512 | 66735.2 | 0.7 | 0.01 | 34 |
| LAB485 | 67026.2 | 0.6 | 0.16 | 14 |
| LAB473 | 66874.2 | 0.8 | 0.03 | 44 |
| LAB473 | 66875.1 | 0.8 | 0.06 | 41 |
| LAB390 | 67020.1 | 0.6 | 0.24 | 19 |
| CONT. | — | 0.5 | — | — |
| LAB593 | 66341.1 | 0.8 | 0.13 | 30 |
| LAB575 | 66784.6 | 0.7 | 0.21 | 19 |
| LAB508 | 66730.5 | 0.8 | 0.07 | 25 |
| LAB507 | 66794.5 | 0.7 | 0.28 | 10 |
| LAB507 | 66794.7 | 0.8 | 0.04 | 34 |
| LAB507 | 66798.1 | 0.7 | 0.21 | 17 |
| LAB476 | 66305.1 | 0.8 | 0.17 | 31 |
| LAB476 | 66306.6 | 1 | 0.02 | 60 |
| LAB476 | 66307.2 | 0.7 | 0.2 | 16 |
| LAB424 | 66710.7 | 0.8 | 0.02 | 27 |
| LAB424 | 66713.2 | 0.9 | L | 53 |
| LAB422 | 65936.2 | 0.8 | 0.07 | 35 |
| LAB422 | 65938.3 | 0.9 | L | 53 |
| LAB422 | 65939.2 | 0.9 | L | 42 |
| LAB412 | 66701.2 | 0.9 | 0.02 | 46 |
| CONT. | — | 0.6 | — | — |
| LAB600 | 65717.5 | 0.5 | 0.21 | 17 |
| LAB542 | 65888.6 | 0.5 | 0.23 | 11 |
| LAB501 | 65970.1 | 0.7 | 0.06 | 56 |

TABLE 89-continued

Genes showing improved plant performance at standard growth conditions (T2 generation)

| | | Leaf Area [cm²] | | |
|---|---|---|---|---|
| Gene Name | Event # | Ave. | P-Val. | % Incr. |
| LAB451 | 66704.5 | 0.6 | 0.16 | 30 |
| CONT. | — | 0.4 | — | — |

Table 89.
"CONT."—Control;
"Ave."—Average;
"% Incr." = % increment;
"p-val."—p-value;
L—p < 0.01.

TABLE 90

Genes showing improved plant performance at standard growth conditions (T1 generation)

| | | Plant Fresh Weight [mg] | | | | | Plant Dry Weight [mg] | | |
|---|---|---|---|---|---|---|---|---|---|
| Gene Name | Event # | Ave. | p-val. | % Incr. | Gene Name | Event # | Ave. | p-val. | % Incr. |
| LAB581 | | 124.9 | 0.26 | 14 | LAB581 | | — | — | — |
| LAB391 | | — | — | — | LAB391 | | 5.5 | 0.11 | 28 |
| CONT. | | 109.5 | — | — | CONT. | | 4.3 | — | — |

Table 90.
"CONT."—Control;
"Ave."—Average;
"% Incr." = % increment;
"p-val."—p-value;
L—p < 0.01.

TABLE 91

Genes showing improved plant performance at standard growth conditions (T1 generation)

| | | Leaf Area cm² | | |
|---|---|---|---|---|
| Gene Name | Event # | Ave. | p-val. | % |
| LAB469 | | 0.8 | 0.02 | 20 |
| CONT. | | 0.6 | — | — |
| LAB391 | | 0.6 | 0.02 | 25 |
| CONT. | | 0.5 | — | — |

Table 91.
"CONT."—Control;
"Ave."—Average;
"% Incr." = % increment;
"p-val."—p-value;
L—p < 0.01.

The genes listed in Tables 92-93 improved root performance when grown at standard conditions. These genes produced larger root biomass (root length and root coverage) when grown under standard growth conditions, compared to control plants. Plants producing larger root biomass have better possibilities to absorb larger amount of water from soil. The genes were cloned under the regulation of a constitutive promoter (At6669; SEQ ID NO:7724). The evaluation of each gene was performed by testing the performance of different number of events. Some of the genes were evaluated in more than one tissue culture assay resulting in positive results as well. Event with p-value <0.1 was considered statistically significant.

TABLE 92

Genes showing improved root performance and growth at standard growth conditions (T2 generation)

| | | Roots Length [cm] | | | Roots Coverage [cm2] | | |
|---|---|---|---|---|---|---|---|
| Gene Name | Event # | Ave. | P-Val. | % Incr. | Ave. | P-Val. | % Incr. |
| LAB607 | 65335.1 | 7.6 | 0.02 | 15 | 9.4 | L | 76 |
| LAB607 | 65336.1 | 7.6 | 0.02 | 15 | 8.3 | L | 55 |
| LAB600 | 65716.3 | 7.4 | 0.14 | 11 | — | — | — |
| LAB600 | 65717.5 | 7.4 | 0.09 | 11 | 8.1 | 0.02 | 51 |
| LAB600 | 65718.2 | 7.2 | 0.11 | 9 | 6.8 | 0.09 | 27 |
| LAB600 | 65719.3 | 7.9 | L | 19 | 9.1 | 0.01 | 70 |
| LAB536 | 65148.1 | — | — | — | 6.9 | 0.24 | 30 |
| LAB501 | 65966.3 | 7.5 | 0.03 | 13 | 7.8 | 0.02 | 45 |
| LAB501 | 65970.2 | 7.1 | 0.29 | 7 | — | — | — |
| LAB490 | 65868.3 | — | — | — | 7.1 | 0.07 | 33 |
| LAB490 | 65868.5 | 7.4 | 0.16 | 11 | 8.3 | 0.01 | 55 |
| CONT. | — | 6.7 | — | — | 5.4 | — | — |
| LAB591 | 65624.4 | — | — | — | 10.8 | 0.21 | 14 |
| LAB582 | 66267.1 | 8 | 0.17 | 7 | 13 | 0.21 | 37 |
| LAB538 | 66228.2 | 7.9 | 0.14 | 7 | 10.5 | 0.17 | 10 |
| LAB499 | 66047.1 | 7.8 | 0.25 | 5 | — | — | — |
| LAB499 | 66048.1 | 7.9 | 0.21 | 7 | 12.2 | 0.08 | 28 |
| LAB491 | 65858.3 | — | — | — | 11.7 | 0.03 | 23 |
| LAB491 | 65859.1 | 8.5 | 0.01 | 15 | 15.8 | L | 67 |
| LAB491 | 65859.5 | 8.3 | L | 12 | 14 | 0.03 | 47 |
| LAB491 | 65861.2 | 8.1 | 0.04 | 9 | 14.9 | 0.02 | 57 |
| LAB481 | 66202.2 | — | — | — | 12.2 | 0.02 | 29 |
| LAB481 | 66203.4 | 7.8 | 0.21 | 5 | 10.3 | 0.13 | 9 |
| LAB408 | 65933.1 | — | — | — | 10.9 | 0.18 | 15 |
| LAB408 | 65933.2 | 8 | 0.22 | 8 | 13.6 | 0.13 | 43 |
| LAB395 | 66234.1 | 8 | 0.2 | 8 | 12.1 | 0.01 | 28 |
| CONT. | — | 7.4 | — | — | 9.5 | — | — |
| LAB603 | 66490.2 | — | — | — | 9.7 | 0.05 | 30 |
| LAB587 | 66638.1 | — | — | — | 8.7 | 0.29 | 15 |
| LAB587 | 66638.2 | — | — | — | 9.2 | 0.08 | 23 |
| LAB587 | 66639.3 | — | — | — | 9.4 | 0.14 | 26 |
| LAB561 | 66632.2 | — | — | — | 9 | 0.28 | 20 |
| LAB561 | 66632.3 | 7.7 | 0.21 | 6 | 10.7 | 0.16 | 42 |

TABLE 92-continued

Genes showing improved root performance and growth at standard growth conditions (T2 generation)

| Gene Name | Event # | Roots Length [cm] Ave. | P-Val. | % Incr. | Roots Coverage [cm2] Ave. | P-Val. | % Incr. |
|---|---|---|---|---|---|---|---|
| LAB561 | 66633.3 | — | — | — | 9.6 | 0.08 | 27 |
| LAB533 | 66429.1 | — | — | — | 10.3 | 0.25 | 38 |
| LAB533 | 66430.5 | — | — | — | 9.4 | 0.05 | 25 |
| LAB533 | 66431.2 | — | — | — | 9.2 | 0.15 | 22 |
| LAB500 | 66485.2 | 7.8 | 0.2 | 7 | 9.3 | 0.21 | 24 |
| LAB478 | 66310.3 | — | — | — | 10.1 | 0.14 | 34 |
| LAB397 | 66356.2 | — | — | — | 11 | 0.2 | 47 |
| LAB397 | 66359.1 | — | — | — | 8.8 | 0.16 | 17 |
| LAB397 | 66360.5 | 8.1 | 0.05 | 11 | 11.1 | 0.04 | 48 |
| CONT. | — | 7.3 | — | — | 7.5 | — | — |
| LAB608 | 65906.1 | 6.8 | 0.14 | 17 | 8.1 | 0.11 | 55 |
| LAB608 | 65907.2 | 7.5 | L | 30 | 9.3 | L | 78 |
| LAB608 | 65907.3 | 7.8 | L | 36 | 11.4 | L | 118 |
| LAB608 | 65909.1 | 6.8 | 0.01 | 17 | — | — | — |
| LAB608 | 65909.2 | 6.7 | 0.02 | 16 | 6.2 | 0.21 | 18 |
| LAB578 | 65581.2 | 7.7 | L | 34 | 10.8 | L | 105 |
| LAB578 | 65581.3 | 6.9 | 0.01 | 20 | 6.6 | 0.23 | 26 |
| LAB578 | 65582.3 | 6.5 | 0.15 | 13 | — | — | — |
| LAB578 | 65582.6 | 6.8 | 0.04 | 17 | 6.9 | 0.06 | 32 |
| LAB578 | 65583.2 | 7.1 | L | 23 | — | — | — |
| LAB523 | 65660.3 | 7.5 | L | 29 | 9.9 | L | 90 |
| LAB523 | 65661.2 | 6.8 | 0.01 | 17 | 8 | 0.02 | 52 |
| LAB523 | 65663.1 | 6.6 | 0.26 | 15 | — | — | — |
| LAB523 | 65663.3 | 7.1 | L | 23 | 7 | 0.12 | 33 |
| LAB523 | 65663.5 | 6.7 | 0.02 | 16 | — | — | — |
| LAB512 | 66735.2 | 6.5 | 0.05 | 13 | — | — | — |
| LAB512 | 66739.1 | 7.3 | 0.01 | 26 | 8.6 | L | 63 |
| LAB512 | 66739.4 | 6.9 | 0.02 | 19 | 6.8 | 0.17 | 30 |
| LAB512 | 66739.5 | 6.2 | 0.29 | 7 | — | — | — |
| LAB488 | 66819.1 | 7.3 | L | 25 | 7.3 | 0.02 | 40 |
| LAB488 | 66821.2 | 6.4 | 0.18 | 11 | — | — | — |
| LAB488 | 66822.4 | 7.5 | L | 30 | 10 | L | 92 |
| LAB488 | 66822.5 | 6.4 | 0.26 | 10 | 6.5 | 0.14 | 25 |
| LAB450 | 65305.3 | 6.7 | 0.09 | 15 | — | — | — |
| LAB450 | 65306.1 | 6.8 | 0.01 | 18 | — | — | — |
| LAB450 | 65306.2 | 6.5 | 0.17 | 13 | 6.5 | 0.27 | 23 |
| LAB450 | 65309.1 | 7 | 0.01 | 21 | — | — | — |
| LAB449 | 65095.1 | 7.2 | L | 24 | 7.8 | 0.08 | 49 |
| LAB449 | 65096.1 | 7.6 | L | 31 | 7.1 | 0.19 | 36 |
| LAB449 | 65098.4 | 7 | L | 20 | 6.8 | 0.11 | 29 |
| LAB449 | 65098.5 | 7.6 | L | 31 | 8 | 0.01 | 52 |
| LAB449 | 65099.4 | 6.8 | 0.05 | 18 | 8.3 | 0.02 | 58 |
| LAB428 | 65078.2 | 6.9 | L | 19 | — | — | — |
| LAB428 | 65079.1 | 7 | L | 22 | 7 | 0.13 | 34 |
| LAB428 | 65079.2 | 6.9 | 0.03 | 19 | 9.5 | 0.06 | 82 |
| LAB420 | 66836.1 | 7 | L | 21 | — | — | — |
| LAB420 | 66836.3 | 6.7 | 0.02 | 16 | — | — | — |
| LAB420 | 66837.1 | 7.2 | L | 25 | 7.9 | L | 51 |
| LAB420 | 66837.2 | 7.3 | L | 26 | 9 | L | 72 |
| LAB420 | 66838.2 | 6.8 | 0.02 | 17 | — | — | — |
| CONT. | — | 5.8 | — | — | 5.2 | — | — |
| LAB612 | 66278.4 | — | — | — | 7.9 | 0.2 | 40 |
| LAB612 | 66280.3 | 6.8 | 0.13 | 12 | — | — | — |
| LAB612 | 66282.2 | 6.9 | 0.05 | 13 | — | — | — |
| LAB612 | 66282.4 | 6.8 | 0.05 | 12 | 8.1 | 0.01 | 43 |
| LAB601 | 66506.1 | — | — | — | 7.5 | 0.07 | 32 |
| LAB601 | 66510.4 | 7.2 | 0.04 | 18 | 10 | L | 76 |
| LAB586 | 65590.2 | 7.1 | 0.18 | 16 | 11.3 | 0.07 | 99 |
| LAB495 | 66314.4 | 7.2 | 0.03 | 18 | 8.6 | 0.23 | 51 |
| LAB495 | 66315.1 | — | — | — | 7.4 | 0.1 | 30 |
| LAB495 | 66315.4 | 6.9 | 0.06 | 14 | 8.6 | L | 52 |
| LAB495 | 66315.8 | 7.1 | 0.02 | 16 | 7.1 | 0.13 | 25 |
| LAB495 | 66316.2 | 7.1 | 0.08 | 16 | 8.6 | 0.07 | 52 |
| LAB493 | 66476.2 | 7.3 | L | 20 | 7.6 | L | 34 |
| LAB493 | 66476.4 | 7 | 0.15 | 15 | 8.6 | 0.14 | 52 |
| LAB493 | 66477.1 | 7 | 0.02 | 15 | — | — | — |
| LAB487 | 66501.1 | — | — | — | 7.7 | 0.02 | 36 |
| LAB487 | 66503.3 | — | — | — | 8.9 | 0.29 | 58 |
| LAB463 | 65988.2 | — | — | — | 7 | 0.29 | 23 |
| LAB463 | 65988.3 | — | — | — | 6.8 | 0.13 | 19 |
| LAB398 | 65912.2 | — | — | — | 6.5 | 0.25 | 14 |
| LAB398 | 65913.3 | 6.6 | 0.17 | 9 | — | — | — |
| LAB393 | 66285.4 | 7.7 | L | 26 | 10.6 | 0.01 | 87 |
| LAB393 | 66287.1 | 6.8 | 0.16 | 11 | 6.9 | 0.18 | 23 |
| LAB393 | 66288.2 | 6.5 | 0.24 | 6 | — | — | — |
| CONT. | — | 6.1 | — | — | 5.7 | — | — |
| LAB472 | 66718.7 | 7.2 | 0.23 | 7 | — | — | — |
| LAB472 | 66719.3 | 7.4 | 0.2 | 11 | — | — | — |
| LAB470 | 66627.2 | 7.1 | 0.25 | 6 | — | — | — |
| LAB470 | 66627.3 | 7.1 | 0.26 | 6 | — | — | — |
| LAB470 | 66630.1 | 7.5 | 0.24 | 12 | 12.7 | 0.09 | 65 |
| LAB470 | 66630.4 | 7.5 | 0.14 | 12 | 11.2 | 0.01 | 46 |
| LAB466 | 66620.4 | 7.4 | 0.19 | 11 | — | — | — |
| LAB466 | 66621.2 | 8 | 0.01 | 19 | 14.9 | L | 94 |
| LAB466 | 66622.5 | 7.2 | 0.21 | 8 | — | — | — |
| LAB454 | 66813.1 | 7.4 | 0.1 | 10 | — | — | — |
| LAB454 | 66813.3 | 7.5 | 0.16 | 12 | — | — | — |
| LAB454 | 66813.5 | — | — | — | 9.1 | 0.29 | 18 |
| LAB412 | 66699.1 | 7.4 | 0.07 | 10 | — | — | — |
| LAB412 | 66699.2 | 8.1 | L | 21 | 12.2 | 0.03 | 59 |
| LAB412 | 66701.2 | 7.7 | 0.09 | 16 | 10.1 | 0.1 | 32 |
| LAB404 | 66779.1 | 7.7 | 0.02 | 15 | 10.3 | 0.28 | 34 |
| LAB404 | 66780.6 | 7.2 | 0.13 | 8 | — | — | — |
| LAB403 | 66802.6 | — | — | — | 8.8 | 0.3 | 14 |
| LAB403 | 66802.7 | 7.4 | 0.12 | 10 | — | — | — |
| LAB403 | 66804.5 | 8 | 0.01 | 19 | 11.6 | 0.11 | 50 |
| LAB403 | 66804.8 | — | — | — | 9.6 | 0.2 | 25 |
| CONT. | — | 6.7 | — | — | 7.7 | — | — |
| LAB516 | 65870.2 | 8 | 0.06 | 11 | 13.1 | L | 74 |
| LAB516 | 65871.3 | — | — | — | 8.9 | 0.24 | 18 |
| LAB506 | 65114.2 | 7.6 | 0.21 | 6 | — | — | — |
| LAB475 | 67390.1 | 8.1 | 0.01 | 12 | 12.2 | 0.01 | 61 |
| LAB475 | 67390.2 | 7.8 | 0.11 | 8 | 10.2 | 0.05 | 35 |
| LAB474 | 66470.4 | — | — | — | 9.5 | 0.11 | 25 |
| LAB474 | 66470.8 | 7.6 | 0.16 | 6 | 9.8 | 0.11 | 30 |
| LAB471 | 66192.1 | 7.5 | 0.15 | 5 | — | — | — |
| LAB459 | 67376.7 | 7.7 | 0.02 | 7 | 9.9 | 0.04 | 32 |
| LAB459 | 67379.3 | 7.6 | 0.12 | 6 | 9.2 | 0.1 | 22 |
| LAB459 | 67380.1 | — | — | — | 8.8 | 0.21 | 16 |
| LAB457 | 65100.1 | — | — | — | 9.9 | 0.04 | 31 |
| LAB457 | 65100.2 | 7.7 | 0.04 | 7 | 9.2 | 0.11 | 21 |
| CONT. | — | 7.2 | — | — | 7.5 | — | — |
| LAB601 | 66510.4 | 8.1 | 0.1 | 8 | 11.9 | 0.09 | 25 |
| LAB586 | 65587.4 | 7.9 | 0.25 | 5 | — | — | — |
| LAB586 | 65588.2 | — | — | — | 12.3 | 0.07 | 30 |
| LAB586 | 65589.3 | 8.1 | 0.09 | 8 | 11.6 | 0.08 | 21 |
| LAB495 | 66315.1 | 8 | 0.17 | 7 | 11.1 | 0.28 | 16 |
| LAB493 | 66476.2 | 8.3 | 0.11 | 11 | 13.8 | 0.18 | 45 |
| LAB493 | 66476.4 | 8.1 | 0.13 | 8 | — | — | — |
| LAB487 | 66501.1 | — | — | — | 11.7 | 0.16 | 23 |
| LAB487 | 66502.4 | — | — | — | 12 | 0.09 | 26 |
| LAB487 | 66503.3 | 8.2 | 0.11 | 9 | — | — | — |
| LAB479 | 66346.2 | 8.3 | 0.04 | 11 | 13.5 | 0.01 | 41 |
| LAB479 | 66346.4 | — | — | — | 13.8 | 0.02 | 45 |
| LAB479 | 66347.1 | 8.2 | 0.15 | 9 | — | — | — |
| LAB478 | 66311.1 | — | — | — | 13.3 | 0.01 | 40 |
| LAB397 | 66359.1 | 8.5 | 0.01 | 13 | 12.8 | 0.02 | 35 |
| CONT. | — | 7.5 | — | — | 9.5 | — | — |
| LAB597 | 66272.8 | — | — | — | 14.1 | 0.07 | 31 |
| LAB597 | 66273.1 | 8.1 | 0.09 | 6 | 14.4 | L | 34 |
| LAB489 | 66722.3 | 8.1 | 0.24 | 5 | — | — | — |
| LAB447 | 66353.8 | 8.3 | 0.03 | 8 | 11.7 | 0.2 | 9 |
| LAB408 | 65930.2 | 7.9 | 0.23 | 2 | — | — | — |
| LAB408 | 65933.2 | — | — | — | 12.6 | 0.29 | 18 |
| LAB407 | 66244.2 | — | — | — | 12.5 | 0.26 | 17 |
| LAB407 | 66245.2 | — | — | — | 13.1 | 0.12 | 22 |
| CONT. | — | 7.7 | — | — | 10.7 | — | — |
| LAB591 | 65623.1 | 7.5 | 0.22 | 8 | 10.6 | 0.05 | 67 |
| LAB591 | 65624.4 | — | — | — | 7.8 | 0.09 | 23 |
| LAB582 | 66267.1 | 7.8 | 0.07 | 13 | 12.3 | 0.03 | 93 |
| LAB582 | 66268.2 | — | — | — | 9 | 0.13 | 42 |
| LAB582 | 66270.1 | 7.3 | 0.22 | 5 | 8.2 | 0.05 | 30 |
| LAB582 | 66270.2 | — | — | — | 9.5 | L | 50 |
| LAB551 | 65811.5 | — | — | — | 9 | L | 42 |

TABLE 92-continued

Genes showing improved root performance and growth at standard growth conditions (T2 generation)

| Gene Name | Event # | Roots Length [cm] Ave. | P-Val. | % Incr. | Roots Coverage [cm2] Ave. | P-Val. | % Incr. |
|---|---|---|---|---|---|---|---|
| LAB551 | 65813.2 | — | — | — | 10 | 0.05 | 57 |
| LAB538 | 66225.1 | — | — | — | 8.8 | 0.07 | 39 |
| LAB538 | 66226.4 | 8 | 0.02 | 16 | 11.2 | 0.09 | 76 |
| LAB538 | 66227.2 | 7.7 | 0.29 | 11 | 11.5 | 0.1 | 82 |
| LAB538 | 66228.2 | — | — | — | 9.3 | 0.03 | 47 |
| LAB538 | 66228.3 | 7.4 | 0.17 | 7 | 8.9 | 0.18 | 40 |
| LAB499 | 66045.1 | 7.7 | 0.03 | 12 | 9.1 | L | 44 |
| LAB499 | 66048.1 | 7.5 | 0.03 | 8 | 9.1 | 0.03 | 44 |
| LAB499 | 66048.4 | 8 | 0.02 | 15 | 12 | L | 89 |
| LAB491 | 65858.3 | 7.9 | L | 14 | 10 | 0.01 | 58 |
| LAB491 | 65859.2 | 7.7 | 0.02 | 11 | 9.2 | 0.03 | 46 |
| LAB491 | 65859.5 | 8 | 0.12 | 16 | 14.7 | 0.03 | 132 |
| LAB491 | 65861.2 | 7.6 | 0.02 | 10 | 10.5 | 0.02 | 66 |
| LAB491 | 65861.3 | 8.2 | L | 18 | 12.6 | 0.02 | 100 |
| LAB481 | 66200.2 | 7.4 | 0.21 | 8 | 10 | 0.14 | 57 |
| LAB481 | 66200.3 | 7.3 | 0.27 | 6 | 8.4 | 0.15 | 33 |
| LAB481 | 66202.1 | — | — | — | 12.1 | 0.05 | 90 |
| LAB481 | 66202.2 | 8 | L | 15 | 9.8 | 0.02 | 55 |
| LAB481 | 66203.4 | 8.1 | L | 17 | 10.1 | L | 59 |
| LAB481 | 66204.3 | — | — | — | 7.2 | 0.24 | 14 |
| LAB408 | 65930.2 | 7.5 | 0.22 | 8 | 9.7 | 0.14 | 53 |
| LAB408 | 65930.4 | — | — | — | 8.2 | 0.09 | 29 |
| LAB408 | 65932.2 | 7.6 | 0.01 | 9 | 7.5 | 0.25 | 19 |
| LAB395 | 66230.1 | — | — | — | 8.1 | 0.22 | 28 |
| LAB395 | 66232.1 | 7.5 | 0.19 | 8 | 9 | 0.08 | 43 |
| LAB395 | 66233.1 | — | — | — | 7.1 | 0.05 | 13 |
| LAB395 | 66234.1 | 7.3 | 0.15 | 6 | 8 | 0.08 | 27 |
| CONT. | — | 6.9 | — | — | 6.3 | — | — |
| LAB604 | 66496.1 | — | — | — | 10.4 | 0.1 | 26 |
| LAB575 | 66782.5 | 7.7 | 0.29 | 8 | 10.4 | 0.11 | 27 |
| LAB575 | 66783.4 | 7.6 | 0.19 | 7 | 11.1 | L | 35 |
| LAB519 | 66324.1 | 7.7 | 0.17 | 7 | 11 | 0.05 | 33 |
| LAB446 | 65090.3 | — | — | — | 10.6 | 0.16 | 28 |
| LAB439 | 65949.3 | — | — | — | 11.2 | 0.04 | 36 |
| LAB439 | 65950.1 | 7.5 | 0.23 | 5 | 9.6 | 0.23 | 16 |
| LAB438 | 66460.2 | 7.9 | 0.07 | 10 | 11.4 | 0.15 | 39 |
| LAB427 | 65539.12 | — | — | — | 11.2 | 0.1 | 36 |
| LAB427 | 65539.3 | — | — | — | 12.3 | 0.02 | 49 |
| LAB427 | 65544.1 | — | — | — | 10.5 | 0.29 | 27 |
| LAB418 | 66825.1 | — | — | — | 9.7 | 0.24 | 18 |
| LAB418 | 66825.8 | — | — | — | 10.9 | 0.2 | 32 |
| CONT. | — | 7.1 | — | — | 8.2 | — | — |
| LAB603 | 66490.2 | 7.5 | L | 16 | 7.7 | 0.06 | 33 |
| LAB603 | 66491.3 | 7.4 | 0.08 | 14 | — | — | — |
| LAB587 | 66638.1 | 7 | 0.06 | 9 | 7.4 | 0.11 | 27 |
| LAB587 | 66638.2 | 7.4 | 0.06 | 16 | 9.5 | 0.02 | 64 |
| LAB561 | 66632.3 | 7.4 | L | 15 | 7.5 | 0.05 | 29 |
| LAB561 | 66633.2 | 7.4 | 0.08 | 15 | 9 | 0.15 | 56 |
| LAB559 | 66789.2 | 7.5 | L | 17 | 7.9 | 0.03 | 36 |
| LAB559 | 66789.3 | 7.4 | L | 16 | 8 | 0.03 | 39 |
| LAB559 | 66790.3 | 6.9 | 0.24 | 7 | — | — | — |
| LAB559 | 66791.2 | 7.3 | 0.03 | 13 | 7.3 | 0.23 | 27 |
| LAB533 | 66430.5 | — | — | — | 7.9 | 0.06 | 37 |
| LAB533 | 66431.2 | — | — | — | 6.9 | 0.3 | 20 |
| LAB500 | 66482.3 | 7.6 | L | 19 | 6.9 | 0.16 | 20 |
| LAB500 | 66482.8 | 6.9 | 0.11 | 8 | — | — | — |
| LAB500 | 66485.3 | 6.9 | 0.26 | 8 | — | — | — |
| LAB489 | 66722.2 | 7.1 | 0.05 | 11 | 9.7 | 0.04 | 69 |
| LAB489 | 66723.1 | 7.7 | L | 20 | 9.2 | 0.03 | 59 |
| LAB489 | 66723.4 | 7.2 | 0.09 | 11 | 8.1 | 0.12 | 40 |
| LAB477 | 66572.1 | 7.3 | 0.05 | 14 | 7.4 | 0.13 | 28 |
| LAB477 | 66574.1 | 7.1 | 0.04 | 11 | 7.3 | 0.12 | 26 |
| LAB477 | 66576.2 | 7 | 0.19 | 8 | — | — | — |
| LAB394 | 66560.5 | 7 | 0.1 | 8 | — | — | — |
| LAB394 | 66561.2 | 6.9 | 0.12 | 7 | 7.2 | 0.09 | 25 |
| LAB394 | 66562.2 | 6.9 | 0.14 | 8 | 6.9 | 0.2 | 20 |
| LAB394 | 66565.1 | 7.4 | L | 16 | 8.5 | 0.02 | 47 |
| CONT. | — | 6.4 | — | — | 5.8 | — | — |
| LAB602 | 65828.2 | 7 | 0.18 | 14 | — | — | — |
| LAB602 | 65829.4 | 7.6 | 0.05 | 23 | 9.8 | 0.11 | 69 |
| LAB602 | 65831.1 | 7.8 | 0.01 | 26 | 8.8 | 0.19 | 52 |
| LAB598 | 66081.5 | 6.9 | 0.17 | 13 | — | — | — |
| LAB543 | 65895.1 | 7.6 | 0.05 | 23 | 8.8 | 0.28 | 52 |
| LAB543 | 65896.1 | 7.1 | 0.1 | 15 | — | — | — |
| LAB543 | 65898.1 | 7.2 | 0.06 | 17 | 6.9 | 0.25 | 20 |
| LAB486 | 65855.3 | 7.3 | 0.08 | 19 | 9.6 | 0.09 | 66 |
| LAB486 | 65856.2 | 7 | 0.13 | 13 | — | — | — |
| LAB431 | 65944.6 | 7.3 | 0.08 | 18 | — | — | — |
| LAB431 | 65945.1 | 7.3 | 0.21 | 18 | 8.2 | 0.27 | 42 |
| CONT. | — | 6.2 | — | — | 5.8 | — | — |
| LAB563 | 67029.4 | — | — | — | 6.5 | 0.24 | 15 |
| LAB563 | 67032.4 | 7.2 | 0.15 | 13 | 7.4 | 0.13 | 32 |
| LAB537 | 66330.6 | 6.9 | 0.17 | 8 | 8.6 | 0.03 | 53 |
| LAB485 | 67022.2 | — | — | — | 7 | 0.2 | 24 |
| LAB485 | 67023.1 | 7.3 | 0.03 | 14 | 8.5 | 0.03 | 52 |
| LAB485 | 67024.1 | 7.1 | 0.04 | 12 | — | — | — |
| LAB485 | 67026.2 | 7.2 | 0.05 | 12 | 8.6 | L | 52 |
| LAB473 | 66872.3 | 7.1 | 0.08 | 12 | — | — | — |
| LAB473 | 66875.1 | 7 | 0.27 | 9 | 8.5 | 0.18 | 51 |
| LAB433 | 67034.3 | — | — | — | 7.3 | 0.03 | 30 |
| LAB433 | 67036.3 | 7.3 | 0.03 | 14 | 6.5 | 0.22 | 15 |
| LAB433 | 67036.4 | 7 | 0.28 | 10 | — | — | — |
| LAB433 | 67038.4 | — | — | — | 6.8 | 0.17 | 21 |
| LAB400 | 65509.1 | 7.1 | 0.14 | 11 | — | — | — |
| LAB400 | 65509.2 | 7 | 0.12 | 9 | 6.7 | 0.28 | 20 |
| LAB400 | 65510.1 | — | — | — | 6.9 | 0.23 | 23 |
| LAB400 | 65511.2 | 7.2 | 0.11 | 13 | — | — | — |
| LAB390 | 67016.2 | — | — | — | 6.7 | 0.24 | 20 |
| LAB390 | 67017.2 | 7.5 | L | 17 | 8.7 | 0.01 | 55 |
| LAB390 | 67017.4 | 7.1 | 0.13 | 12 | 7.1 | 0.24 | 26 |
| LAB390 | 67020.1 | 7.4 | 0.03 | 17 | 8.1 | 0.08 | 44 |
| CONT. | — | 6.4 | — | — | 5.6 | — | — |
| LAB610 | 65343.3 | — | — | — | 8.3 | 0.02 | 39 |
| LAB610 | 65343.5 | 7.1 | 0.06 | 13 | — | — | — |
| LAB595 | 65270.2 | — | — | — | 8 | 0.06 | 34 |
| LAB595 | 65273.2 | — | — | — | 8 | 0.07 | 35 |
| LAB595 | 65273.3 | 7 | 0.27 | 11 | 9.8 | 0.03 | 65 |
| LAB577 | 65575.2 | — | — | — | 8.4 | 0.21 | 40 |
| LAB577 | 65578.4 | 7.2 | 0.15 | 14 | 8.7 | 0.02 | 45 |
| LAB562 | 65612.3 | 7.7 | L | 22 | 9.1 | L | 53 |
| LAB562 | 65614.4 | 6.9 | 0.25 | 9 | 7.8 | 0.16 | 31 |
| LAB505 | 65105.1 | 7.1 | 0.14 | 13 | 9.9 | L | 65 |
| LAB505 | 65108.3 | 6.8 | 0.26 | 8 | 9.1 | 0.01 | 53 |
| LAB505 | 65109.2 | 7.4 | 0.02 | 17 | 8.4 | 0.02 | 40 |
| LAB505 | 65110.4 | — | — | — | 7.6 | 0.14 | 27 |
| LAB459 | 67376.7 | — | — | — | 6.9 | 0.29 | 16 |
| LAB459 | 67379.3 | 7 | 0.14 | 10 | 8.1 | 0.08 | 35 |
| LAB435 | 67374.1 | 7.2 | 0.05 | 14 | 9.1 | 0.07 | 52 |
| LAB423 | 65527.1 | 7.3 | 0.06 | 15 | — | — | — |
| LAB423 | 65527.3 | 6.7 | 0.28 | 7 | — | — | — |
| LAB423 | 65528.2 | 7.7 | L | 23 | 9.4 | 0.02 | 57 |
| LAB423 | 65528.3 | 7.4 | 0.08 | 18 | 12.1 | L | 104 |
| CONT. | — | 6.3 | — | — | 6 | — | — |
| LAB612 | 66278.4 | 8 | 0.24 | 6 | 12.7 | 0.08 | 26 |
| LAB602 | 65828.2 | 8.2 | 0.08 | 7 | — | — | — |
| LAB598 | 66081.5 | 8.1 | 0.14 | 6 | — | — | — |
| LAB598 | 66082.2 | 8 | 0.23 | 5 | — | — | — |
| LAB592 | 65819.3 | — | — | — | 11.6 | 0.26 | 14 |
| LAB543 | 65897.2 | 8.3 | 0.04 | 9 | 13.1 | L | 29 |
| LAB486 | 65855.1 | 8.3 | 0.05 | 9 | 12.7 | 0.03 | 25 |
| LAB486 | 65855.3 | 8.4 | 0.02 | 11 | 16.5 | L | 62 |
| LAB463 | 65988.3 | — | — | — | 11.4 | 0.24 | 13 |
| LAB431 | 65943.5 | 8.1 | 0.16 | 6 | 11.8 | 0.29 | 16 |
| LAB431 | 65945.1 | 8 | 0.25 | 5 | — | — | — |
| LAB398 | 65912.6 | 7.9 | 0.27 | 4 | — | — | — |
| LAB398 | 65914.2 | 8.2 | 0.08 | 8 | — | — | — |
| CONT. | — | 7.6 | — | — | 10.1 | — | — |
| LAB451 | 66704.3 | 7.7 | 0.2 | 7 | — | — | — |
| LAB451 | 66704.5 | 7.9 | 0.27 | 9 | — | — | — |
| LAB451 | 66707.5 | 8 | 0.06 | 11 | 11.7 | 0.12 | 25 |
| LAB445 | 66464.3 | 7.8 | 0.28 | 8 | — | — | — |
| LAB420 | 66836.1 | 7.7 | 0.29 | 7 | — | — | — |

TABLE 92-continued

Genes showing improved root performance and growth at standard growth conditions (T2 generation)

| Gene Name | Event # | Roots Length [cm] Ave. | P-Val. | % Incr. | Roots Coverage [cm2] Ave. | P-Val. | % Incr. |
|---|---|---|---|---|---|---|---|
| CONT. | — | 7.2 | — | — | 9.4 | — | — |
| LAB524 | 65136.4 | — | — | — | 8.6 | 0.26 | 35 |
| LAB512 | 66734.5 | — | — | — | 7.7 | 0.18 | 20 |
| LAB512 | 66735.2 | — | — | — | 9.2 | 0.07 | 44 |
| LAB485 | 67023.1 | 7.6 | 0.02 | 14 | 8.1 | 0.09 | 27 |
| LAB473 | 66874.1 | 7.1 | 0.19 | 7 | 7.3 | 0.18 | 14 |
| LAB473 | 66874.2 | — | — | — | 9.2 | 0.1 | 44 |
| LAB473 | 66875.1 | 7.5 | 0.07 | 13 | 8.9 | 0.12 | 39 |
| LAB433 | 67036.4 | 7.4 | 0.25 | 12 | — | — | — |
| LAB390 | 67020.1 | — | — | — | 7.3 | 0.27 | 15 |
| CONT. | — | 6.7 | — | — | 6.4 | — | — |
| LAB593 | 66341.1 | — | — | — | 8.9 | 0.26 | 31 |
| LAB575 | 66784.6 | 7.2 | 0.14 | 9 | 9.1 | 0.16 | 34 |
| LAB508 | 66729.1 | — | — | — | 8.1 | 0.24 | 20 |
| LAB508 | 66729.2 | 7 | 0.17 | 7 | — | — | — |
| LAB508 | 66730.5 | 7.6 | 0.01 | 16 | 11 | 0.03 | 62 |
| LAB507 | 66794.7 | 7.6 | 0.01 | 15 | 10.9 | L | 61 |
| LAB476 | 66305.1 | — | — | — | 9.8 | 0.25 | 44 |
| LAB476 | 66306.6 | 8 | L | 21 | 13.6 | 0.01 | 101 |
| LAB476 | 66307.2 | 7.2 | 0.28 | 9 | 9.6 | L | 41 |
| LAB424 | 66710.7 | — | — | — | 9.1 | L | 33 |
| LAB424 | 66713.2 | 7.6 | 0.03 | 15 | 11 | L | 61 |
| LAB422 | 65936.2 | 7.7 | L | 17 | 9.4 | 0.02 | 38 |
| LAB422 | 65936.5 | 7.2 | 0.05 | 10 | — | — | — |
| LAB422 | 65938.3 | 8.3 | L | 25 | 12.9 | L | 90 |
| LAB422 | 65939.2 | 7.7 | 0.01 | 17 | 12.7 | L | 87 |
| LAB418 | 66825.1 | — | — | — | 8.6 | 0.14 | 26 |
| LAB412 | 66698.2 | 7.1 | 0.2 | 7 | — | — | — |
| LAB412 | 66699.1 | 7.1 | 0.06 | 8 | 9 | L | 33 |
| LAB412 | 66699.2 | 7.3 | 0.03 | 10 | 8.8 | 0.07 | 30 |
| LAB412 | 66701.2 | — | — | — | 12.2 | 0.05 | 80 |
| LAB412 | 66701.6 | 7.3 | 0.13 | 10 | — | — | — |
| CONT. | — | 6.6 | — | — | 6.8 | — | — |
| LAB607 | 65335.1 | 6.3 | 0.05 | 8 | — | — | — |
| LAB607 | 65335.3 | 6.6 | 0.06 | 13 | — | — | — |
| LAB600 | 65717.5 | 6.7 | 0.23 | 15 | 7.3 | 0.16 | 42 |
| LAB600 | 65718.1 | 6.2 | 0.02 | 6 | — | — | — |
| LAB600 | 65719.3 | 6.7 | L | 15 | — | — | — |
| LAB536 | 65148.4 | 6.3 | 0.08 | 8 | — | — | — |
| LAB501 | 65968.3 | — | — | — | 5.6 | 0.3 | 8 |
| LAB501 | 65970.1 | 6.4 | 0.21 | 9 | 7.1 | 0.03 | 38 |
| LAB501 | 65970.2 | 6.9 | L | 19 | 6.4 | 0.13 | 24 |
| LAB490 | 65864.1 | 6.6 | L | 13 | 6 | 0.23 | 16 |
| LAB490 | 65867.3 | 6.1 | 0.19 | 4 | 6.2 | 0.2 | 20 |
| LAB490 | 65868.3 | 6.2 | 0.11 | 7 | — | — | — |
| LAB482 | 66830.1 | 6.4 | 0.18 | 10 | — | — | — |
| LAB482 | 66832.1 | 6.3 | 0.17 | 9 | — | — | — |
| LAB451 | 66704.2 | 6.7 | L | 15 | — | — | — |
| LAB451 | 66704.3 | — | — | — | 7.5 | 0.23 | 46 |
| LAB451 | 66704.5 | 6.9 | 0.03 | 18 | 6.8 | 0.22 | 31 |
| LAB451 | 66707.5 | 6.6 | L | 13 | 6.2 | 0.23 | 20 |
| CONT. | — | 5.8 | — | — | 5.2 | — | — |

Table 92.
"CONT."—Control;
"Ave."—Average;
"% Incr." = % increment;
"p-val."—p-value;
L—p < 0.01.

TABLE 93

Genes showing improved root performance and growth at standard growth conditions (T1 generation)

| Gene Name | Event # | Roots Length [cm] Ave. | p-val. | % | Gene Name | Event # | Roots Coverage [cm$^2$] Ave. | p-val. | % |
|---|---|---|---|---|---|---|---|---|---|
| LAB475 | | 5 | 0.09 | 15 | LAB475 | | — | — | — |
| CONT. | | 4.4 | — | — | CONT. | | — | — | — |
| LAB469 | | 7.6 | L | 28 | LAB469 | | 8.6 | 0.01 | 48 |
| LAB461 | | 6.5 | 0.18 | 11 | LAB461 | | — | — | — |
| LAB429 | | 7 | 0.01 | 19 | LAB429 | | 7.1 | 0.2 | 22 |
| LAB417 | | 6.5 | 0.09 | 11 | LAB417 | | — | — | — |
| CONT. | | 5.9 | — | — | CONT. | | 5.9 | — | — |
| LAB391 | | 5.8 | 0.14 | 9 | LAB391 | | 5.1 | 0.09 | 25 |
| CONT. | | 5.3 | — | — | CONT. | | 4.1 | — | — |

Table 93.
"CONT."—Control;
"Ave."—Average;
"% Incr." = % increment;
"p-val."—p-value; L - p < 0.01.

The genes listed in Tables 94-95 improved plant growth rate (leaf area, root length and root coverage growth rate) when grown at standard growth conditions. These produced plants that grew faster than control plants when grown under standard growth conditions. Faster growth was observed when growth rate of leaf area and root length and coverage was measured. The genes were cloned under the regulation of a constitutive promoter (At6669; SEQ ID NO:7724). Evaluation of each gene was performed by testing the performance of different number of events. Some of the genes were evaluated in more than one tissue culture assay resulting in positive results as well. Event with p-value <0.1 was considered statistically significant.

TABLE 94

Genes showing improved plant performance and growth rate at standard growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LAB607 | 65335.1 | 0.1 | 0.02 | 52 | 1.1 | L | 76 | 0.7 | 0.08 | 17 |
| LAB607 | 65336.1 | — | — | — | 1.0 | L | 55 | 0.7 | 0.13 | 15 |
| LAB600 | 65717.5 | — | — | — | 1.0 | 0.02 | 50 | — | — | — |
| LAB600 | 65718.2 | — | — | — | 0.8 | 0.20 | 24 | — | — | — |
| LAB600 | 65719.3 | 0.1 | 0.06 | 38 | 1.1 | L | 69 | 0.8 | 0.04 | 20 |
| LAB536 | 65148.1 | 0.1 | 0.13 | 29 | 0.8 | 0.18 | 30 | — | — | — |
| LAB501 | 65966.3 | 0.1 | 0.02 | 46 | 0.9 | 0.03 | 45 | 0.7 | 0.11 | 16 |
| LAB490 | 65868.3 | — | — | — | 0.9 | 0.10 | 33 | — | — | — |
| LAB490 | 65868.5 | — | — | — | 1.0 | L | 56 | — | — | — |
| CONT. | — | 0.0 | — | — | 0.6 | — | — | 0.6 | — | — |
| LAB591 | 65624.4 | — | — | — | 1.3 | 0.13 | 15 | 0.8 | 0.23 | 9 |
| LAB591 | 65627.1 | 0.1 | 0.30 | 11 | — | — | — | 0.8 | 0.26 | 9 |
| LAB591 | 65627.3 | — | — | — | — | — | — | 0.8 | 0.10 | 13 |
| LAB582 | 66267.1 | 0.1 | 0.22 | 14 | 1.6 | L | 37 | 0.8 | 0.20 | 12 |
| LAB538 | 66225.1 | 0.1 | 0.08 | 17 | — | — | — | — | — | — |
| LAB538 | 66226.3 | — | — | — | — | — | — | 0.8 | 0.20 | 10 |
| LAB538 | 66226.4 | — | — | — | — | — | — | 0.8 | 0.20 | 11 |
| LAB538 | 66228.2 | — | — | — | 1.3 | 0.18 | 12 | 0.8 | 0.11 | 14 |
| LAB499 | 66044.1 | 0.1 | 0.29 | 10 | 1.3 | 0.20 | 14 | — | — | — |
| LAB499 | 66044.3 | — | — | — | 1.3 | 0.22 | 13 | 0.8 | 0.08 | 14 |
| LAB499 | 66045.1 | — | — | — | 1.3 | 0.22 | 15 | — | — | — |
| LAB499 | 66047.1 | 0.1 | 0.16 | 22 | 1.3 | 0.26 | 13 | 0.8 | 0.15 | 12 |
| LAB499 | 66048.1 | 0.1 | 0.12 | 14 | 1.5 | L | 30 | 0.8 | 0.26 | 10 |
| LAB491 | 65858.3 | — | — | — | 1.4 | 0.02 | 23 | — | — | — |
| LAB491 | 65859.1 | 0.1 | L | 58 | 2.0 | L | 69 | 0.9 | 0.05 | 19 |
| LAB491 | 65859.5 | 0.1 | L | 51 | 1.7 | L | 49 | 0.9 | 0.04 | 18 |
| LAB491 | 65861.2 | 0.1 | L | 75 | 1.8 | L | 59 | 0.8 | 0.21 | 12 |
| LAB481 | 66202.2 | 0.1 | L | 31 | 1.5 | L | 30 | — | — | — |
| LAB481 | 66203.4 | — | — | — | 1.3 | 0.29 | 10 | — | — | — |
| LAB408 | 65930.4 | 0.1 | 0.15 | 12 | — | — | — | — | — | — |
| LAB408 | 65933.1 | 0.1 | 0.09 | 16 | 1.3 | 0.12 | 15 | — | — | — |
| LAB408 | 65933.2 | 0.1 | 0.04 | 28 | 1.7 | L | 44 | 0.8 | 0.27 | 12 |
| LAB395 | 66231.2 | — | — | — | — | — | — | 0.8 | 0.09 | 14 |
| LAB395 | 66233.1 | — | — | — | 1.3 | 0.21 | 13 | 0.8 | 0.27 | 10 |
| LAB395 | 66234.1 | 0.1 | L | 31 | 1.5 | L | 30 | 0.9 | 0.01 | 22 |
| CONT. | — | 0.1 | — | — | 1.2 | — | — | 0.7 | — | — |
| LAB603 | 66489.1 | 0.1 | 0.06 | 32 | — | — | — | — | — | — |
| LAB603 | 66490.2 | — | — | — | 1.2 | 0.04 | 32 | — | — | — |
| LAB587 | 66638.1 | 0.1 | 0.06 | 26 | — | — | — | — | — | — |
| LAB587 | 66638.2 | 0.1 | 0.02 | 29 | 1.2 | 0.07 | 29 | — | — | — |
| LAB587 | 66639.3 | 0.1 | 0.02 | 30 | 1.2 | 0.10 | 26 | — | — | — |
| LAB561 | 66632.2 | 0.1 | 0.11 | 22 | 1.1 | 0.19 | 21 | — | — | — |
| LAB561 | 66632.3 | 0.1 | L | 54 | 1.3 | 0.04 | 47 | 0.8 | 0.24 | 12 |
| LAB561 | 66633.3 | 0.1 | 0.20 | 18 | 1.2 | 0.10 | 27 | — | — | — |
| LAB533 | 66429.1 | 0.1 | 0.04 | 43 | 1.3 | 0.09 | 42 | — | — | — |
| LAB533 | 66430.1 | 0.1 | 0.12 | 20 | — | — | — | — | — | — |
| LAB533 | 66430.5 | — | — | — | 1.2 | 0.06 | 27 | — | — | — |
| LAB533 | 66431.2 | 0.1 | 0.04 | 34 | 1.1 | 0.14 | 24 | — | — | — |
| LAB500 | 66485.2 | 0.1 | L | 44 | 1.2 | 0.09 | 29 | 0.9 | 0.06 | 20 |
| LAB478 | 66310.3 | 0.1 | L | 40 | 1.3 | 0.05 | 40 | 0.8 | 0.16 | 15 |
| LAB477 | 66576.1 | 0.1 | 0.18 | 17 | — | — | — | — | — | — |
| LAB477 | 66576.2 | 0.1 | 0.22 | 16 | — | — | — | — | — | — |
| LAB397 | 66356.2 | 0.1 | 0.01 | 44 | 1.4 | 0.04 | 53 | — | — | — |
| LAB397 | 66359.1 | — | — | — | 1.1 | 0.20 | 18 | — | — | — |
| LAB397 | 66359.2 | 0.1 | 0.20 | 16 | — | — | — | — | — | — |
| LAB397 | 66360.5 | 0.1 | L | 40 | 1.4 | L | 53 | 0.9 | 0.05 | 20 |
| CONT. | — | 0.1 | — | — | 0.9 | — | — | 0.7 | — | — |
| LAB608 | 65906.1 | 0.1 | 0.17 | 27 | 1.0 | 0.02 | 55 | 0.7 | 0.08 | 21 |
| LAB608 | 65907.2 | 0.1 | 0.02 | 43 | 1.1 | L | 74 | — | — | — |
| LAB608 | 65907.3 | 0.1 | L | 102 | 1.4 | L | 114 | 0.8 | L | 34 |
| LAB608 | 65909.2 | — | — | — | 0.8 | 0.26 | 19 | 0.7 | L | 27 |
| LAB578 | 65581.2 | 0.1 | L | 86 | 1.3 | L | 105 | 0.8 | L | 33 |
| LAB578 | 65581.3 | — | — | — | 0.8 | 0.18 | 26 | 0.7 | 0.06 | 20 |
| LAB578 | 65582.6 | 0.1 | 0.26 | 19 | 0.8 | 0.08 | 32 | 0.7 | 0.02 | 25 |
| LAB578 | 65583.2 | — | — | — | — | — | — | 0.7 | 0.04 | 21 |
| LAB523 | 65660.3 | 0.1 | L | 76 | 1.2 | L | 91 | 0.8 | L | 36 |
| LAB523 | 65661.2 | 0.1 | L | 66 | 0.9 | 0.02 | 46 | — | — | — |
| LAB523 | 65663.1 | 0.1 | 0.22 | 24 | 0.9 | 0.16 | 33 | 0.7 | 0.17 | 18 |
| LAB523 | 65663.3 | — | — | — | 0.9 | 0.08 | 34 | 0.7 | 0.01 | 27 |
| LAB512 | 66734.5 | 0.1 | 0.10 | 38 | — | — | — | 0.7 | 0.17 | 15 |
| LAB512 | 66735.2 | — | — | — | — | — | — | 0.7 | 0.21 | 12 |

TABLE 94-continued

Genes showing improved plant performance and growth rate at standard growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LAB512 | 66739.1 | 0.1 | L | 55 | 1.0 | L | 62 | 0.7 | 0.06 | 22 |
| LAB512 | 66739.4 | 0.1 | 0.07 | 31 | 0.8 | 0.12 | 30 | 0.7 | 0.05 | 21 |
| LAB512 | 66739.5 | — | — | — | — | — | — | 0.6 | 0.25 | 11 |
| LAB488 | 66819.1 | 0.1 | 0.16 | 27 | 0.9 | 0.03 | 39 | 0.7 | 0.06 | 20 |
| LAB488 | 66821.2 | — | — | — | — | — | — | 0.7 | 0.14 | 15 |
| LAB488 | 66822.4 | 0.1 | L | 79 | 1.2 | L | 91 | 0.8 | L | 36 |
| LAB488 | 66822.5 | 0.1 | 0.03 | 43 | 0.8 | 0.17 | 24 | — | — | — |
| LAB450 | 65305.3 | — | — | — | 0.8 | 0.26 | 22 | 0.7 | 0.17 | 15 |
| LAB450 | 65306.1 | — | — | — | — | — | — | 0.6 | 0.28 | 11 |
| LAB450 | 65306.2 | 0.1 | 0.23 | 22 | 0.8 | 0.23 | 23 | 0.7 | 0.15 | 16 |
| LAB450 | 65309.1 | — | — | — | — | — | — | 0.7 | 0.05 | 22 |
| LAB449 | 65095.1 | — | — | — | 1.0 | 0.02 | 49 | 0.7 | 0.02 | 26 |
| LAB449 | 65096.1 | 0.1 | 0.21 | 23 | 0.9 | 0.08 | 37 | 0.8 | L | 40 |
| LAB449 | 65098.4 | — | — | — | 0.8 | 0.11 | 30 | 0.7 | 0.02 | 23 |
| LAB449 | 65098.5 | 0.1 | 0.05 | 34 | 1.0 | L | 53 | 0.8 | L | 34 |
| LAB449 | 65099.4 | 0.1 | 0.13 | 29 | 1.0 | L | 56 | — | — | — |
| LAB428 | 65079.1 | — | — | — | 0.9 | 0.08 | 34 | 0.7 | 0.05 | 21 |
| LAB428 | 65079.2 | 0.1 | L | 75 | 1.2 | L | 83 | 0.7 | 0.07 | 20 |
| LAB420 | 66836.1 | — | — | — | — | — | — | 0.7 | 0.22 | 13 |
| LAB420 | 66836.3 | — | — | — | — | — | — | 0.6 | 0.27 | 11 |
| LAB420 | 66837.1 | 0.1 | 0.06 | 39 | 1.0 | L | 52 | 0.7 | L | 29 |
| LAB420 | 66837.2 | 0.1 | 0.01 | 57 | 1.1 | L | 71 | 0.7 | 0.03 | 24 |
| LAB420 | 66838.2 | — | — | — | — | — | — | 0.7 | 0.07 | 19 |
| CONT. | — | 0.0 | — | — | 0.6 | — | — | 0.6 | — | — |
| LAB612 | 66278.4 | — | — | — | 0.9 | 0.06 | 40 | — | — | — |
| LAB612 | 66280.3 | — | — | — | — | — | — | 0.7 | 0.06 | 21 |
| LAB612 | 66282.2 | — | — | — | — | — | — | 0.7 | 0.02 | 25 |
| LAB612 | 66282.4 | — | — | — | 1.0 | L | 47 | 0.7 | 0.02 | 24 |
| LAB601 | 66506.1 | — | — | — | 0.9 | 0.03 | 34 | — | — | — |
| LAB601 | 66510.4 | 0.1 | 0.05 | 41 | 1.2 | L | 80 | 0.7 | 0.02 | 26 |
| LAB586 | 65587.2 | 0.1 | 0.27 | 25 | 0.8 | 0.21 | 21 | — | — | — |
| LAB586 | 65588.2 | — | — | — | — | — | — | 0.7 | 0.11 | 18 |
| LAB586 | 65589.3 | — | — | — | 0.8 | 0.27 | 22 | — | — | — |
| LAB586 | 65590.2 | 0.1 | L | 73 | 1.4 | L | 105 | 0.8 | L | 38 |
| LAB495 | 66314.4 | — | — | — | 1.0 | 0.04 | 55 | 0.7 | L | 29 |
| LAB495 | 66315.1 | — | — | — | 0.9 | 0.06 | 33 | — | — | — |
| LAB495 | 66315.4 | — | — | — | 1.0 | L | 54 | 0.6 | 0.15 | 14 |
| LAB495 | 66315.8 | — | — | — | 0.9 | 0.09 | 28 | 0.7 | 0.02 | 25 |
| LAB495 | 66316.2 | — | — | — | 1.0 | L | 53 | 0.6 | 0.15 | 17 |
| LAB493 | 66476.2 | — | — | — | 0.9 | 0.03 | 34 | 0.7 | 0.03 | 24 |
| LAB493 | 66476.4 | — | — | — | 1.0 | 0.01 | 55 | 0.7 | 0.09 | 20 |
| LAB493 | 66477.1 | — | — | — | — | — | — | 0.7 | 0.05 | 19 |
| LAB493 | 66477.4 | — | — | — | — | — | — | 0.6 | 0.30 | 12 |
| LAB493 | 66479.3 | — | — | — | — | — | — | 0.6 | 0.22 | 14 |
| LAB487 | 66501.1 | 0.1 | 0.18 | 26 | 0.9 | 0.01 | 40 | — | — | — |
| LAB487 | 66501.2 | — | — | — | 0.9 | 0.26 | 39 | 0.7 | 0.22 | 18 |
| LAB487 | 66502.4 | — | — | — | 0.8 | 0.18 | 26 | — | — | — |
| LAB487 | 66503.3 | 0.1 | 0.22 | 30 | 1.1 | 0.06 | 61 | — | — | — |
| LAB463 | 65988.1 | — | — | — | — | — | — | 0.6 | 0.22 | 12 |
| LAB463 | 65988.2 | — | — | — | 0.9 | 0.14 | 26 | — | — | — |
| LAB463 | 65988.3 | — | — | — | 0.8 | 0.17 | 21 | 0.6 | 0.18 | 14 |
| LAB398 | 65913.3 | — | — | — | — | — | — | 0.6 | 0.23 | 12 |
| LAB393 | 66285.4 | 0.1 | L | 64 | 1.3 | L | 89 | 0.7 | L | 32 |
| LAB393 | 66286.2 | — | — | — | 0.8 | 0.20 | 25 | — | — | — |
| LAB393 | 66287.1 | — | — | — | 0.8 | 0.15 | 23 | 0.6 | 0.13 | 16 |
| CONT. | — | 0.1 | — | — | 0.7 | — | — | 0.6 | — | — |
| LAB472 | 66718.7 | — | — | — | — | — | — | 0.7 | 0.30 | 9 |
| LAB472 | 66719.3 | — | — | — | — | — | — | 0.7 | 0.08 | 18 |
| LAB470 | 66627.2 | — | — | — | — | — | — | 0.7 | 0.05 | 17 |
| LAB470 | 66629.3 | — | — | — | — | — | — | 0.7 | 0.24 | 11 |
| LAB470 | 66630.1 | 0.1 | 0.07 | 37 | 1.5 | L | 68 | 0.7 | 0.12 | 16 |
| LAB470 | 66630.4 | 0.1 | 0.06 | 31 | 1.3 | 0.01 | 47 | 0.7 | 0.09 | 16 |
| LAB466 | 66620.4 | — | — | — | — | — | — | 0.7 | 0.26 | 11 |
| LAB466 | 66621.2 | 0.1 | L | 77 | 1.7 | L | 91 | 0.7 | 0.25 | 12 |
| LAB466 | 66622.2 | 0.1 | 0.05 | 31 | 1.1 | 0.20 | 25 | 0.8 | 0.01 | 26 |
| LAB466 | 66622.5 | — | — | — | — | — | — | 0.7 | 0.13 | 14 |
| LAB462 | 66617.1 | 0.1 | 0.29 | 18 | — | — | — | — | — | — |
| LAB462 | 66618.2 | — | — | — | — | — | — | 0.7 | 0.15 | 13 |
| LAB454 | 66813.3 | — | — | — | — | — | — | 0.7 | 0.05 | 19 |
| LAB454 | 66813.4 | 0.1 | 0.10 | 24 | — | — | — | — | — | — |
| LAB454 | 66813.5 | — | — | — | 1.1 | 0.28 | 20 | — | — | — |

TABLE 94-continued

Genes showing improved plant performance and growth rate at standard growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LAB412 | 66699.2 | 0.1 | 0.03 | 46 | 1.5 | L | 63 | 0.8 | L | 33 |
| LAB412 | 66701.2 | 0.1 | 0.06 | 31 | 1.2 | 0.11 | 30 | 0.7 | 0.17 | 14 |
| LAB404 | 66779.10 | — | — | — | 1.2 | 0.13 | 37 | 0.8 | L | 24 |
| LAB403 | 66800.3 | — | — | — | — | — | — | 0.7 | 0.18 | 12 |
| LAB403 | 66804.5 | 0.1 | 0.09 | 34 | 1.3 | 0.04 | 48 | 0.7 | 0.05 | 19 |
| LAB403 | 66804.8 | — | — | — | 1.1 | 0.17 | 26 | — | — | — |
| CONT. | — | 0.1 | — | — | 0.9 | — | — | 0.6 | — | — |
| LAB516 | 65870.2 | 0.1 | L | 57 | 1.6 | L | 75 | 0.8 | 0.16 | 10 |
| LAB516 | 65871.3 | 0.1 | 0.14 | 30 | — | — | — | — | — | — |
| LAB511 | 66257.1 | 0.1 | 0.08 | 55 | 1.2 | 0.26 | 28 | — | — | — |
| LAB506 | 65111.7 | 0.1 | 0.11 | 34 | — | — | — | 0.8 | 0.14 | 10 |
| LAB475 | 67390.1 | 0.1 | 0.02 | 53 | 1.5 | L | 61 | 0.8 | 0.13 | 10 |
| LAB475 | 67390.2 | 0.1 | 0.27 | 24 | 1.2 | 0.07 | 33 | — | — | — |
| LAB474 | 66470.2 | — | — | — | — | — | — | 0.8 | 0.10 | 10 |
| LAB474 | 66470.4 | 0.1 | 0.04 | 49 | 1.1 | 0.14 | 26 | — | — | — |
| LAB474 | 66470.8 | 0.1 | 0.03 | 55 | 1.2 | 0.09 | 31 | 0.8 | 0.11 | 9 |
| LAB459 | 67376.3 | 0.1 | 0.29 | 22 | — | — | — | 0.8 | 0.07 | 11 |
| LAB459 | 67376.7 | 0.1 | 0.15 | 29 | 1.2 | 0.06 | 32 | 0.7 | 0.20 | 7 |
| LAB459 | 67379.3 | — | — | — | 1.1 | 0.23 | 21 | 0.8 | 0.11 | 9 |
| LAB459 | 67380.1 | — | — | — | 1.1 | 0.28 | 19 | 0.8 | 0.02 | 13 |
| LAB457 | 65100.1 | 0.1 | L | 64 | 1.2 | 0.07 | 32 | 0.8 | 0.03 | 12 |
| LAB457 | 65100.2 | — | — | — | 1.1 | 0.25 | 19 | — | — | — |
| CONT. | — | 0.1 | — | — | 0.9 | — | — | 0.7 | — | — |
| LAB601 | 66510.4 | — | — | — | 1.5 | 0.21 | 24 | — | — | — |
| LAB586 | 65587.2 | 0.1 | 0.02 | 33 | — | — | — | — | — | — |
| LAB586 | 65588.2 | 0.1 | 0.23 | 15 | 1.5 | 0.13 | 30 | — | — | — |
| LAB586 | 65589.3 | — | — | — | 1.4 | 0.25 | 22 | — | — | — |
| LAB537 | 66329.2 | 0.1 | 0.27 | 14 | — | — | — | — | — | — |
| LAB537 | 66330.6 | 0.1 | 0.29 | 14 | — | — | — | — | — | — |
| LAB493 | 66476.2 | 0.1 | 0.26 | 18 | 1.7 | 0.07 | 45 | 0.9 | 0.23 | 11 |
| LAB487 | 66501.1 | 0.1 | 0.28 | 13 | 1.5 | 0.22 | 25 | — | — | — |
| LAB487 | 66502.4 | — | — | — | 1.5 | 0.17 | 28 | 0.9 | 0.24 | 10 |
| LAB479 | 66346.2 | — | — | — | 1.7 | 0.04 | 41 | — | — | — |
| LAB479 | 66346.4 | 0.1 | 0.11 | 22 | 1.7 | 0.03 | 46 | — | — | — |
| LAB479 | 66347.1 | — | — | — | 1.5 | 0.25 | 25 | 0.9 | 0.25 | 9 |
| LAB478 | 66311.1 | 0.1 | 0.06 | 25 | 1.6 | 0.05 | 40 | — | — | — |
| LAB397 | 66359.1 | 0.1 | 0.25 | 16 | 1.6 | 0.08 | 34 | 0.9 | 0.28 | 8 |
| CONT. | — | 0.1 | — | — | 1.2 | — | — | 0.8 | — | — |
| LAB597 | 66272.8 | — | — | — | 1.7 | 0.02 | 31 | — | — | — |
| LAB597 | 66273.1 | 0.1 | L | 37 | 1.8 | L | 34 | — | — | — |
| LAB408 | 65933.2 | 0.1 | 0.17 | 22 | 1.6 | 0.20 | 18 | — | — | — |
| LAB407 | 66244.2 | — | — | — | 1.5 | 0.21 | 16 | — | — | — |
| LAB407 | 66245.2 | — | — | — | 1.6 | 0.10 | 21 | — | — | — |
| CONT. | — | 0.1 | — | — | 1.3 | — | — | — | — | — |
| LAB591 | 65623.1 | — | — | — | 1.3 | L | 67 | — | — | — |
| LAB591 | 65624.1 | — | — | — | 0.9 | 0.26 | 18 | — | — | — |
| LAB591 | 65624.4 | — | — | — | 1.0 | 0.08 | 23 | — | — | — |
| LAB582 | 66267.1 | 0.1 | L | 60 | 1.5 | L | 94 | 0.9 | 0.13 | 12 |
| LAB582 | 66268.2 | 0.1 | 0.13 | 23 | 1.1 | 0.02 | 42 | — | — | — |
| LAB582 | 66270.1 | 0.1 | 0.13 | 19 | 1.0 | 0.03 | 30 | — | — | — |
| LAB582 | 66270.2 | — | — | — | 1.1 | L | 47 | — | — | — |
| LAB551 | 65811.5 | — | — | — | 1.1 | L | 42 | — | — | — |
| LAB551 | 65813.2 | 0.1 | 0.12 | 20 | 1.2 | L | 57 | — | — | — |
| LAB538 | 66225.1 | — | — | — | 1.1 | 0.01 | 38 | — | — | — |
| LAB538 | 66226.4 | 0.1 | 0.02 | 37 | 1.4 | L | 75 | 0.8 | 0.21 | 10 |
| LAB538 | 66227.2 | 0.1 | L | 43 | 1.4 | L | 83 | 0.9 | 0.13 | 14 |
| LAB538 | 66228.2 | 0.1 | 0.13 | 18 | 1.1 | L | 47 | — | — | — |
| LAB538 | 66228.3 | — | — | — | 1.1 | 0.04 | 39 | — | — | — |
| LAB499 | 66045.1 | 0.1 | 0.27 | 14 | 1.1 | L | 41 | — | — | — |
| LAB499 | 66048.1 | — | — | — | 1.1 | L | 43 | — | — | — |
| LAB499 | 66048.4 | 0.1 | 0.01 | 35 | 1.5 | L | 88 | 0.9 | 0.15 | 10 |
| LAB491 | 65858.3 | 0.1 | 0.19 | 16 | 1.2 | L | 58 | — | — | — |
| LAB491 | 65859.2 | 0.1 | 0.07 | 22 | 1.1 | L | 45 | 0.8 | 0.29 | 7 |
| LAB491 | 65859.5 | 0.1 | L | 91 | 1.8 | L | 131 | — | — | — |
| LAB491 | 65861.2 | 0.1 | L | 37 | 1.3 | L | 65 | — | — | — |
| LAB491 | 65861.3 | 0.1 | L | 49 | 1.6 | L | 99 | 0.9 | 0.09 | 12 |
| LAB481 | 66200.2 | 0.1 | 0.04 | 31 | 1.2 | L | 58 | 0.8 | 0.26 | 8 |
| LAB481 | 66200.3 | — | — | — | 1.0 | 0.04 | 31 | — | — | — |
| LAB481 | 66202.1 | 0.1 | 0.05 | 31 | 1.5 | L | 89 | — | — | — |
| LAB481 | 66202.2 | — | — | — | 1.2 | L | 54 | 0.9 | 0.11 | 11 |
| LAB481 | 66203.4 | 0.1 | 0.04 | 33 | 1.2 | L | 57 | — | — | — |

TABLE 94-continued

Genes showing improved plant performance and growth rate at standard growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LAB408 | 65930.2 | — | — | — | 1.2 | 0.01 | 52 | — | — | — |
| LAB408 | 65930.4 | 0.1 | 0.08 | 23 | 1.0 | 0.06 | 28 | — | — | — |
| LAB408 | 65932.2 | — | — | — | 0.9 | 0.26 | 16 | — | — | — |
| LAB395 | 66230.1 | 0.1 | 0.14 | 26 | 1.0 | 0.08 | 27 | — | — | — |
| LAB395 | 66232.1 | — | — | — | 1.1 | 0.01 | 38 | — | — | — |
| LAB395 | 66234.1 | — | — | — | 1.0 | 0.07 | 26 | — | — | — |
| CONT. | — | 0.1 | — | — | 0.8 | — | — | 0.8 | — | — |
| LAB604 | 66495.4 | — | — | — | — | — | — | 0.8 | 0.24 | 9 |
| LAB604 | 66496.1 | 0.1 | 0.24 | 24 | 1.3 | 0.09 | 25 | — | — | — |
| LAB575 | 66782.5 | — | — | — | 1.3 | 0.09 | 27 | — | — | — |
| LAB575 | 66783.4 | 0.1 | 0.01 | 51 | 1.4 | 0.01 | 36 | 0.8 | 0.02 | 17 |
| LAB519 | 66324.1 | 0.1 | 0.06 | 41 | 1.3 | 0.04 | 33 | — | — | — |
| LAB446 | 65090.3 | 0.1 | 0.27 | 24 | 1.3 | 0.08 | 28 | — | — | — |
| LAB439 | 65948.2 | 0.1 | 0.26 | 23 | — | — | — | — | — | — |
| LAB439 | 65949.3 | 0.1 | 0.15 | 29 | 1.4 | 0.03 | 35 | — | — | — |
| LAB439 | 65950.1 | — | — | — | 1.2 | 0.27 | 16 | — | — | — |
| LAB438 | 66460.2 | 0.1 | 0.14 | 31 | 1.4 | 0.04 | 39 | 0.8 | 0.12 | 11 |
| LAB427 | 65539.12 | 0.1 | 0.12 | 32 | 1.4 | 0.04 | 36 | — | — | — |
| LAB427 | 65539.3 | 0.1 | L | 55 | 1.5 | L | 52 | 0.8 | 0.01 | 19 |
| LAB427 | 65544.1 | 0.1 | 0.29 | 26 | 1.3 | 0.13 | 28 | — | — | — |
| LAB418 | 66825.10 | — | — | — | 1.2 | 0.22 | 18 | — | — | — |
| LAB418 | 66825.8 | 0.1 | 0.15 | 36 | 1.3 | 0.07 | 34 | — | — | — |
| CONT. | — | 0.1 | — | — | 1.0 | — | — | 0.7 | — | — |
| LAB603 | 66490.2 | — | — | — | 0.9 | 0.09 | 32 | — | — | — |
| LAB587 | 66638.1 | 0.1 | 0.12 | 27 | 0.9 | 0.13 | 29 | 0.8 | 0.06 | 19 |
| LAB587 | 66638.2 | 0.1 | 0.02 | 45 | 1.2 | L | 64 | 0.8 | 0.10 | 17 |
| LAB587 | 66641.2 | — | — | — | — | — | — | 0.8 | 0.29 | 11 |
| LAB561 | 66632.3 | 0.1 | 0.19 | 21 | 0.9 | 0.12 | 28 | 0.8 | 0.27 | 11 |
| LAB561 | 66633.2 | 0.1 | 0.06 | 42 | 1.1 | 0.03 | 55 | — | — | — |
| LAB559 | 66789.2 | — | — | — | 1.0 | 0.06 | 34 | — | — | — |
| LAB559 | 66789.3 | 0.1 | 0.27 | 18 | 1.0 | 0.05 | 39 | 0.8 | 0.14 | 15 |
| LAB559 | 66791.2 | — | — | — | 0.9 | 0.22 | 25 | — | — | — |
| LAB533 | 66430.5 | — | — | — | 1.0 | 0.07 | 36 | — | — | — |
| LAB500 | 66482.3 | 0.1 | 0.20 | 21 | — | — | — | 0.8 | 0.13 | 16 |
| LAB500 | 66482.8 | 0.1 | 0.19 | 21 | — | — | — | — | — | — |
| LAB489 | 66722.2 | 0.1 | 0.04 | 35 | 1.2 | L | 68 | — | — | — |
| LAB489 | 66723.1 | 0.1 | 0.14 | 32 | 1.1 | L | 59 | 0.8 | 0.17 | 14 |
| LAB489 | 66723.4 | — | — | — | 1.0 | 0.06 | 40 | 0.8 | 0.24 | 12 |
| LAB477 | 66572.1 | — | — | — | 0.9 | 0.14 | 29 | 0.8 | 0.22 | 13 |
| LAB477 | 66574.1 | — | — | — | 0.9 | 0.16 | 26 | 0.8 | 0.12 | 16 |
| LAB394 | 66561.2 | — | — | — | 0.9 | 0.23 | 22 | — | — | — |
| LAB394 | 66565.1 | — | — | — | 1.0 | 0.02 | 46 | 0.8 | 0.23 | 12 |
| CONT. | — | 0.1 | — | — | 0.7 | — | — | 0.7 | — | — |
| LAB602 | 65828.2 | 0.1 | 0.19 | 28 | — | — | — | 0.7 | 0.08 | 27 |
| LAB602 | 65829.4 | 0.1 | 0.08 | 45 | 1.1 | 0.02 | 71 | 0.7 | 0.09 | 27 |
| LAB602 | 65831.1 | 0.1 | 0.21 | 27 | 1.1 | 0.06 | 57 | 0.8 | 0.02 | 36 |
| LAB592 | 65816.1 | — | — | — | — | — | — | 0.7 | 0.19 | 19 |
| LAB592 | 65816.3 | 0.1 | 0.15 | 30 | — | — | — | 0.7 | 0.15 | 23 |
| LAB592 | 65820.1 | — | — | — | — | — | — | 0.7 | 0.30 | 16 |
| LAB543 | 65895.1 | 0.1 | 0.14 | 34 | 1.0 | 0.11 | 52 | 0.7 | 0.24 | 19 |
| LAB543 | 65898.1 | — | — | — | — | — | — | 0.7 | 0.10 | 24 |
| LAB486 | 65855.3 | 0.1 | 0.08 | 50 | 1.1 | 0.03 | 69 | 0.7 | 0.14 | 24 |
| LAB486 | 65856.2 | — | — | — | — | — | — | 0.7 | 0.07 | 26 |
| LAB431 | 65943.5 | — | — | — | — | — | — | 0.7 | 0.09 | 25 |
| LAB431 | 65944.6 | 0.1 | 0.20 | 26 | 0.9 | 0.18 | 37 | 0.7 | 0.06 | 28 |
| LAB431 | 65945.1 | — | — | — | 1.0 | 0.12 | 47 | 0.7 | 0.16 | 24 |
| CONT. | — | 0.0 | — | — | 0.7 | — | — | 0.6 | — | — |
| LAB563 | 67029.4 | 0.1 | 0.04 | 28 | — | — | — | — | — | — |
| LAB563 | 67032.4 | 0.0 | 0.24 | 14 | 0.9 | 0.08 | 33 | 0.7 | 0.19 | 15 |
| LAB537 | 66329.2 | 0.1 | 0.05 | 24 | — | — | — | — | — | — |
| LAB537 | 66330.6 | 0.1 | L | 53 | 1.1 | L | 57 | 0.8 | 0.06 | 21 |
| LAB537 | 66331.3 | 0.1 | 0.14 | 24 | — | — | — | — | — | — |
| LAB485 | 67022.2 | 0.0 | 0.19 | 17 | 0.8 | 0.17 | 24 | — | — | — |
| LAB485 | 67023.1 | — | — | — | 1.0 | L | 53 | — | — | — |
| LAB485 | 67024.2 | 0.0 | 0.30 | 14 | — | — | — | — | — | — |
| LAB485 | 67026.2 | 0.1 | L | 51 | 1.0 | L | 53 | 0.7 | 0.20 | 15 |
| LAB473 | 66873.3 | 0.1 | 0.14 | 23 | — | — | — | — | — | — |
| LAB473 | 66875.1 | 0.1 | 0.23 | 27 | 1.0 | 0.03 | 52 | — | — | — |
| LAB433 | 67034.3 | 0.1 | L | 41 | 0.9 | 0.06 | 32 | 0.7 | 0.12 | 17 |
| LAB433 | 67036.3 | — | — | — | — | — | — | 0.7 | 0.19 | 14 |
| LAB433 | 67038.4 | 0.0 | 0.13 | 21 | 0.8 | 0.17 | 23 | — | — | — |

TABLE 94-continued

Genes showing improved plant performance and growth rate at standard growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LAB433 | 67038.5 | 0.1 | L | 37 | — | — | — | — | — | — |
| LAB400 | 65509.2 | 0.1 | 0.18 | 23 | 0.8 | 0.27 | 19 | — | — | — |
| LAB400 | 65510.1 | 0.0 | 0.22 | 18 | 0.8 | 0.18 | 23 | — | — | — |
| LAB400 | 65511.2 | — | — | — | 0.8 | 0.29 | 23 | — | — | — |
| LAB393 | 66286.1 | 0.1 | L | 44 | — | — | — | — | — | — |
| LAB390 | 67016.2 | 0.1 | 0.07 | 27 | 0.8 | 0.21 | 22 | — | — | — |
| LAB390 | 67017.2 | 0.1 | L | 45 | 1.1 | L | 56 | 0.7 | 0.18 | 15 |
| LAB390 | 67017.4 | 0.0 | 0.21 | 17 | 0.9 | 0.14 | 27 | — | — | — |
| LAB390 | 67020.1 | 0.1 | 0.09 | 25 | 1.0 | 0.03 | 45 | 0.7 | 0.08 | 20 |
| CONT. | — | 0.0 | — | — | 0.7 | — | — | 0.6 | — | — |
| LAB610 | 65342.3 | 0.1 | 0.14 | 26 | — | — | — | — | — | — |
| LAB610 | 65343.3 | 0.1 | 0.08 | 34 | 1.0 | 0.07 | 40 | — | — | — |
| LAB610 | 65343.5 | — | — | — | — | — | — | 0.7 | 0.13 | 17 |
| LAB595 | 65270.2 | 0.1 | 0.01 | 48 | 1.0 | 0.11 | 34 | — | — | — |
| LAB595 | 65273.2 | 0.1 | 0.18 | 24 | 1.0 | 0.11 | 37 | — | — | — |
| LAB595 | 65273.3 | 0.1 | 0.02 | 45 | 1.2 | 0.01 | 65 | — | — | — |
| LAB577 | 65575.2 | 0.1 | 0.16 | 27 | 1.0 | 0.11 | 41 | — | — | — |
| LAB577 | 65578.4 | 0.1 | 0.10 | 32 | 1.1 | 0.05 | 46 | 0.7 | 0.09 | 21 |
| LAB562 | 65611.1 | — | — | — | — | — | — | 0.7 | 0.26 | 13 |
| LAB562 | 65612.3 | 0.1 | 0.04 | 39 | 1.1 | 0.02 | 53 | 0.8 | 0.04 | 23 |
| LAB562 | 65614.4 | 0.1 | 0.28 | 21 | 0.9 | 0.17 | 32 | — | — | — |
| LAB505 | 65105.1 | 0.1 | 0.21 | 24 | 1.2 | L | 67 | 0.7 | 0.28 | 13 |
| LAB505 | 65108.3 | 0.1 | 0.02 | 51 | 1.1 | 0.02 | 55 | 0.8 | 0.06 | 22 |
| LAB505 | 65109.2 | 0.1 | 0.21 | 24 | 1.0 | 0.06 | 40 | 0.8 | 0.03 | 25 |
| LAB505 | 65110.4 | — | — | — | 0.9 | 0.20 | 29 | — | — | — |
| LAB459 | 67376.3 | 0.1 | 0.25 | 23 | — | — | — | 0.7 | 0.28 | 13 |
| LAB459 | 67379.3 | 0.1 | 0.07 | 34 | 1.0 | 0.13 | 35 | — | — | — |
| LAB435 | 67374.1 | 0.1 | 0.06 | 36 | 1.1 | 0.04 | 49 | — | — | — |
| LAB435 | 67374.3 | 0.1 | 0.29 | 19 | — | — | — | — | — | — |
| LAB423 | 65528.2 | 0.1 | 0.15 | 31 | 1.1 | 0.02 | 57 | 0.8 | 0.06 | 22 |
| LAB423 | 65528.3 | 0.1 | L | 73 | 1.5 | L | 104 | 0.7 | 0.14 | 17 |
| CONT. | — | 0.0 | — | — | 0.7 | — | — | 0.6 | — | — |
| LAB569 | 65260.3 | — | — | — | — | — | — | 0.7 | 0.18 | 16 |
| LAB567 | 66072.4 | 0.1 | 0.24 | 19 | — | — | — | — | — | — |
| LAB548 | 65703.2 | 0.1 | 0.13 | 26 | — | — | — | — | — | — |
| LAB548 | 65703.4 | 0.1 | 0.15 | 27 | — | — | — | — | — | — |
| LAB541 | 65407.6 | 0.1 | 0.27 | 17 | — | — | — | — | — | — |
| LAB526 | 65666.2 | 0.1 | L | 52 | 1.8 | L | 71 | 0.8 | 0.01 | 31 |
| LAB526 | 65667.3 | 0.1 | 0.02 | 41 | — | — | — | — | — | — |
| LAB526 | 65669.2 | 0.1 | 0.12 | 27 | 1.4 | 0.13 | 31 | 0.7 | 0.10 | 19 |
| LAB526 | 65669.4 | 0.1 | L | 52 | — | — | — | — | — | — |
| LAB518 | 66024.4 | 0.1 | 0.09 | 29 | 1.3 | 0.21 | 24 | — | — | — |
| LAB467 | 66130.1 | — | — | — | 1.4 | 0.14 | 32 | 0.8 | 0.09 | 21 |
| LAB467 | 66130.2 | — | — | — | — | — | — | 0.7 | 0.29 | 13 |
| LAB467 | 66131.2 | 0.1 | 0.09 | 28 | 1.5 | 0.03 | 46 | 0.7 | 0.14 | 18 |
| LAB467 | 66131.4 | 0.1 | L | 48 | 1.3 | 0.19 | 24 | — | — | — |
| LAB461 | 67386.3 | 0.1 | L | 45 | 1.4 | 0.10 | 33 | 0.7 | 0.10 | 19 |
| CONT. | — | 0.1 | — | — | 1.0 | — | — | 0.6 | — | — |
| LAB612 | 66278.4 | 0.1 | 0.20 | 18 | 1.6 | 0.14 | 27 | 0.9 | 0.26 | 9 |
| LAB602 | 65828.1 | 0.1 | 0.26 | 17 | — | — | — | — | — | — |
| LAB602 | 65828.2 | 0.1 | 0.18 | 19 | — | — | — | 0.9 | 0.07 | 15 |
| LAB602 | 65829.4 | 0.1 | 0.24 | 17 | — | — | — | — | — | — |
| LAB598 | 66081.2 | 0.1 | 0.18 | 23 | — | — | — | — | — | — |
| LAB598 | 66082.2 | 0.1 | 0.23 | 17 | — | — | — | — | — | — |
| LAB592 | 65819.3 | 0.1 | 0.03 | 34 | — | — | — | 0.9 | 0.09 | 15 |
| LAB592 | 65820.1 | — | — | — | — | — | — | 0.9 | 0.05 | 16 |
| LAB543 | 65897.2 | 0.1 | L | 45 | 1.6 | 0.08 | 30 | 0.9 | 0.24 | 9 |
| LAB543 | 65898.1 | 0.1 | L | 43 | — | — | — | — | — | — |
| LAB486 | 65855.1 | 0.1 | 0.05 | 29 | 1.6 | 0.12 | 26 | 0.9 | 0.28 | 9 |
| LAB486 | 65855.3 | 0.1 | L | 58 | 2.0 | L | 65 | 0.9 | 0.03 | 18 |
| LAB463 | 65988.3 | 0.1 | 0.04 | 33 | — | — | — | 0.9 | 0.27 | 10 |
| LAB463 | 65989.2 | 0.1 | 0.03 | 48 | — | — | — | 0.9 | 0.30 | 9 |
| LAB431 | 65944.3 | 0.1 | 0.21 | 19 | — | — | — | — | — | — |
| LAB398 | 65912.6 | — | — | — | — | — | — | 0.9 | 0.17 | 11 |
| LAB398 | 65914.2 | 0.1 | 0.08 | 25 | — | — | — | 0.9 | 0.15 | 12 |
| CONT. | — | 0.1 | — | — | 1.2 | — | — | 0.8 | — | — |
| LAB451 | 66707.5 | — | — | — | 1.4 | 0.22 | 22 | — | — | — |
| LAB445 | 66464.3 | — | — | — | — | — | — | 0.8 | 0.27 | 11 |
| LAB420 | 66836.1 | — | — | — | — | — | — | 0.8 | 0.26 | 11 |
| CONT. | — | — | — | — | 1.1 | — | — | 0.7 | — | — |
| LAB607 | 65335.1 | — | — | — | — | — | — | 0.7 | 0.12 | 11 |

TABLE 94-continued

Genes showing improved plant performance and growth rate at standard growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LAB607 | 65335.3 | — | — | — | — | — | — | 0.6 | 0.28 | 8 |
| LAB600 | 65717.5 | 0.1 | 0.22 | 18 | 0.9 | 0.03 | 41 | 0.7 | 0.15 | 14 |
| LAB600 | 65719.3 | — | — | — | — | — | — | 0.7 | 0.04 | 12 |
| LAB501 | 65970.1 | 0.1 | 0.01 | 52 | 0.9 | 0.01 | 36 | — | — | — |
| LAB501 | 65970.2 | — | — | — | 0.8 | 0.07 | 26 | 0.7 | L | 24 |
| LAB490 | 65864.1 | — | — | — | 0.7 | 0.27 | 16 | 0.7 | 0.11 | 10 |
| LAB490 | 65867.3 | — | — | — | 0.8 | 0.19 | 19 | — | — | — |
| LAB451 | 66704.3 | — | — | — | 0.9 | 0.05 | 46 | 0.7 | 0.28 | 14 |
| LAB451 | 66704.5 | 0.1 | 0.15 | 25 | 0.8 | 0.08 | 31 | 0.7 | 0.09 | 14 |
| LAB451 | 66707.5 | — | — | — | 0.7 | 0.23 | 18 | — | — | — |
| CONT. | — | 0.0 | — | — | 0.6 | — | — | 0.6 | — | — |
| LAB563 | 67028.3 | 0.1 | 0.13 | 20 | — | — | — | — | — | — |
| LAB524 | 65135.1 | 0.1 | 0.12 | 33 | — | — | — | — | — | — |
| LAB524 | 65136.4 | 0.1 | 0.01 | 39 | 1.1 | 0.09 | 38 | 0.8 | 0.08 | 21 |
| LAB512 | 66734.5 | 0.1 | 0.19 | 15 | 0.9 | 0.19 | 22 | — | — | — |
| LAB512 | 66735.2 | 0.1 | L | 38 | 1.1 | 0.02 | 44 | — | — | — |
| LAB485 | 67023.1 | — | — | — | 1.0 | 0.10 | 27 | 0.8 | 0.14 | 14 |
| LAB485 | 67026.2 | 0.1 | 0.15 | 17 | — | — | — | — | — | — |
| LAB473 | 66873.1 | 0.1 | 0.15 | 20 | — | — | — | — | — | — |
| LAB473 | 66874.2 | 0.1 | L | 51 | 1.1 | 0.02 | 46 | 0.8 | 0.12 | 18 |
| LAB473 | 66875.1 | 0.1 | L | 43 | 1.1 | 0.04 | 37 | — | — | — |
| LAB433 | 67036.4 | — | — | — | 1.0 | 0.16 | 33 | 0.8 | 0.26 | 12 |
| LAB390 | 67020.1 | 0.1 | 0.17 | 18 | — | — | — | — | — | — |
| CONT. | — | 0.1 | — | — | 0.8 | — | — | 0.7 | — | — |
| LAB593 | 66341.1 | 0.1 | 0.07 | 35 | 1.1 | 0.10 | 34 | — | — | — |
| LAB575 | 66784.5 | — | — | — | — | — | — | 0.7 | 0.18 | 12 |
| LAB575 | 66784.6 | 0.1 | 0.19 | 22 | 1.1 | 0.06 | 36 | 0.7 | 0.10 | 14 |
| LAB508 | 66729.1 | — | — | — | 1.0 | 0.22 | 21 | — | — | — |
| LAB508 | 66729.2 | — | — | — | 1.0 | 0.26 | 20 | — | — | — |
| LAB508 | 66730.5 | 0.1 | 0.06 | 31 | 1.3 | L | 65 | 0.8 | L | 24 |
| LAB507 | 66794.7 | 0.1 | 0.01 | 43 | 1.3 | L | 62 | 0.8 | 0.02 | 19 |
| LAB507 | 66798.1 | 0.1 | 0.14 | 24 | — | — | — | 0.7 | 0.17 | 13 |
| LAB476 | 66305.1 | 0.1 | 0.08 | 34 | 1.2 | 0.06 | 47 | 0.7 | 0.17 | 14 |
| LAB476 | 66306.6 | 0.1 | L | 67 | 1.7 | L | 103 | 0.8 | 0.03 | 19 |
| LAB476 | 66307.2 | 0.1 | 0.24 | 19 | 1.2 | 0.01 | 43 | 0.7 | 0.13 | 14 |
| LAB424 | 66710.7 | 0.1 | 0.07 | 28 | 1.1 | 0.02 | 34 | — | — | — |
| LAB424 | 66713.2 | 0.1 | L | 57 | 1.3 | L | 62 | 0.7 | 0.09 | 14 |
| LAB422 | 65936.2 | 0.1 | 0.04 | 38 | 1.1 | 0.02 | 39 | 0.8 | 0.02 | 19 |
| LAB422 | 65936.5 | — | — | — | — | — | — | 0.7 | 0.18 | 12 |
| LAB422 | 65938.3 | 0.1 | L | 62 | 1.6 | L | 92 | 0.8 | L | 25 |
| LAB422 | 65939.2 | 0.1 | L | 49 | 1.5 | L | 90 | 0.8 | 0.02 | 19 |
| LAB418 | 66825.10 | — | — | — | 1.0 | 0.12 | 27 | — | — | — |
| LAB412 | 66699.1 | — | — | — | 1.1 | 0.04 | 33 | — | — | — |
| LAB412 | 66699.2 | — | — | — | 1.1 | 0.06 | 31 | 0.7 | 0.13 | 12 |
| LAB412 | 66701.2 | 0.1 | L | 54 | 1.5 | L | 82 | — | — | — |
| LAB412 | 66701.6 | — | — | — | 1.0 | 0.24 | 21 | 0.7 | 0.24 | 10 |
| CONT. | — | 0.1 | — | — | 0.8 | — | — | 0.6 | — | — |

Table 94.
"CONT."—Control;
"Ave."—Average;
"% Incr." = % increment;
"p-val."— p-value. L - p < 0.01.

TABLE 95

Genes showing improved plant performance and growth rate at standard growth conditions (T1 generation)

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LAB581 | — | — | — | — | — | — | 0.5 | 0.28 | 17 |
| LAB475 | — | — | — | — | — | — | 0.5 | 0.07 | 16 |
| CONT. | — | — | — | — | — | — | 0.5 | — | — |

TABLE 95-continued

Genes showing improved plant performance and growth rate at standard growth conditions (T1 generation)

| Gene Name | RGR Of Leaf Area | | | RGR Of Roots Coverage | | | RGR Of Root Length % | | |
|---|---|---|---|---|---|---|---|---|---|
| | Ave. | P-Val. | % Incr. | Ave. | P-Val. | % Incr. | Ave. | P-Val. | Incr. |
| LAB594 | — | — | — | — | — | — | 0.8 | 0.19 | 14 |
| LAB469 | 0.1 | 0.06 | 22 | 1.1 | L | 50 | 0.9 | L | 33 |
| LAB461 | — | — | — | — | — | — | 0.7 | 0.16 | 13 |
| LAB429 | — | — | — | 0.9 | 0.12 | 23 | 0.8 | L | 22 |
| LAB417 | — | — | — | — | — | — | 0.7 | 0.08 | 13 |
| CONT. | 0.1 | — | — | 0.7 | — | — | 0.7 | — | — |
| LAB391 | 0.1 | 0.03 | 29 | 0.6 | 0.08 | 26 | 0.6 | 0.13 | 11 |
| CONT. | 0.0 | — | — | 0.5 | — | — | 0.6 | — | — |

Table 95.
"CONT."—Control;
"Ave."—Average;
"% Incr." = % increment;
"P-val."—p-value; L - p < 0.01.

Example 18

Evaluation of Transgenic Arabidopsis ABST, Yield and Plant Growth Rate Under Abiotic Stress as Well as Under Standard Growth Conditions in Greenhouse Assay Assay 3—ABST measured until seed yield: seed yield, plant biomass and plant growth rate at drought conditions and standard growth conditions in greenhouse experiments—This assay follows seed yield production, the biomass formation and the rosette area growth of plants grown in the greenhouse under drought conditions and under standard growth conditions. Transgenic Arabidopsis seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation (under the control of the AT6669 (SEQ ID NO:7724) promoter). Transgenic plants transformed with a construct conformed by an empty vector carrying the At6669 (SEQ ID NO:7724) promoter and the selectable marker was used as control.

The plants were analyzed for their overall size, growth rate, flowering, seed yield, 1,000-seed weight, dry matter and harvest index (HI— seed yield/dry matter). Transgenic plants performance was compared to control plants grown in parallel under to the same conditions. Mock-transgenic plants with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) is used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area.

Vegetative growth rate:—the relative growth rate (RGR) of leaf number [formula VI (described above)], rosette area (Formula XV, above), plot coverage (Formula XVII, above) and harvest index (Formula IV) was calculated with the indicated formulas.

Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were to harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr.). 1000 seed weight (the weight of 1000 seeds) (gr.).

The harvest index (HI) was calculated using Formula IV as described above.

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 96-105 summarize the observed phenotypes of transgenic plants exogenously expressing the gene constructs using the greenhouse seed maturation (GH-SM) assays under drought conditions (Tables 96-100) or standard growth conditions (Tables 101-105) conditions. The evaluation of each gene was performed by testing the to performance of different number of events. Event with p-value <0.1 was considered statistically significant.

TABLE 96

Genes showing improved plant performance under drought conditions

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LAB609 | 65709.3 | 502.5 | 0.21 | 7 | — | — | — | — | — | — |
| LAB609 | 65711.1 | 521.2 | 0.08 | 11 | — | — | — | — | — | — |
| LAB605 | 65982.2 | 525.4 | 0.07 | 12 | — | — | — | — | — | — |
| LAB585 | 65398.2 | 532.3 | 0.15 | 14 | — | — | — | — | — | — |
| LAB573 | 65571.2 | 532.5 | 0.05 | 14 | — | — | — | — | — | — |
| LAB573 | 65573.2 | 519.4 | 0.22 | 11 | — | — | — | — | — | — |
| LAB570 | 65558.2 | — | — | — | 19.4 | 0.20 | −3 | — | — | — |
| LAB570 | 65559.2 | 561.2 | 0.01 | 20 | — | — | — | — | — | — |
| LAB568 | 65619.1 | — | — | — | 19.2 | 0.03 | −4 | — | — | — |
| LAB568 | 65620.1 | — | — | — | 19.7 | 0.15 | −2 | — | — | — |
| LAB540 | 65884.8 | — | — | — | 19.8 | 0.28 | −1 | — | — | — |
| LAB534 | 65877.2 | 510.6 | 0.14 | 9 | 19.8 | 0.28 | −1 | — | — | — |
| LAB534 | 65877.3 | 512.5 | 0.21 | 10 | — | — | — | — | — | — |
| LAB510 | 65991.2 | — | — | — | 18.3 | 0.06 | −8 | — | — | — |
| LAB510 | 65993.1 | 610.0 | 0.02 | 30 | — | — | — | — | — | — |
| LAB504 | 66018.1 | — | — | — | 19.1 | L | −4 | — | — | — |
| LAB468 | 65834.2 | — | — | — | 19.0 | L | −5 | — | — | — |
| LAB468 | 65837.1 | — | — | — | 19.7 | 0.15 | −2 | — | — | — |
| LAB460 | 65645.1 | — | — | — | 19.7 | 0.17 | −2 | — | — | — |
| LAB460 | 65647.2 | — | — | — | 19.6 | 0.13 | −2 | — | — | — |
| LAB460 | 65647.4 | 533.8 | 0.04 | 14 | 19.5 | 0.10 | −2 | — | — | — |
| LAB458 | 65805.3 | 527.5 | 0.21 | 13 | — | — | — | — | — | — |
| LAB455 | 66008.3 | — | — | — | 19.8 | 0.28 | −1 | — | — | — |
| LAB455 | 66009.4 | — | — | — | 19.3 | 0.25 | −3 | — | — | — |
| LAB455 | 66011.3 | — | — | — | 19.1 | L | −4 | — | — | — |
| LAB440 | 65954.1 | 551.2 | 0.02 | 18 | — | — | — | — | — | — |
| LAB440 | 65957.2 | — | — | — | 19.6 | 0.13 | −2 | — | — | — |
| LAB426 | 65637.3 | — | — | — | 19.7 | 0.17 | −2 | — | — | — |
| LAB406 | 65519.4 | — | — | — | 19.3 | 0.28 | −4 | — | — | — |
| CONT. | — | 467.6 | — | — | 20.0 | — | — | 12.0 | — | — |
| LAB589 | 65918.5 | — | — | — | — | — | — | 12.0 | 0.04 | −4 |
| LAB571 | 65567.2 | — | — | — | 18.0 | 0.10 | −4 | — | — | — |
| LAB554 | 66241.3 | 782.1 | 0.11 | 5 | — | — | — | — | — | — |
| LAB550 | 65900.1 | — | — | — | 18.0 | 0.10 | −4 | — | — | — |
| LAB550 | 65901.2 | — | — | — | 17.7 | 0.13 | −5 | — | — | — |
| LAB550 | 65903.2 | 792.8 | 0.18 | 6 | 17.9 | 0.05 | −4 | — | — | — |
| LAB547 | 65822.1 | — | — | — | 16.1 | L | −14 | 11.2 | 0.14 | −10 |
| LAB547 | 65823.1 | — | — | — | 15.9 | 0.22 | −14 | 10.0 | 0.07 | −20 |
| LAB547 | 65823.2 | — | — | — | 17.8 | 0.03 | −5 | 11.4 | 0.23 | −9 |
| LAB547 | 65824.2 | — | — | — | 17.4 | L | −7 | — | — | — |
| LAB547 | 65825.1 | — | — | — | 17.8 | 0.08 | −5 | 11.5 | 0.20 | −8 |
| LAB530 | 66262.2 | — | — | — | 18.1 | 0.14 | −3 | 12.3 | 0.18 | −2 |
| LAB530 | 66262.5 | 785.6 | 0.27 | 5 | — | — | — | — | — | — |
| LAB530 | 66264.2 | 806.9 | 0.27 | 8 | 17.4 | 0.09 | −7 | — | — | — |

TABLE 96-continued

Genes showing improved plant performance under drought conditions

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LAB529 | 65391.2 | — | — | — | 17.8 | 0.08 | −5 | 11.6 | 0.30 | −7 |
| LAB502 | 65972.2 | — | — | — | 17.3 | L | −7 | 11.4 | 0.23 | −9 |
| LAB502 | 65975.1 | 785.0 | 0.09 | 5 | — | — | — | — | — | — |
| LAB496 | 65961.2 | 788.8 | 0.19 | 5 | — | — | — | — | — | — |
| LAB496 | 65962.2 | 850.4 | 0.24 | 14 | — | — | — | 12.3 | 0.12 | −2 |
| LAB496 | 65962.3 | 778.1 | 0.15 | 4 | — | — | — | — | — | — |
| LAB484 | 65846.3 | 784.4 | 0.10 | 5 | 17.5 | L | −6 | — | — | — |
| LAB484 | 65848.3 | 787.5 | 0.24 | 5 | 17.8 | 0.16 | −4 | 12.1 | 0.26 | −3 |
| LAB484 | 65850.3 | — | — | — | 17.7 | 0.02 | −5 | 12.3 | 0.18 | −2 |
| LAB483 | 65841.2 | 787.5 | 0.08 | 5 | — | — | — | — | — | — |
| LAB483 | 65841.3 | 796.2 | 0.19 | 6 | 17.7 | 0.21 | −5 | 11.6 | 0.30 | −7 |
| LAB483 | 65843.2 | 853.8 | L | 14 | — | — | — | — | — | — |
| LAB483 | 65844.2 | 845.6 | L | 13 | — | — | — | — | — | — |
| LAB456 | 66182.3 | 783.8 | 0.10 | 5 | — | — | — | — | — | — |
| LAB456 | 66186.3 | 818.5 | L | 9 | — | — | — | — | — | — |
| LAB453 | 66176.4 | — | — | — | 17.8 | 0.03 | −5 | — | — | — |
| LAB453 | 66177.1 | 795.6 | 0.06 | 6 | — | — | — | — | — | — |
| LAB453 | 66178.4 | 780.0 | 0.15 | 4 | — | — | — | — | — | — |
| LAB430 | 66209.4 | 795.6 | 0.06 | 6 | — | — | — | — | — | — |
| LAB399 | 65503.1 | 869.4 | 0.10 | 16 | 17.4 | L | −6 | — | — | — |
| LAB399 | 65507.1 | — | — | — | — | — | — | 12.1 | 0.02 | −3 |
| CONT. | — | 748.3 | — | — | 18.6 | — | — | 12.5 | — | — |
| LAB610 | 65342.5 | — | — | — | — | — | — | 16.1 | 0.11 | −2 |
| LAB577 | 65575.2 | 645.0 | 0.28 | 5 | — | — | — | — | — | — |
| LAB577 | 65577.4 | — | — | — | — | — | — | 16.1 | 0.11 | −2 |
| LAB576 | 65332.2 | — | — | — | — | — | — | 16.1 | 0.11 | −2 |
| LAB524 | 65135.1 | 648.8 | 0.22 | 5 | — | — | — | — | — | — |
| LAB524 | 65136.4 | 668.8 | 0.05 | 9 | — | — | — | 16.1 | 0.18 | −1 |
| LAB524 | 65139.4 | — | — | — | — | — | — | 16.1 | 0.11 | −2 |
| LAB513 | 65124.5 | — | — | — | — | — | — | 16.1 | 0.14 | −2 |
| LAB513 | 65126.2 | 748.8 | 0.18 | 22 | — | — | — | — | — | — |
| LAB505 | 65110.2 | — | — | — | — | — | — | 16.1 | 0.11 | −2 |
| LAB505 | 65110.4 | — | — | — | — | — | — | 16.1 | 0.11 | −2 |
| LAB450 | 65306.2 | — | — | — | — | — | — | 16.1 | 0.11 | −2 |
| LAB446 | 65091.3 | 646.9 | 0.19 | 5 | — | — | — | — | — | — |
| LAB446 | 65094.1 | — | — | — | — | — | — | 16.1 | 0.11 | −2 |
| LAB428 | 65082.2 | — | — | — | — | — | — | 16.1 | 0.18 | −1 |
| LAB423 | 65527.1 | 661.9 | 0.17 | 7 | — | — | — | — | — | — |
| CONT. | — | 616.0 | — | — | — | — | — | 16.4 | — | — |
| LAB572 | 66117.2 | — | — | — | 20.7 | 0.22 | −3 | — | — | — |
| LAB569 | 65257.4 | — | — | — | 19.9 | 0.03 | −7 | — | — | — |
| LAB567 | 66068.3 | — | — | — | 20.4 | 0.04 | −4 | — | — | — |
| LAB541 | 65407.1 | 698.1 | 0.28 | 6 | — | — | — | — | — | — |
| LAB541 | 65412.7 | 688.1 | 0.23 | 4 | — | — | — | — | — | — |
| LAB526 | 65666.2 | 690.6 | 0.20 | 5 | — | — | — | — | — | — |
| LAB526 | 65667.3 | 717.3 | 0.12 | 9 | — | — | — | — | — | — |
| LAB526 | 65669.2 | 701.2 | 0.11 | 6 | — | — | — | — | — | — |
| LAB518 | 66024.5 | 733.8 | 0.12 | 11 | — | — | — | — | — | — |
| LAB498 | 66041.1 | 821.0 | 0.21 | 25 | — | — | — | — | — | — |
| LAB467 | 66131.2 | 741.2 | 0.01 | 13 | — | — | — | — | — | — |
| LAB467 | 66132.3 | 705.6 | 0.25 | 7 | — | — | — | — | — | — |
| LAB443 | 65555.2 | 730.6 | 0.27 | 11 | — | — | — | — | — | — |
| LAB443 | 65556.1 | 716.9 | 0.05 | 9 | — | — | — | — | — | — |
| LAB439 | 65950.2 | 717.5 | 0.04 | 9 | — | — | — | — | — | — |
| LAB396 | 65924.1 | 716.2 | 0.22 | 9 | — | — | — | — | — | — |
| LAB396 | 65925.4 | 755.6 | L | 15 | 20.4 | 0.04 | −4 | — | — | — |
| LAB396 | 65926.1 | 730.6 | 0.02 | 11 | 20.8 | 0.20 | −3 | — | — | — |
| LAB396 | 65927.1 | 749.4 | 0.18 | 14 | — | — | — | — | — | — |
| CONT. | — | 658.5 | — | — | 21.4 | — | — | — | — | — |

Table 96:
"CONT."—Control;
"Ave."—Average;
"% Incr." = % increment;
"P-val."—p-value; L means that p-value is less than 0.01.
The transgenes were under the transcriptional regulation of the new At6669 promoter (SEQ ID NO: 7724).

It should be noted that a negative increment (in percentages) when found in flowering or inflorescence emergence indicates drought avoidance of the plant.

TABLE 97

Genes showing improved plant performance drought conditions

| Gene Name | Event # | Leaf Blade Area [cm²] | | | Leaf Number | | | Plot Coverage [cm²] | | |
|---|---|---|---|---|---|---|---|---|---|---|
| | | P-Ave. | Val. | % Incr. | Ave. | P-Val. | % Incr. | Ave. | P-Val. | % Incr. |
| LAB609 | 65710.2 | 1.0 | 0.28 | 15 | — | — | — | 54.2 | 0.19 | 13 |
| LAB609 | 65711.1 | 1.0 | 0.02 | 18 | 10.4 | 0.15 | 5 | 55.3 | 0.08 | 16 |
| LAB605 | 65978.1 | 0.9 | 0.10 | 11 | — | — | — | — | — | — |
| LAB585 | 65399.2 | 0.9 | 0.23 | 9 | 10.4 | 0.26 | 5 | 53.3 | 0.17 | 11 |
| LAB585 | 65400.1 | — | — | — | 10.3 | 0.25 | 4 | — | — | — |
| LAB573 | 65572.3 | 0.9 | 0.23 | 7 | — | — | — | — | — | — |
| LAB570 | 65558.2 | — | — | — | 10.8 | 0.30 | 9 | — | — | — |
| LAB570 | 65560.2 | 0.9 | 0.26 | 11 | 10.6 | 0.25 | 7 | — | — | — |
| LAB568 | 65619.1 | 1.0 | 0.05 | 18 | — | — | — | 58.2 | 0.10 | 22 |
| LAB568 | 65620.1 | 1.0 | 0.02 | 18 | — | — | — | 57.4 | 0.03 | 20 |
| LAB568 | 65620.4 | 0.9 | 0.19 | 9 | — | — | — | 53.6 | 0.16 | 12 |
| LAB540 | 65883.2 | 0.9 | 0.22 | 7 | — | — | — | — | — | — |
| LAB540 | 65884.2 | 0.9 | 0.12 | 9 | — | — | — | — | — | — |
| LAB540 | 65884.8 | — | — | — | 10.7 | 0.27 | 8 | 53.3 | 0.21 | 11 |
| LAB534 | 65876.2 | 0.9 | 0.29 | 8 | — | — | — | — | — | — |
| LAB534 | 65877.3 | 0.9 | 0.08 | 11 | — | — | — | 53.6 | 0.16 | 12 |
| LAB534 | 65879.4 | 0.9 | 0.18 | 12 | — | — | — | — | — | — |
| LAB510 | 65991.1 | 0.9 | 0.20 | 11 | — | — | — | — | — | — |
| LAB510 | 65991.2 | 1.1 | 0.06 | 25 | 10.9 | 0.06 | 10 | 62.3 | L | 30 |
| LAB510 | 65992.4 | 0.9 | 0.23 | 11 | — | — | — | 53.3 | 0.21 | 11 |
| LAB510 | 65993.1 | 0.9 | 0.23 | 7 | — | — | — | — | — | — |
| LAB504 | 66014.6 | 1.1 | L | 27 | — | — | — | 63.4 | 0.02 | 33 |
| LAB504 | 66018.1 | 0.9 | 0.20 | 10 | — | — | — | 52.6 | 0.24 | 10 |
| LAB468 | 65836.2 | — | — | — | 10.2 | 0.27 | 4 | — | — | — |
| LAB468 | 65837.1 | — | — | — | 11.9 | 0.29 | 21 | — | — | — |
| LAB460 | 65647.4 | 1.0 | 0.22 | 21 | 10.4 | 0.09 | 5 | 60.8 | 0.10 | 27 |
| LAB458 | 65804.3 | 1.0 | 0.02 | 17 | — | — | — | 54.3 | 0.11 | 14 |
| LAB458 | 65805.3 | — | — | — | 10.4 | 0.09 | 5 | — | — | — |
| LAB458 | 65805.4 | 1.1 | 0.11 | 30 | 10.2 | 0.27 | 4 | 62.0 | L | 30 |
| LAB458 | 65807.3 | 1.0 | 0.26 | 19 | — | — | — | 56.1 | 0.08 | 17 |
| LAB455 | 66008.3 | 1.0 | L | 22 | — | — | — | 57.8 | 0.05 | 21 |
| LAB455 | 66009.4 | 1.0 | 0.07 | 13 | — | — | — | 52.6 | 0.23 | 10 |
| LAB455 | 66011.1 | 1.0 | 0.01 | 19 | — | — | — | 55.6 | 0.07 | 16 |
| LAB455 | 66011.3 | 0.9 | 0.16 | 11 | — | — | — | 52.6 | 0.25 | 10 |
| LAB440 | 65954.1 | — | — | — | 10.4 | 0.26 | 5 | — | — | — |
| LAB440 | 65955.1 | 0.9 | 0.10 | 12 | 10.3 | 0.25 | 4 | 53.5 | 0.16 | 12 |
| LAB440 | 65956.1 | — | — | — | 10.4 | 0.26 | 5 | — | — | — |
| LAB440 | 65957.2 | 1.0 | L | 20 | — | — | — | 57.0 | 0.12 | 19 |
| LAB426 | 65636.1 | 1.0 | 0.21 | 16 | 10.3 | 0.18 | 4 | 55.7 | 0.07 | 16 |
| LAB426 | 65636.2 | 1.0 | 0.11 | 20 | — | — | — | 58.6 | 0.13 | 22 |
| LAB410 | 65402.1 | 0.9 | 0.09 | 10 | — | — | — | 55.0 | 0.13 | 15 |
| LAB410 | 65402.4 | 1.0 | 0.18 | 13 | — | — | — | — | — | — |
| LAB410 | 65405.4 | 1.0 | 0.05 | 14 | 10.8 | 0.30 | 9 | 56.9 | 0.04 | 19 |
| LAB406 | 65516.2 | — | — | — | — | — | — | 53.5 | 0.20 | 12 |
| LAB406 | 65517.3 | — | — | — | 10.4 | 0.13 | 5 | — | — | — |
| LAB406 | 65519.4 | 1.1 | 0.09 | 24 | — | — | — | 58.3 | 0.04 | 22 |
| CONT. | — | 0.8 | — | — | 9.9 | — | — | 47.8 | — | — |
| LAB589 | 65919.2 | — | — | — | 10.6 | 0.28 | 6 | — | — | — |
| LAB571 | 65567.2 | — | — | — | 10.8 | L | 8 | 62.6 | 0.21 | 7 |
| LAB571 | 65568.2 | — | — | — | — | — | — | 64.2 | 0.10 | 10 |
| LAB554 | 66236.3 | — | — | — | — | — | — | 64.2 | 0.21 | 10 |
| LAB554 | 66237.5 | — | — | — | 10.8 | 0.05 | 8 | 63.5 | 0.19 | 9 |
| LAB550 | 65900.1 | 1.3 | 0.04 | 13 | 10.4 | 0.09 | 4 | 66.3 | 0.04 | 14 |
| LAB550 | 65901.2 | 1.3 | 0.01 | 17 | — | — | — | 70.6 | L | 21 |
| LAB550 | 65902.4 | 1.2 | 0.28 | 6 | — | — | — | — | — | — |
| LAB550 | 65903.2 | 1.2 | 0.15 | 12 | 10.6 | 0.11 | 6 | 67.7 | 0.21 | 16 |
| LAB547 | 65822.1 | — | — | — | 10.9 | L | 9 | — | — | — |
| LAB530 | 66262.5 | — | — | — | — | — | — | 62.0 | 0.29 | 6 |
| LAB530 | 66264.2 | 1.3 | 0.19 | 16 | — | — | — | — | — | — |
| LAB529 | 65389.1 | 1.2 | 0.12 | 11 | — | — | — | — | — | — |
| LAB502 | 65974.1 | 1.2 | 0.25 | 6 | — | — | — | — | — | — |
| LAB502 | 65976.6 | — | — | — | 10.4 | 0.14 | 4 | — | — | — |
| LAB496 | 65964.3 | — | — | — | 10.8 | 0.02 | 8 | — | — | — |
| LAB484 | 65846.3 | 1.3 | 0.03 | 13 | — | — | — | 66.7 | 0.04 | 14 |
| LAB484 | 65847.2 | 1.3 | 0.14 | 18 | — | — | — | 67.3 | 0.20 | 15 |
| LAB484 | 65850.3 | 1.2 | 0.05 | 11 | — | — | — | 69.3 | 0.04 | 19 |
| LAB483 | 65841.3 | 1.3 | 0.15 | 20 | 10.6 | 0.17 | 6 | 72.0 | 0.01 | 23 |

TABLE 97-continued

Genes showing improved plant performance drought conditions

| Gene Name | Event # | Leaf Blade Area [cm²] P-Ave. | Val. | % Incr. | Leaf Number Ave. | P-Val. | % Incr. | Plot Coverage [cm²] Ave. | P-Val. | % Incr. |
|---|---|---|---|---|---|---|---|---|---|---|
| LAB483 | 65843.2 | 1.4 | 0.04 | 24 | 10.2 | 0.22 | 2 | 74.0 | 0.10 | 27 |
| LAB456 | 66186.3 | — | — | — | 10.3 | 0.15 | 3 | — | — | — |
| LAB453 | 66176.4 | 1.2 | 0.04 | 12 | — | — | — | 65.7 | 0.05 | 13 |
| LAB453 | 66178.4 | — | — | — | — | — | — | 62.0 | 0.28 | 6 |
| LAB452 | 66171.2 | 1.3 | 0.03 | 13 | — | — | — | 66.1 | 0.04 | 13 |
| LAB452 | 66171.3 | — | — | — | 10.4 | 0.09 | 4 | — | — | — |
| LAB430 | 66209.4 | 1.2 | 0.12 | 8 | — | — | — | 63.7 | 0.12 | 9 |
| LAB430 | 66210.2 | — | — | — | 10.6 | 0.17 | 6 | — | — | — |
| LAB399 | 65503.1 | 1.5 | 0.16 | 31 | 10.6 | 0.28 | 6 | 80.3 | 0.10 | 38 |
| LAB399 | 65506.1 | 1.2 | 0.25 | 11 | — | — | — | 63.4 | 0.13 | 9 |
| LAB399 | 65507.1 | 1.2 | 0.23 | 6 | — | — | — | — | — | — |
| CONT. | — | 1.1 | — | — | 10.0 | — | — | 58.3 | — | — |
| LAB595 | 65269.5 | 1.1 | 0.03 | 16 | — | — | — | 64.1 | 0.04 | 15 |
| LAB595 | 65270.3 | 1.1 | 0.28 | 14 | 11.4 | 0.13 | 5 | 63.2 | 0.23 | 13 |
| LAB577 | 65577.4 | 1.0 | 0.23 | 7 | — | — | — | 60.6 | 0.18 | 9 |
| LAB546 | 65157.4 | 1.0 | 0.24 | 10 | — | — | — | 60.1 | 0.23 | 8 |
| LAB505 | 65108.3 | 1.0 | 0.30 | 7 | — | — | — | — | — | — |
| LAB505 | 65110.2 | 1.1 | 0.07 | 12 | — | — | — | 61.3 | 0.12 | 10 |
| LAB505 | 65110.4 | 1.1 | 0.10 | 11 | — | — | — | 59.8 | 0.29 | 7 |
| LAB449 | 65095.1 | — | — | — | 11.2 | 0.23 | 3 | — | — | — |
| LAB446 | 65091.3 | 1.1 | 0.15 | 13 | — | — | — | — | — | — |
| LAB423 | 65527.1 | 1.0 | 0.16 | 10 | — | — | — | — | — | — |
| CONT. | — | 1.0 | — | — | 10.9 | — | — | 55.7 | — | — |
| LAB572 | 66117.2 | 1.0 | L | 19 | — | — | — | 52.9 | 0.25 | 22 |
| LAB569 | 65257.4 | 1.0 | 0.16 | 18 | — | — | — | 53.6 | 0.27 | 24 |
| LAB567 | 66068.3 | 1.0 | L | 23 | 10.9 | 0.01 | 15 | 56.8 | L | 31 |
| LAB567 | 66072.4 | 0.9 | L | 11 | — | — | — | 48.6 | L | 12 |
| LAB558 | 65323.1 | 0.9 | 0.17 | 8 | — | — | — | 46.3 | 0.02 | 7 |
| LAB558 | 65325.2 | 1.0 | 0.04 | 25 | — | — | — | 52.0 | 0.02 | 20 |
| LAB548 | 65702.3 | 0.9 | 0.15 | 10 | 9.9 | 0.27 | 5 | 48.2 | 0.04 | 11 |
| LAB548 | 65703.4 | 0.9 | 0.05 | 8 | — | — | — | 49.0 | 0.29 | 13 |
| LAB541 | 65412.7 | 0.9 | 0.29 | 4 | — | — | — | 44.5 | 0.13 | 3 |
| LAB541 | 65412.8 | 1.0 | 0.09 | 26 | 9.9 | 0.25 | 5 | 57.8 | L | 33 |
| LAB526 | 65668.2 | 0.9 | 0.08 | 8 | — | — | — | — | — | — |
| LAB526 | 65669.4 | 1.1 | 0.14 | 28 | 10.6 | 0.03 | 12 | 58.7 | 0.07 | 36 |
| LAB521 | 65599.1 | — | — | — | 10.5 | 0.13 | 11 | — | — | — |
| LAB518 | 66023.3 | 0.9 | 0.04 | 8 | — | — | — | 47.7 | 0.14 | 10 |
| LAB518 | 66024.5 | 0.9 | 0.14 | 12 | — | — | — | 49.3 | L | 14 |
| LAB498 | 66038.3 | 0.9 | L | 7 | — | — | — | 47.3 | L | 9 |
| LAB467 | 66130.2 | 1.0 | L | 20 | — | — | — | 53.2 | 0.10 | 23 |
| LAB467 | 66131.4 | 0.9 | 0.12 | 7 | — | — | — | — | — | — |
| LAB405 | 66122.1 | — | — | — | — | — | — | 51.6 | 0.22 | 19 |
| LAB396 | 65924.1 | 1.0 | 0.04 | 16 | 10.3 | 0.06 | 9 | 51.9 | 0.03 | 20 |
| LAB396 | 65925.4 | 1.0 | 0.27 | 26 | 10.1 | 0.16 | 7 | 60.3 | 0.20 | 39 |
| LAB396 | 65926.1 | 0.9 | 0.20 | 14 | — | — | — | 50.7 | 0.12 | 17 |
| LAB396 | 65927.1 | 0.9 | 0.21 | 11 | 10.2 | 0.28 | 8 | 53.7 | 0.23 | 24 |
| LAB396 | 65927.4 | — | — | — | 10.2 | 0.07 | 9 | — | — | — |
| CONT. | — | 0.8 | — | — | 9.4 | — | — | 43.3 | — | — |

Table 97.
"CONT."—Control;
"Ave."—Average;
"% Incr." = % increment;
"P-val."—p-value; L means that p-value is less than 0.01.
The transgenes were under the transcriptional regulation of the new At6669 promoter (SEQ ID NO: 7724).

TABLE 98

Genes showing improved plant performance drought conditions

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| LAB609 | 65710.2 | — | — | — | 7.7 | 0.26 | 16 | — | — | — |
| LAB609 | 65711.1 | — | — | — | 7.9 | 0.21 | 18 | 0.4 | 0.26 | 12 |
| LAB609 | 65711.2 | — | — | — | — | — | — | 0.4 | 0.16 | 16 |
| LAB570 | 65560.2 | 0.8 | 0.23 | 20 | — | — | — | — | — | — |

TABLE 98-continued

Genes showing improved plant performance drought conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LAB568 | 65619.1 | — | — | — | 8.3 | 0.09 | 25 | — | — | — |
| LAB568 | 65620.1 | — | — | — | 8.1 | 0.15 | 21 | 0.4 | 0.28 | 11 |
| LAB540 | 65884.8 | 0.8 | 0.22 | 20 | — | — | — | — | — | — |
| LAB510 | 65991.2 | — | — | — | 8.8 | 0.03 | 32 | 0.4 | 0.27 | 11 |
| LAB504 | 66014.6 | — | — | — | 8.8 | 0.03 | 32 | 0.4 | 0.18 | 14 |
| LAB468 | 65837.1 | 0.9 | 0.06 | 36 | — | — | — | — | — | — |
| LAB460 | 65647.4 | — | — | — | 8.6 | 0.06 | 28 | 0.4 | 0.23 | 13 |
| LAB458 | 65804.3 | — | — | — | 7.7 | 0.29 | 15 | 0.5 | 0.07 | 19 |
| LAB458 | 65805.4 | — | — | — | 8.7 | 0.04 | 31 | 0.4 | 0.13 | 16 |
| LAB458 | 65807.3 | — | — | — | 7.9 | 0.21 | 18 | — | — | — |
| LAB455 | 66008.3 | — | — | — | 8.2 | 0.11 | 23 | 0.4 | 0.16 | 15 |
| LAB455 | 66011.1 | — | — | — | 8.0 | 0.15 | 21 | 0.4 | 0.28 | 12 |
| LAB440 | 65957.2 | — | — | — | 8.0 | 0.16 | 21 | 0.4 | 0.23 | 13 |
| LAB426 | 65636.1 | — | — | — | 7.7 | 0.26 | 16 | — | — | — |
| LAB426 | 65636.2 | — | — | — | 8.1 | 0.13 | 22 | — | — | — |
| LAB410 | 65402.1 | — | — | — | 7.8 | 0.24 | 17 | — | — | — |
| LAB410 | 65405.4 | — | — | — | 7.9 | 0.20 | 18 | — | — | — |
| LAB406 | 65519.4 | — | — | — | 8.3 | 0.09 | 25 | 0.4 | 0.19 | 14 |
| CONT. | — | 0.7 | — | — | 6.7 | — | — | 0.4 | — | — |
| LAB589 | 65919.2 | 0.8 | 0.05 | 19 | — | — | — | — | — | — |
| LAB589 | 65921.2 | 0.8 | 0.18 | 13 | — | — | — | — | — | — |
| LAB571 | 65564.3 | 0.8 | 0.08 | 18 | — | — | — | — | — | — |
| LAB571 | 65568.1 | 0.8 | 0.10 | 15 | — | — | — | — | — | — |
| LAB554 | 66236.3 | 0.8 | 0.18 | 13 | — | — | — | — | — | — |
| LAB554 | 66237.3 | 0.8 | 0.16 | 17 | — | — | — | — | — | — |
| LAB554 | 66241.6 | 0.8 | 0.14 | 15 | — | — | — | — | — | — |
| LAB550 | 65900.1 | — | — | — | 8.2 | 0.29 | 13 | 0.4 | 0.27 | 10 |
| LAB550 | 65901.2 | — | — | — | 8.8 | 0.11 | 20 | 0.4 | 0.28 | 9 |
| LAB550 | 65903.2 | 0.7 | 0.17 | 12 | 8.4 | 0.25 | 14 | — | — | — |
| LAB530 | 66262.5 | 0.7 | 0.23 | 11 | — | — | — | — | — | — |
| LAB529 | 65391.2 | — | — | — | 8.3 | 0.27 | 14 | — | — | — |
| LAB503 | 66212.3 | 0.8 | 0.08 | 17 | — | — | — | — | — | — |
| LAB502 | 65972.2 | 0.8 | 0.23 | 13 | — | — | — | — | — | — |
| LAB502 | 65976.2 | 0.8 | 0.04 | 23 | — | — | — | — | — | — |
| LAB496 | 65961.2 | 0.8 | 0.21 | 14 | — | — | — | — | — | — |
| LAB484 | 65847.2 | — | — | — | 8.4 | 0.24 | 14 | — | — | — |
| LAB484 | 65848.3 | 0.7 | 0.25 | 11 | — | — | — | — | — | — |
| LAB484 | 65850.3 | — | — | — | 8.7 | 0.11 | 19 | 0.4 | 0.23 | 11 |
| LAB483 | 65841.3 | — | — | — | 8.9 | 0.09 | 21 | 0.4 | 0.27 | 10 |
| LAB483 | 65843.2 | — | — | — | 9.2 | 0.04 | 26 | 0.4 | 0.10 | 15 |
| LAB453 | 66176.4 | — | — | — | 8.3 | 0.28 | 13 | — | — | — |
| LAB452 | 66171.2 | — | — | — | 8.2 | 0.30 | 12 | 0.4 | 0.27 | 10 |
| LAB452 | 66172.7 | 0.8 | 0.12 | 16 | — | — | — | — | — | — |
| LAB432 | 66003.4 | 0.8 | 0.03 | 22 | — | — | — | — | — | — |
| LAB399 | 65503.1 | — | — | — | 10.0 | L | 36 | 0.5 | 0.03 | 20 |
| CONT. | — | 0.7 | — | — | 7.3 | — | — | 0.4 | — | — |
| LAB610 | 65341.4 | 0.8 | 0.05 | 19 | — | — | — | — | — | — |
| LAB610 | 65342.5 | — | — | — | — | — | — | 0.4 | 0.29 | 13 |
| LAB595 | 65269.5 | — | — | — | 7.8 | 0.19 | 15 | 0.4 | 0.20 | 13 |
| LAB595 | 65270.3 | — | — | — | 7.7 | 0.22 | 14 | 0.4 | 0.11 | 17 |
| LAB577 | 65575.2 | 0.8 | 0.09 | 19 | — | — | — | — | — | — |
| LAB577 | 65577.4 | — | — | — | — | — | — | 0.4 | 0.16 | 14 |
| LAB546 | 65157.4 | — | — | — | — | — | — | 0.4 | 0.29 | 11 |
| LAB457 | 65101.1 | 0.8 | 0.20 | 13 | — | — | — | — | — | — |
| LAB449 | 65095.1 | 0.8 | 0.21 | 13 | — | — | — | — | — | — |
| LAB446 | 65091.2 | 0.8 | 0.17 | 13 | — | — | — | — | — | — |
| LAB446 | 65094.1 | — | — | — | — | — | — | 0.4 | 0.27 | 11 |
| LAB444 | 65086.1 | — | — | — | — | — | — | 0.4 | 0.26 | 11 |
| LAB423 | 65527.1 | — | — | — | — | — | — | 0.4 | 0.23 | 13 |
| LAB423 | 65528.3 | 0.7 | 0.19 | 12 | — | — | — | — | — | — |
| CONT. | — | 0.7 | — | — | 6.8 | — | — | 0.4 | — | — |
| LAB572 | 66117.2 | — | — | — | 6.3 | 0.03 | 20 | — | — | — |
| LAB569 | 65257.4 | — | — | — | 6.7 | L | 27 | 0.4 | 0.11 | 11 |
| LAB567 | 66068.3 | 0.7 | 0.12 | 20 | 6.7 | L | 28 | — | — | — |
| LAB567 | 66072.4 | — | — | — | 5.8 | 0.11 | 11 | — | — | — |
| LAB558 | 65325.2 | — | — | — | 6.4 | L | 21 | 0.4 | 0.03 | 10 |
| LAB548 | 65702.3 | — | — | — | 5.7 | 0.20 | 9 | — | — | — |
| LAB548 | 65703.4 | — | — | — | 5.7 | 0.24 | 9 | — | — | — |
| LAB541 | 65412.8 | — | — | — | 6.9 | L | 31 | 0.4 | 0.26 | 6 |
| LAB526 | 65669.4 | — | — | — | 7.3 | L | 39 | — | — | — |
| LAB521 | 65599.1 | 0.7 | 0.23 | 15 | — | — | — | — | — | — |
| LAB521 | 65599.6 | 0.7 | 0.18 | 18 | — | — | — | — | — | — |

TABLE 98-continued

Genes showing improved plant performance drought conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LAB518 | 66023.1 | — | — | — | 6.2 | 0.04 | 19 | — | — | — |
| LAB518 | 66023.3 | — | — | — | 5.8 | 0.15 | 11 | — | — | — |
| LAB518 | 66024.5 | — | — | — | 5.9 | 0.09 | 12 | — | — | — |
| LAB498 | 66038.3 | — | — | — | 5.9 | 0.07 | 13 | 0.4 | 0.19 | 6 |
| LAB467 | 66130.2 | — | — | — | 6.6 | L | 26 | 0.4 | 0.02 | 12 |
| LAB467 | 66132.3 | 0.7 | 0.21 | 20 | 6.1 | 0.16 | 17 | — | — | — |
| LAB443 | 65555.3 | — | — | — | 6.0 | 0.10 | 15 | — | — | — |
| LAB405 | 66122.1 | — | — | — | 6.3 | 0.03 | 19 | — | — | — |
| LAB396 | 65924.1 | — | — | — | 6.4 | L | 22 | — | — | — |
| LAB396 | 65925.4 | — | — | — | 7.2 | L | 36 | 0.4 | 0.26 | 8 |
| LAB396 | 65926.1 | — | — | — | 5.9 | 0.09 | 13 | — | — | — |
| LAB396 | 65927.1 | — | — | — | 6.5 | 0.01 | 23 | — | — | — |
| CONT. | — | 0.6 | — | — | 5.2 | — | — | 0.3 | — | — |

Table 98.
"CONT."—Control;
"Ave."—Average;
"% Incr." = % increment;
"p-val."—p-value; L means that p-value is less than 0.01.
The transgenes were under the transcriptional regulation of the new At6669 promoter (SEQ ID NO: 7724).

TABLE 99

Genes showing improved plant performance drought conditions

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB609 | 65710.2 | — | — | — | 6.8 | 0.19 | 13 | — | — | — |
| LAB609 | 65711.1 | — | — | — | 6.9 | 0.08 | 16 | 4.4 | 0.06 | 6 |
| LAB605 | 65978.1 | — | — | — | — | — | — | 4.3 | 0.21 | 4 |
| LAB585 | 65399.2 | — | — | — | 6.7 | 0.17 | 11 | 4.3 | 0.24 | 3 |
| LAB570 | 65557.3 | 0.5 | 0.23 | 27 | — | — | — | — | — | — |
| LAB570 | 65559.2 | — | — | — | — | — | — | 4.4 | 0.17 | 4 |
| LAB568 | 65619.1 | — | — | — | 7.3 | 0.10 | 22 | 4.6 | 0.01 | 9 |
| LAB568 | 65620.1 | 0.5 | 0.19 | 10 | 7.2 | 0.03 | 20 | 4.6 | 0.07 | 9 |
| LAB568 | 65620.4 | — | — | — | 6.7 | 0.16 | 12 | 4.4 | 0.08 | 6 |
| LAB540 | 65883.1 | 0.5 | 0.18 | 8 | — | — | — | — | — | — |
| LAB540 | 65883.2 | 0.5 | 0.27 | 7 | — | — | — | — | — | — |
| LAB540 | 65884.8 | — | — | — | 6.7 | 0.21 | 11 | — | — | — |
| LAB534 | 65876.2 | — | — | — | — | — | — | 4.4 | 0.26 | 4 |
| LAB534 | 65877.3 | — | — | — | 6.7 | 0.16 | 12 | 4.5 | 0.04 | 7 |
| LAB534 | 65878.3 | 0.5 | 0.15 | 10 | — | — | — | — | — | — |
| LAB510 | 65991.1 | — | — | — | — | — | — | 4.4 | 0.28 | 5 |
| LAB510 | 65991.2 | — | — | — | 7.8 | L | 30 | 4.7 | L | 14 |
| LAB510 | 65992.4 | — | — | — | 6.7 | 0.21 | 11 | 4.4 | 0.10 | 5 |
| LAB510 | 65993.1 | — | — | — | — | — | — | 4.6 | 0.01 | 10 |
| LAB504 | 66014.6 | — | — | — | 7.9 | 0.02 | 33 | 4.8 | L | 14 |
| LAB504 | 66015.2 | 0.5 | 0.19 | 9 | — | — | — | — | — | — |
| LAB504 | 66018.1 | — | — | — | 6.6 | 0.24 | 10 | 4.4 | 0.14 | 5 |
| LAB468 | 65838.1 | 0.5 | L | 23 | — | — | — | — | — | — |
| LAB460 | 65647.2 | 0.5 | L | 24 | — | — | — | — | — | — |
| LAB460 | 65647.4 | — | — | — | 7.6 | 0.10 | 27 | 4.7 | 0.13 | 13 |
| LAB458 | 65804.3 | — | — | — | 6.8 | 0.11 | 14 | 4.7 | L | 12 |
| LAB458 | 65805.1 | 0.5 | 0.10 | 12 | — | — | — | — | — | — |
| LAB458 | 65805.4 | — | — | — | 7.7 | L | 30 | 4.8 | L | 15 |
| LAB458 | 65807.3 | — | — | — | 7.0 | 0.08 | 17 | 4.6 | 0.24 | 10 |
| LAB455 | 66008.3 | — | — | — | 7.2 | 0.05 | 21 | 4.7 | 0.01 | 12 |
| LAB455 | 66009.4 | — | — | — | 6.6 | 0.23 | 10 | 4.4 | 0.17 | 6 |
| LAB455 | 66011.1 | — | — | — | 6.9 | 0.07 | 16 | 4.5 | 0.04 | 8 |
| LAB455 | 66011.3 | — | — | — | 6.6 | 0.25 | 10 | 4.4 | 0.12 | 6 |
| LAB440 | 65955.1 | 0.5 | 0.05 | 14 | 6.7 | 0.16 | 12 | 4.4 | 0.12 | 5 |
| LAB440 | 65957.2 | — | — | — | 7.1 | 0.12 | 19 | 4.6 | 0.02 | 10 |
| LAB426 | 65636.1 | 0.5 | 0.05 | 14 | 7.0 | 0.07 | 16 | 4.5 | 0.04 | 7 |
| LAB426 | 65636.2 | — | — | — | 7.3 | 0.13 | 22 | 4.6 | 0.12 | 11 |
| LAB426 | 65637.2 | 0.5 | 0.11 | 14 | — | — | — | — | — | — |
| LAB426 | 65640.4 | — | — | — | — | — | — | 4.4 | 0.19 | 5 |

TABLE 99-continued

Genes showing improved plant performance drought conditions

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB410 | 65402.1 | — | — | — | 6.9 | 0.13 | 15 | 4.5 | 0.05 | 7 |
| LAB410 | 65402.4 | — | — | — | — | — | — | 4.5 | 0.11 | 7 |
| LAB410 | 65405.4 | — | — | — | 7.1 | 0.04 | 19 | 4.5 | 0.03 | 8 |
| LAB406 | 65516.2 | — | — | — | 6.7 | 0.20 | 12 | — | — | — |
| LAB406 | 65519.4 | — | — | — | 7.3 | 0.04 | 22 | 4.6 | 0.01 | 9 |
| CONT. | — | 0.4 | — | — | 6.0 | — | — | 4.2 | — | — |
| LAB589 | 65918.5 | 0.5 | 0.06 | 10 | — | — | — | 4.5 | 0.29 | 3 |
| LAB589 | 65919.2 | 0.5 | 0.01 | 10 | — | — | — | — | — | — |
| LAB589 | 65921.3 | 0.5 | 0.02 | 12 | — | — | — | — | — | — |
| LAB571 | 65567.2 | — | — | — | 7.8 | 0.21 | 7 | 4.5 | 0.23 | 4 |
| LAB571 | 65568.1 | 0.5 | 0.22 | 4 | — | — | — | — | — | — |
| LAB571 | 65568.2 | — | — | — | 8.0 | 0.10 | 10 | 4.7 | 0.22 | 9 |
| LAB554 | 66236.3 | — | — | — | 8.0 | 0.21 | 10 | 4.6 | 0.15 | 6 |
| LAB554 | 66237.5 | — | — | — | 7.9 | 0.19 | 9 | — | — | — |
| LAB550 | 65900.1 | — | — | — | 8.3 | 0.04 | 14 | 4.8 | 0.02 | 10 |
| LAB550 | 65901.2 | — | — | — | 8.8 | L | 21 | 4.8 | 0.02 | 10 |
| LAB550 | 65902.4 | — | — | — | — | — | — | 4.5 | 0.17 | 5 |
| LAB550 | 65903.2 | — | — | — | 8.5 | 0.21 | 16 | 4.7 | 0.16 | 8 |
| LAB547 | 65825.1 | 0.5 | 0.10 | 5 | — | — | — | — | — | — |
| LAB530 | 66261.4 | 0.5 | 0.30 | 5 | — | — | — | — | — | — |
| LAB530 | 66262.3 | — | — | — | — | — | — | 4.5 | 0.25 | 4 |
| LAB530 | 66262.5 | — | — | — | 7.8 | 0.29 | 6 | — | — | — |
| LAB530 | 66264.2 | — | — | — | — | — | — | 4.7 | 0.28 | 9 |
| LAB529 | 65389.1 | — | — | — | — | — | — | 4.5 | 0.24 | 4 |
| LAB529 | 65391.2 | — | — | — | — | — | — | 4.7 | 0.20 | 8 |
| LAB502 | 65974.1 | 0.5 | 0.20 | 10 | — | — | — | 4.5 | 0.22 | 4 |
| LAB502 | 65976.2 | 0.5 | 0.23 | 7 | — | — | — | — | — | — |
| LAB502 | 65976.6 | 0.5 | 0.22 | 7 | — | — | — | — | — | — |
| LAB496 | 65961.2 | 0.5 | 0.07 | 7 | — | — | — | — | — | — |
| LAB484 | 65846.3 | — | — | — | 8.3 | 0.04 | 14 | 4.8 | 0.12 | 11 |
| LAB484 | 65847.2 | — | — | — | 8.4 | 0.20 | 15 | 4.7 | 0.09 | 8 |
| LAB484 | 65848.3 | — | — | — | — | — | — | 4.6 | 0.21 | 5 |
| LAB484 | 65850.3 | — | — | — | 8.7 | 0.04 | 19 | 4.8 | 0.01 | 11 |
| LAB483 | 65841.3 | — | — | — | 9.0 | 0.01 | 23 | 4.9 | 0.02 | 13 |
| LAB483 | 65843.2 | — | — | — | 9.3 | 0.10 | 27 | 5.0 | 0.05 | 16 |
| LAB453 | 66176.4 | — | — | — | 8.2 | 0.05 | 13 | 4.7 | 0.04 | 8 |
| LAB453 | 66177.1 | 0.5 | 0.16 | 4 | — | — | — | — | — | — |
| LAB453 | 66177.2 | 0.5 | 0.08 | 9 | — | — | — | — | — | — |
| LAB453 | 66178.4 | — | — | — | 7.7 | 0.28 | 6 | 4.5 | 0.22 | 4 |
| LAB452 | 66171.2 | — | — | — | 8.3 | 0.04 | 13 | 4.8 | 0.03 | 10 |
| LAB452 | 66172.7 | 0.5 | 0.04 | 12 | — | — | — | — | — | — |
| LAB432 | 66003.3 | 0.5 | 0.21 | 6 | — | — | — | — | — | — |
| LAB430 | 66209.4 | — | — | — | 8.0 | 0.12 | 9 | 4.5 | 0.17 | 5 |
| LAB399 | 65503.1 | — | — | — | 10.0 | 0.10 | 38 | 5.2 | L | 20 |
| LAB399 | 65506.1 | 0.5 | 0.22 | 4 | 7.9 | 0.13 | 9 | 4.6 | 0.11 | 6 |
| LAB399 | 65507.1 | — | — | — | — | — | — | 4.5 | 0.22 | 5 |
| CONT. | — | 0.4 | — | — | 7.3 | — | — | 4.3 | — | — |
| LAB595 | 65269.5 | 0.4 | 0.26 | 11 | 8.0 | 0.04 | 15 | 4.7 | 0.06 | 8 |
| LAB595 | 65270.3 | 0.4 | 0.29 | 18 | 7.9 | 0.23 | 13 | 4.7 | 0.23 | 9 |
| LAB595 | 65273.2 | 0.4 | L | 9 | — | — | — | — | — | — |
| LAB578 | 65581.3 | 0.4 | 0.18 | 6 | — | — | — | — | — | — |
| LAB578 | 65582.6 | 0.4 | L | 13 | — | — | — | — | — | — |
| LAB578 | 65583.2 | 0.4 | 0.22 | 17 | — | — | — | — | — | — |
| LAB577 | 65577.4 | — | — | — | 7.6 | 0.18 | 9 | 4.6 | 0.23 | 6 |
| LAB576 | 65330.2 | 0.4 | 0.16 | 20 | — | — | — | — | — | — |
| LAB576 | 65332.2 | 0.4 | 0.24 | 5 | — | — | — | — | — | — |
| LAB576 | 65332.3 | 0.4 | L | 16 | — | — | — | — | — | — |
| LAB562 | 65611.1 | 0.4 | 0.19 | 13 | — | — | — | — | — | — |
| LAB562 | 65613.2 | 0.4 | 0.04 | 9 | — | — | — | — | — | — |
| LAB546 | 65155.2 | 0.4 | L | 14 | — | — | — | — | — | — |
| LAB546 | 65156.1 | 0.4 | 0.20 | 10 | — | — | — | — | — | — |
| LAB546 | 65157.4 | — | — | — | 7.5 | 0.23 | 8 | 4.5 | 0.17 | 6 |
| LAB524 | 65136.1 | 0.4 | L | 9 | — | — | — | — | — | — |
| LAB524 | 65139.4 | 0.4 | L | 9 | — | — | — | — | — | — |
| LAB513 | 65124.3 | 0.4 | 0.02 | 12 | — | — | — | — | — | — |
| LAB513 | 65126.1 | 0.4 | L | 18 | — | — | — | — | — | — |
| LAB506 | 65114.2 | 0.4 | 0.18 | 6 | — | — | — | — | — | — |
| LAB506 | 65115.3 | 0.4 | L | 13 | — | — | — | — | — | — |
| LAB506 | 65115.4 | 0.4 | 0.20 | 11 | — | — | — | — | — | — |
| LAB505 | 65109.2 | 0.4 | 0.07 | 8 | — | — | — | — | — | — |
| LAB505 | 65110.2 | — | — | — | 7.7 | 0.12 | 10 | 4.5 | 0.16 | 6 |
| LAB505 | 65110.4 | — | — | — | 7.5 | 0.29 | 7 | — | — | — |

TABLE 99-continued

Genes showing improved plant performance drought conditions

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LAB449 | 65095.1 | 0.4 | 0.07 | 21 | — | — | — | — | — | — |
| LAB449 | 65096.1 | 0.4 | L | 21 | — | — | — | — | — | — |
| LAB446 | 65090.3 | 0.4 | L | 13 | — | — | — | — | — | — |
| LAB446 | 65091.2 | 0.4 | 0.28 | 20 | — | — | — | — | — | — |
| LAB446 | 65094.1 | 0.4 | L | 10 | — | — | — | — | — | — |
| LAB444 | 65085.4 | 0.4 | 0.03 | 14 | — | — | — | — | — | — |
| LAB444 | 65086.1 | 0.4 | 0.12 | 18 | — | — | — | — | — | — |
| LAB444 | 65088.5 | 0.4 | 0.14 | 13 | — | — | — | — | — | — |
| LAB428 | 65079.3 | 0.4 | 0.21 | 19 | — | — | — | — | — | — |
| LAB428 | 65082.2 | 0.4 | 0.13 | 22 | — | — | — | — | — | — |
| LAB428 | 65082.3 | 0.4 | 0.25 | 5 | — | — | — | — | — | — |
| LAB423 | 65527.1 | — | — | — | — | — | — | 4.6 | 0.29 | 7 |
| LAB423 | 65527.3 | 0.4 | 0.02 | 17 | — | — | — | — | — | — |
| LAB423 | 65528.3 | 0.4 | 0.03 | 9 | — | — | — | — | — | — |
| CONT. | — | 0.4 | — | — | 7.0 | — | — | 4.3 | — | — |
| LAB572 | 66117.2 | — | — | — | 6.6 | 0.25 | 22 | 4.3 | 0.06 | 8 |
| LAB569 | 65257.4 | — | — | — | 6.7 | 0.27 | 24 | — | — | — |
| LAB567 | 66068.3 | — | — | — | 7.1 | L | 31 | 4.4 | 0.02 | 10 |
| LAB567 | 66072.4 | 0.4 | 0.14 | 7 | 6.1 | L | 12 | — | — | — |
| LAB566 | 66140.1 | 0.4 | 0.19 | 11 | — | — | — | — | — | — |
| LAB566 | 66142.1 | 0.4 | 0.14 | 8 | — | — | — | — | — | — |
| LAB558 | 65323.1 | — | — | — | 5.8 | 0.02 | 7 | — | — | — |
| LAB558 | 65325.2 | — | — | — | 6.5 | 0.02 | 20 | 4.4 | 0.02 | 8 |
| LAB548 | 65702.3 | — | — | — | 6.0 | 0.04 | 11 | 4.2 | 0.24 | 5 |
| LAB548 | 65703.2 | 0.5 | 0.04 | 20 | — | — | — | — | — | — |
| LAB548 | 65703.4 | 0.4 | 0.04 | 12 | 6.1 | 0.29 | 13 | — | — | — |
| LAB541 | 65412.7 | — | — | — | 5.6 | 0.13 | 3 | — | — | — |
| LAB541 | 65412.8 | — | — | — | 7.2 | L | 33 | 4.5 | 0.10 | 12 |
| LAB526 | 65669.4 | — | — | — | 7.3 | 0.07 | 36 | 4.4 | 0.11 | 8 |
| LAB521 | 65599.6 | 0.4 | 0.20 | 9 | — | — | — | — | — | — |
| LAB521 | 65603.2 | 0.4 | 0.13 | 12 | — | — | — | — | — | — |
| LAB518 | 66023.3 | 0.4 | 0.22 | 10 | 6.0 | 0.14 | 10 | 4.2 | 0.28 | 5 |
| LAB518 | 66024.5 | — | — | — | 6.2 | L | 14 | 4.3 | L | 6 |
| LAB498 | 66038.3 | 0.4 | 0.28 | 6 | 5.9 | L | 9 | 4.1 | 0.10 | 3 |
| LAB467 | 66130.2 | — | — | — | 6.6 | 0.10 | 23 | 4.4 | L | 9 |
| LAB439 | 65948.2 | — | — | — | — | — | — | 4.2 | 0.27 | 3 |
| LAB405 | 66122.1 | — | — | — | 6.4 | 0.22 | 19 | 4.3 | 0.22 | 7 |
| LAB396 | 65924.1 | — | — | — | 6.5 | 0.03 | 20 | 4.2 | 0.03 | 5 |
| LAB396 | 65925.4 | — | — | — | 7.5 | 0.20 | 39 | 4.6 | 0.24 | 15 |
| LAB396 | 65926.1 | — | — | — | 6.3 | 0.12 | 17 | 4.2 | 0.11 | 5 |
| LAB396 | 65927.1 | — | — | — | 6.7 | 0.23 | 24 | 4.2 | 0.10 | 3 |
| CONT. | — | 0.4 | — | — | 5.4 | — | — | 4.0 | — | — |

Table 99.
"CONT."—Control;
"Ave."—Average;
"% Incr." = % increment;
"p-val."—p-value; L means that p-value is less than 0.01.
The transgenes were under the transcriptional regulation of the new At6669 promoter (SEQ ID NO: 7724).

TABLE 100

Genes showing improved plant performance drought conditions

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LAB585 | 65398.2 | — | — | — | 19.9 | 0.30 | 8 |
| LAB585 | 65399.2 | 208.6 | 0.14 | 5 | — | — | — |
| LAB573 | 65571.2 | 233.0 | 0.02 | 17 | — | — | — |
| LAB573 | 65572.1 | 226.4 | 0.05 | 14 | — | — | — |
| LAB570 | 65557.3 | — | — | — | 19.4 | 0.05 | 5 |
| LAB570 | 65558.2 | — | — | — | 21.8 | L | 18 |
| LAB570 | 65559.2 | 237.8 | L | 20 | 19.0 | 0.27 | 3 |
| LAB568 | 65617.3 | — | — | — | 19.8 | 0.02 | 7 |
| LAB540 | 65883.1 | 210.4 | 0.17 | 6 | — | — | — |
| LAB540 | 65883.2 | 220.6 | 0.01 | 11 | — | — | — |
| LAB534 | 65876.2 | — | — | — | 19.1 | 0.15 | 3 |
| LAB534 | 65877.2 | 215.4 | 0.25 | 8 | — | — | — |
| LAB510 | 65990.3 | 211.5 | 0.07 | 6 | — | — | — |
| LAB510 | 65993.1 | — | — | — | 24.1 | L | 30 |
| LAB504 | 66014.6 | 211.1 | 0.11 | 6 | 19.6 | 0.10 | 6 |
| LAB468 | 65836.2 | 207.4 | 0.18 | 4 | — | — | — |
| LAB468 | 65838.1 | 234.4 | L | 18 | — | — | — |
| LAB468 | 65838.2 | 251.9 | 0.29 | 27 | — | — | — |
| LAB460 | 65645.2 | 216.7 | 0.15 | 9 | — | — | — |
| LAB460 | 65647.2 | 213.2 | 0.05 | 7 | — | — | — |
| LAB458 | 65805.3 | 228.6 | 0.26 | 15 | — | — | — |
| LAB458 | 65805.4 | 209.9 | 0.25 | 6 | — | — | — |
| LAB440 | 65956.1 | — | — | — | 22.6 | L | 23 |
| LAB426 | 65637.2 | 238.3 | L | 20 | — | — | — |

TABLE 100-continued

Genes showing improved plant performance drought conditions

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| CONT. | — | 198.7 | — | — | 18.5 | — | — |
| LAB589 | 65918.5 | 350.5 | L | 6 | — | — | — |
| LAB589 | 65919.2 | 352.7 | 0.14 | 7 | 20.0 | 0.05 | 5 |
| LAB589 | 65919.4 | — | — | — | 19.5 | 0.20 | 3 |
| LAB589 | 65921.3 | 346.7 | L | 5 | — | — | — |
| LAB571 | 65564.4 | 344.8 | 0.17 | 5 | — | — | — |
| LAB554 | 66236.3 | 367.1 | 0.10 | 11 | — | — | — |
| LAB554 | 66241.3 | — | — | — | 19.6 | 0.18 | 3 |
| LAB550 | 65900.1 | 348.8 | 0.07 | 6 | — | — | — |
| LAB550 | 65901.2 | 362.0 | 0.01 | 10 | 19.7 | 0.11 | 4 |
| LAB547 | 65825.1 | 371.7 | 0.18 | 13 | — | — | — |
| LAB530 | 66261.4 | 364.1 | 0.02 | 10 | — | — | — |
| LAB530 | 66262.2 | — | — | — | 21.8 | L | 15 |
| LAB530 | 66262.5 | 352.5 | 0.12 | 7 | — | — | — |
| LAB530 | 66264.2 | 354.6 | 0.19 | 8 | 20.9 | 0.05 | 10 |
| LAB529 | 65392.2 | 340.3 | 0.13 | 3 | — | — | — |
| LAB503 | 66212.1 | 352.2 | 0.13 | 7 | 21.0 | 0.04 | 11 |
| LAB503 | 66213.5 | 362.1 | 0.01 | 10 | — | — | — |
| LAB502 | 65975.1 | 354.7 | 0.10 | 8 | 20.1 | 0.04 | 6 |
| LAB502 | 65976.2 | 355.7 | L | 8 | — | — | — |
| LAB496 | 65961.2 | 370.9 | L | 13 | — | — | — |
| LAB496 | 65962.2 | 368.8 | 0.26 | 12 | 20.4 | 0.01 | 7 |
| LAB484 | 65847.2 | 363.2 | 0.15 | 10 | 19.6 | 0.17 | 3 |
| LAB484 | 65848.3 | — | — | — | 19.9 | 0.15 | 5 |
| LAB483 | 65840.3 | 357.7 | 0.12 | 9 | 19.4 | 0.28 | 2 |
| LAB483 | 65841.2 | — | — | — | 19.6 | 0.15 | 3 |
| LAB483 | 65843.2 | — | — | — | 22.8 | 0.18 | 20 |
| LAB483 | 65844.2 | — | — | — | 22.6 | L | 19 |
| LAB453 | 66177.1 | 366.9 | 0.09 | 11 | — | — | — |
| LAB453 | 66177.2 | 351.6 | L | 7 | — | — | — |
| LAB453 | 66178.4 | 374.6 | 0.30 | 14 | — | — | — |
| LAB452 | 66171.2 | 344.9 | 0.05 | 5 | — | — | — |
| LAB452 | 66172.4 | — | — | — | 19.5 | 0.22 | 3 |
| LAB452 | 66172.7 | — | — | — | 19.7 | 0.25 | 4 |
| LAB432 | 66003.4 | 365.0 | 0.04 | 11 | — | — | — |
| LAB430 | 66206.2 | 338.2 | 0.05 | 3 | 20.1 | 0.11 | 6 |
| LAB430 | 66207.4 | 355.6 | 0.27 | 8 | 21.6 | 0.05 | 14 |
| CONT. | — | 329.6 | — | — | 19.0 | — | — |
| LAB610 | 65342.3 | 229.5 | 0.07 | 5 | 21.6 | L | 28 |
| LAB610 | 65342.5 | 237.6 | 0.01 | 9 | 17.3 | 0.11 | 2 |
| LAB595 | 65269.5 | — | — | — | 17.4 | 0.04 | 3 |
| LAB595 | 65270.2 | 254.9 | 0.01 | 17 | 20.1 | 0.11 | 19 |
| LAB595 | 65270.3 | 257.6 | 0.24 | 18 | — | — | — |
| LAB595 | 65273.2 | — | — | — | 19.7 | L | 16 |
| LAB595 | 65273.3 | — | — | — | 17.3 | 0.26 | 2 |
| LAB578 | 65581.3 | 239.6 | 0.21 | 10 | — | — | — |
| LAB578 | 65582.3 | — | — | — | 18.2 | L | 8 |
| LAB578 | 65582.6 | 228.9 | 0.09 | 5 | 17.3 | 0.15 | 2 |
| LAB577 | 65578.4 | 228.0 | 0.12 | 4 | — | — | — |
| LAB576 | 65329.2 | — | — | — | 17.5 | 0.02 | 4 |
| LAB576 | 65330.2 | 269.2 | 0.18 | 23 | — | — | — |
| LAB576 | 65332.3 | 252.9 | 0.10 | 16 | 17.9 | 0.17 | 5 |
| LAB562 | 65614.4 | 244.3 | 0.02 | 12 | 17.8 | 0.22 | 5 |
| LAB546 | 65155.2 | 233.5 | 0.11 | 7 | — | — | — |
| LAB546 | 65156.1 | — | — | — | 17.8 | 0.04 | 5 |
| LAB546 | 65156.2 | — | — | — | 18.2 | 0.03 | 7 |
| LAB546 | 65157.4 | 236.1 | 0.02 | 8 | 17.9 | L | 5 |
| LAB524 | 65135.1 | — | — | — | 22.9 | 0.18 | 35 |
| LAB524 | 65135.2 | — | — | — | 17.9 | L | 6 |
| LAB524 | 65136.1 | 233.7 | 0.03 | 7 | 17.4 | 0.05 | 3 |
| LAB524 | 65136.4 | 236.7 | 0.19 | 8 | — | — | — |
| LAB524 | 65139.4 | 239.1 | 0.03 | 10 | — | — | — |
| LAB513 | 65124.3 | 252.3 | 0.02 | 16 | 17.7 | L | 5 |
| LAB513 | 65124.5 | 236.9 | 0.02 | 9 | 17.6 | 0.06 | 4 |
| LAB513 | 65125.1 | — | — | — | 17.3 | 0.23 | 2 |
| LAB513 | 65126.1 | 240.5 | 0.17 | 10 | 18.2 | 0.09 | 7 |
| LAB506 | 65111.7 | — | — | — | 17.4 | 0.04 | 3 |
| LAB506 | 65115.3 | 240.4 | L | 10 | 18.8 | L | 11 |
| LAB506 | 65115.4 | — | — | — | 17.5 | 0.10 | 4 |
| LAB505 | 65109.2 | — | — | — | 17.5 | 0.04 | 3 |
| LAB505 | 65110.2 | — | — | — | 20.5 | L | 21 |
| LAB505 | 65110.4 | — | — | — | 19.0 | 0.08 | 12 |
| LAB457 | 65100.1 | — | — | — | 18.0 | 0.26 | 6 |
| LAB457 | 65100.2 | 243.7 | 0.03 | 12 | 18.1 | 0.07 | 7 |
| LAB457 | 65101.2 | — | — | — | 19.9 | 0.20 | 18 |
| LAB457 | 65102.2 | 227.0 | 0.14 | 4 | 17.5 | 0.03 | 3 |
| LAB450 | 65306.2 | 237.7 | 0.25 | 9 | — | — | — |
| LAB449 | 65095.1 | — | — | — | 18.5 | L | 9 |
| LAB449 | 65096.1 | 250.9 | 0.07 | 15 | 17.2 | 0.21 | 2 |
| LAB449 | 65098.5 | — | — | — | 17.6 | 0.05 | 4 |
| LAB446 | 65090.3 | 238.7 | 0.16 | 9 | 17.6 | L | 4 |
| LAB446 | 65091.2 | 258.4 | 0.21 | 18 | — | — | — |
| LAB446 | 65091.3 | 236.0 | 0.03 | 8 | 20.2 | 0.22 | 19 |
| LAB446 | 65093.2 | 229.3 | 0.09 | 5 | 17.6 | 0.10 | 4 |
| LAB446 | 65094.1 | 244.9 | 0.01 | 12 | — | — | — |
| LAB444 | 65085.4 | 233.2 | 0.25 | 7 | — | — | — |
| LAB444 | 65086.1 | 267.5 | L | 23 | — | — | — |
| LAB444 | 65086.2 | — | — | — | 18.1 | 0.20 | 7 |
| LAB428 | 65079.1 | — | — | — | 19.9 | L | 17 |
| LAB428 | 65082.3 | 227.3 | 0.26 | 4 | — | — | — |
| LAB423 | 65527.1 | 241.6 | 0.29 | 11 | 18.6 | 0.23 | 10 |
| LAB423 | 65527.3 | 249.7 | L | 14 | 17.8 | L | 5 |
| LAB423 | 65528.3 | 243.1 | 0.13 | 11 | 17.3 | 0.14 | 2 |
| LAB423 | 65530.2 | — | — | — | 17.4 | 0.10 | 3 |
| CONT. | — | 218.2 | — | — | 16.9 | — | — |
| LAB572 | 66117.2 | 288.9 | 0.29 | 10 | — | — | — |
| LAB569 | 65260.6 | — | — | — | 19.5 | 0.12 | 5 |
| LAB567 | 66068.3 | — | — | — | 21.4 | 0.03 | 15 |
| LAB566 | 66142.1 | 284.6 | 0.22 | 9 | — | — | — |
| LAB566 | 66143.1 | 288.6 | 0.17 | 10 | — | — | — |
| LAB558 | 65324.1 | — | — | — | 19.5 | 0.13 | 5 |
| LAB555 | 65605.1 | — | — | — | 20.4 | 0.02 | 10 |
| LAB555 | 65606.2 | — | — | — | 20.3 | 0.03 | 10 |
| LAB555 | 65607.7 | 287.1 | 0.26 | 10 | 19.3 | 0.30 | 4 |
| LAB548 | 65702.3 | — | — | — | 19.9 | 0.23 | 7 |
| LAB548 | 65703.2 | — | — | — | 19.7 | 0.07 | 6 |
| LAB548 | 65703.4 | 291.4 | 0.13 | 11 | 22.7 | L | 22 |
| LAB526 | 65666.2 | — | — | — | 19.7 | 0.08 | 6 |
| LAB526 | 65669.2 | — | — | — | 20.8 | 0.03 | 12 |
| LAB521 | 65599.6 | 292.3 | 0.16 | 12 | — | — | — |
| LAB518 | 66023.3 | 291.3 | 0.14 | 11 | 20.5 | 0.05 | 11 |
| LAB518 | 66024.5 | — | — | — | 22.8 | 0.24 | 23 |
| LAB498 | 66038.3 | — | — | — | 19.3 | 0.22 | 4 |
| LAB498 | 66041.1 | 291.9 | 0.16 | 11 | — | — | — |
| LAB467 | 66130.2 | 288.5 | 0.17 | 10 | — | — | — |
| LAB467 | 66131.2 | — | — | — | 19.4 | 0.17 | 5 |
| LAB467 | 66131.4 | 285.8 | 0.20 | 9 | — | — | — |
| LAB443 | 65555.2 | — | — | — | 19.5 | 0.16 | 5 |
| LAB443 | 65555.3 | 282.8 | 0.26 | 8 | 19.5 | 0.28 | 5 |
| LAB443 | 65556.1 | 295.6 | 0.21 | 13 | 19.8 | 0.15 | 7 |
| LAB439 | 65948.2 | — | — | — | 20.6 | 0.03 | 11 |
| LAB439 | 65952.1 | — | — | — | 19.8 | 0.12 | 7 |
| LAB405 | 66122.1 | — | — | — | 19.5 | 0.17 | 5 |
| LAB405 | 66124.2 | — | — | — | 19.4 | 0.28 | 4 |
| LAB405 | 66126.1 | — | — | — | 23.9 | L | 29 |
| LAB396 | 65924.1 | 286.3 | 0.19 | 9 | — | — | — |
| LAB396 | 65925.4 | — | — | — | 23.6 | 0.05 | 27 |
| LAB396 | 65926.1 | — | — | — | 23.5 | 0.11 | 26 |
| LAB396 | 65927.1 | — | — | — | 22.0 | L | 18 |
| CONT. | — | 261.9 | — | — | 18.6 | — | — |

Table 100.
"CONT."—Control;
"Ave."— Average;
"% Incr." = % increment;
"p-val."—p-value;
"L" means that p-value is less than 0.01.
The transgenes were under the transcriptional regulation of the new At6669 promoter (SEQ ID NO: 7724).

TABLE 101

Genes showing improved plant performance under standard growth conditions

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LAB609 | 65708.2 | — | — | — | 19.7 | 0.03 | −5 | — | — | — |
| LAB609 | 65709.3 | — | — | — | 20.2 | 0.19 | −3 | — | — | — |
| LAB609 | 65711.1 | — | — | — | 20.0 | 0.08 | −3 | — | — | — |
| LAB609 | 65711.2 | 824.4 | L | 15 | 20.1 | 0.11 | −3 | — | — | — |
| LAB605 | 65978.1 | — | — | — | 20.3 | 0.29 | −2 | — | — | — |
| LAB605 | 65979.2 | 943.1 | 0.05 | 31 | — | — | — | — | — | — |
| LAB605 | 65980.1 | — | — | — | 20.3 | 0.29 | −2 | — | — | — |
| LAB605 | 65980.3 | 777.5 | 0.30 | 8 | 19.9 | 0.06 | −4 | — | — | — |
| LAB605 | 65982.2 | 835.0 | L | 16 | — | — | — | — | — | — |
| LAB585 | 65396.1 | — | — | — | 20.1 | 0.11 | −3 | — | — | — |
| LAB585 | 65399.2 | — | — | — | 20.2 | 0.22 | −2 | — | — | — |
| LAB585 | 65400.1 | — | — | — | 19.7 | 0.02 | −5 | — | — | — |
| LAB573 | 65571.2 | 899.4 | 0.27 | 25 | — | — | — | — | — | — |
| LAB573 | 65572.3 | 743.8 | 0.26 | 3 | 19.8 | 0.04 | −4 | — | — | — |
| LAB573 | 65573.5 | 795.0 | L | 10 | — | — | — | — | — | — |
| LAB570 | 65557.3 | 743.1 | 0.28 | 3 | — | — | — | — | — | — |
| LAB570 | 65558.2 | 792.9 | 0.23 | 10 | — | — | — | — | — | — |
| LAB570 | 65560.2 | — | — | — | 20.2 | 0.22 | −2 | — | — | — |
| LAB568 | 65619.1 | — | — | — | 19.8 | 0.04 | −5 | — | — | — |
| LAB568 | 65620.1 | 800.0 | L | 11 | — | — | — | — | — | — |
| LAB540 | 65883.1 | 778.1 | 0.26 | 8 | 20.3 | 0.29 | −2 | — | — | — |
| LAB540 | 65883.2 | 811.4 | 0.15 | 13 | — | — | — | — | — | — |
| LAB540 | 65884.8 | — | — | — | 20.1 | 0.12 | −3 | — | — | — |
| LAB534 | 65876.2 | 847.9 | 0.25 | 18 | — | — | — | — | — | — |
| LAB534 | 65877.2 | — | — | — | 20.0 | 0.08 | −3 | — | — | — |
| LAB534 | 65878.3 | — | — | — | 20.2 | 0.15 | −3 | — | — | — |
| LAB510 | 65991.1 | — | — | — | 19.8 | 0.04 | −4 | — | — | — |
| LAB510 | 65991.2 | 846.9 | L | 18 | 19.4 | 0.11 | −6 | — | — | — |
| LAB510 | 65993.1 | 920.0 | 0.02 | 28 | — | — | — | — | — | — |
| LAB504 | 66014.6 | 894.8 | 0.23 | 24 | — | — | — | — | — | — |
| LAB504 | 66015.2 | 753.8 | 0.12 | 5 | — | — | — | — | — | — |
| LAB504 | 66016.2 | 761.2 | 0.21 | 6 | 20.2 | 0.19 | −3 | — | — | — |
| LAB504 | 66018.1 | — | — | — | 20.0 | 0.16 | −3 | — | — | — |
| LAB468 | 65834.2 | — | — | — | 20.2 | 0.19 | −3 | — | — | — |
| LAB468 | 65838.1 | — | — | — | 20.0 | 0.10 | −3 | — | — | — |
| LAB468 | 65838.2 | 763.1 | 0.20 | 6 | — | — | — | — | — | — |
| LAB460 | 65644.3 | 769.4 | 0.26 | 7 | 19.9 | 0.06 | −4 | — | — | — |
| LAB460 | 65645.1 | — | — | — | 20.2 | 0.22 | −3 | — | — | — |
| LAB460 | 65645.2 | 812.5 | 0.23 | 13 | 19.7 | 0.03 | −5 | — | — | — |
| LAB460 | 65647.2 | — | — | — | 19.9 | 0.06 | −4 | — | — | — |
| LAB460 | 65647.4 | 775.6 | 0.03 | 8 | 19.8 | 0.03 | −5 | — | — | — |
| LAB458 | 65804.3 | 784.4 | 0.26 | 9 | — | — | — | — | — | — |
| LAB458 | 65805.4 | — | — | — | 20.3 | 0.25 | −2 | — | — | — |
| LAB455 | 66008.3 | 836.2 | 0.13 | 16 | 20.1 | 0.11 | −3 | — | — | — |
| LAB455 | 66009.4 | — | — | — | 20.0 | 0.10 | −3 | — | — | — |
| LAB455 | 66011.1 | — | — | — | 20.3 | 0.29 | −2 | — | — | — |
| LAB455 | 66011.3 | — | — | — | 20.1 | 0.11 | −3 | — | — | — |
| LAB440 | 65954.1 | 834.4 | 0.05 | 16 | — | — | — | — | — | — |
| LAB440 | 65955.1 | 745.0 | 0.24 | 3 | — | — | — | — | — | — |
| LAB440 | 65956.1 | — | — | — | 19.5 | 0.08 | −6 | — | — | — |
| LAB440 | 65957.2 | — | — | — | 20.0 | 0.10 | −3 | — | — | — |
| LAB440 | 65957.4 | 928.1 | 0.06 | 29 | 20.1 | 0.11 | −3 | — | — | — |
| LAB426 | 65636.1 | — | — | — | 19.9 | 0.11 | −4 | — | — | — |
| LAB426 | 65640.4 | 762.5 | 0.10 | 6 | 19.9 | 0.06 | −4 | — | — | — |
| LAB410 | 65401.2 | 757.7 | 0.13 | 5 | 20.0 | 0.10 | −3 | — | — | — |
| LAB410 | 65402.1 | — | — | — | 19.6 | 0.25 | −6 | — | — | — |
| LAB410 | 65402.4 | 762.5 | 0.14 | 6 | — | — | — | — | — | — |
| LAB410 | 65405.4 | 753.8 | 0.12 | 5 | — | — | — | — | — | — |
| LAB410 | 65406.2 | 759.4 | 0.27 | 5 | 20.2 | 0.19 | −3 | — | — | — |
| CONT. | — | 719.9 | — | — | 20.7 | — | — | — | — | — |
| LAB589 | 65921.3 | — | — | — | 17.5 | L | −4 | 11.6 | 0.29 | −7 |
| LAB571 | 65568.2 | 1054.4 | 0.06 | 5 | 17.3 | 0.02 | −5 | — | — | — |
| LAB547 | 65822.1 | 1063.1 | 0.02 | 6 | 16.3 | L | −11 | 11.3 | 0.07 | −10 |
| LAB547 | 65823.1 | — | — | — | 15.6 | 0.02 | −14 | 9.2 | L | −27 |
| LAB547 | 65824.2 | — | — | — | 16.7 | 0.16 | −9 | 10.9 | L | −13 |
| LAB547 | 65825.1 | — | — | — | 17.8 | 0.20 | −3 | 11.6 | 0.29 | −7 |
| LAB530 | 66264.2 | — | — | — | 17.1 | 0.02 | −6 | 11.8 | 0.02 | −5 |
| LAB529 | 65389.1 | — | — | — | 17.5 | 0.09 | −4 | 11.5 | 0.14 | −8 |
| LAB529 | 65391.3 | 1048.8 | 0.08 | 5 | 17.3 | L | −5 | — | — | — |
| LAB484 | 65846.3 | 1030.0 | 0.21 | 3 | — | — | — | — | — | — |
| LAB484 | 65847.2 | — | — | — | 18.0 | 0.22 | −1 | — | — | — |
| LAB484 | 65850.3 | — | — | — | 17.9 | 0.14 | −2 | 11.7 | 0.03 | −6 |

TABLE 101-continued

Genes showing improved plant performance under standard growth conditions

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LAB483 | 65841.2 | — | — | — | 16.7 | 0.05 | −9 | 11.3 | 0.25 | −9 |
| LAB483 | 65843.2 | 1101.9 | 0.26 | 10 | 16.8 | 0.21 | −8 | — | — | — |
| LAB483 | 65844.2 | 1117.5 | 0.06 | 11 | — | — | — | 11.8 | 0.14 | −5 |
| LAB432 | 66003.3 | — | — | — | 17.7 | 0.03 | −3 | — | — | — |
| LAB399 | 65503.1 | — | — | — | 17.9 | 0.14 | −2 | — | — | — |
| LAB399 | 65507.1 | — | — | — | — | — | — | 12.2 | 0.24 | −2 |
| CONT. | — | 1003.5 | — | — | 18.3 | — | — | 12.5 | — | — |
| LAB610 | 65342.3 | 936.2 | L | 15 | — | — | — | — | — | — |
| LAB610 | 65342.5 | 893.8 | 0.18 | 10 | — | — | — | — | — | — |
| LAB610 | 65343.2 | 873.1 | 0.08 | 7 | — | — | — | — | — | — |
| LAB610 | 65343.5 | 882.5 | 0.06 | 8 | — | — | — | 16.1 | 0.16 | −1 |
| LAB595 | 65270.3 | 900.0 | 0.25 | 10 | — | — | — | 16.1 | 0.25 | −1 |
| LAB595 | 65273.2 | 898.1 | 0.11 | 10 | — | — | — | 16.1 | 0.16 | −1 |
| LAB578 | 65581.3 | 908.1 | 0.02 | 11 | — | — | — | — | — | — |
| LAB578 | 65582.3 | 938.1 | 0.03 | 15 | — | — | — | — | — | — |
| LAB577 | 65575.2 | 887.5 | 0.20 | 9 | — | — | — | — | — | — |
| LAB577 | 65577.3 | — | — | — | — | — | — | 16.1 | 0.16 | −1 |
| LAB577 | 65577.4 | 891.9 | 0.03 | 9 | — | — | — | — | — | — |
| LAB577 | 65578.4 | — | — | — | — | — | — | 16.1 | 0.25 | −1 |
| LAB577 | 65579.2 | 920.2 | L | 13 | — | — | — | — | — | — |
| LAB576 | 65330.2 | 1025.4 | 0.20 | 26 | — | — | — | — | — | — |
| LAB576 | 65332.2 | — | — | — | — | — | — | 16.0 | 0.04 | −2 |
| LAB576 | 65332.3 | 863.8 | 0.28 | 6 | — | — | — | — | — | — |
| LAB562 | 65611.1 | 870.6 | 0.09 | 7 | — | — | — | — | — | — |
| LAB562 | 65612.2 | 940.0 | 0.11 | 15 | — | — | — | — | — | — |
| LAB546 | 65153.2 | 872.5 | 0.10 | 7 | — | — | — | — | — | — |
| LAB546 | 65156.1 | — | — | — | — | — | — | 16.0 | 0.04 | −2 |
| LAB546 | 65156.2 | 952.5 | 0.02 | 17 | — | — | — | 16.1 | 0.16 | −1 |
| LAB546 | 65157.4 | 940.0 | L | 15 | — | — | — | — | — | — |
| LAB524 | 65136.1 | 865.1 | 0.16 | 6 | — | — | — | — | — | — |
| LAB524 | 65136.4 | 914.4 | 0.07 | 12 | — | — | — | — | — | — |
| LAB524 | 65139.4 | 903.1 | 0.25 | 11 | — | — | — | — | — | — |
| LAB513 | 65124.5 | — | — | — | — | — | — | 16.0 | 0.04 | −2 |
| LAB505 | 65105.1 | 947.5 | 0.06 | 16 | — | — | — | — | — | — |
| LAB505 | 65110.2 | 931.2 | 0.02 | 14 | — | — | — | 16.1 | 0.16 | −1 |
| LAB457 | 65100.1 | 876.2 | 0.07 | 7 | — | — | — | — | — | — |
| LAB457 | 65100.2 | 908.8 | 0.02 | 11 | — | — | — | — | — | — |
| LAB457 | 65102.2 | 891.9 | 0.20 | 9 | — | — | — | — | — | — |
| LAB450 | 65306.2 | 939.3 | 0.13 | 15 | — | — | — | — | — | — |
| LAB450 | 65309.1 | — | — | — | — | — | — | 16.0 | 0.04 | −2 |
| LAB450 | 65309.2 | — | — | — | — | — | — | 16.1 | 0.25 | −1 |
| LAB449 | 65098.4 | — | — | — | — | — | — | 16.1 | 0.22 | −1 |
| LAB449 | 65099.4 | 889.4 | 0.11 | 9 | — | — | — | — | — | — |
| LAB446 | 65090.3 | — | — | — | — | — | — | 16.0 | 0.04 | −2 |
| LAB446 | 65093.2 | — | — | — | — | — | — | 16.1 | 0.25 | −1 |
| LAB444 | 65086.1 | 914.4 | 0.04 | 12 | — | — | — | 16.0 | 0.04 | −2 |
| LAB444 | 65088.5 | — | — | — | — | — | — | 16.0 | 0.04 | −2 |
| LAB428 | 65078.2 | — | — | — | — | — | — | 16.1 | 0.16 | −1 |
| LAB428 | 65079.1 | — | — | — | — | — | — | 16.0 | 0.04 | −2 |
| LAB428 | 65082.2 | 896.9 | 0.06 | 10 | — | — | — | — | — | — |
| LAB423 | 65528.2 | 880.6 | 0.19 | 8 | — | — | — | — | — | — |
| CONT. | — | 815.6 | — | — | — | — | — | 16.3 | — | — |
| LAB569 | 65257.4 | 1041.2 | 0.16 | 8 | 20.8 | 0.11 | −4 | — | — | — |
| LAB567 | 66072.4 | — | — | — | 20.8 | 0.11 | −4 | — | — | — |
| LAB566 | 66142.1 | — | — | — | 20.8 | 0.17 | −4 | — | — | — |
| LAB548 | 65703.2 | — | — | — | 21.1 | 0.26 | −3 | — | — | — |
| LAB548 | 65703.4 | — | — | — | 20.5 | 0.05 | −6 | — | — | — |
| LAB521 | 65601.3 | 1064.4 | 0.08 | 10 | — | — | — | — | — | — |
| LAB518 | 66023.1 | — | — | — | 20.6 | 0.24 | −5 | — | — | — |
| LAB518 | 66024.4 | 1032.5 | 0.27 | 7 | — | — | — | — | — | — |
| LAB498 | 66041.1 | 1025.0 | 0.18 | 6 | — | — | — | — | — | — |
| LAB498 | 66041.2 | 1075.3 | 0.04 | 11 | — | — | — | — | — | — |
| LAB443 | 65552.1 | 1053.8 | 0.29 | 9 | — | — | — | — | — | — |
| LAB439 | 65948.2 | 1063.1 | 0.06 | 10 | — | — | — | — | — | — |
| LAB396 | 65924.1 | — | — | — | 20.7 | 0.19 | −4 | — | — | — |
| LAB396 | 65925.4 | 1113.1 | 0.03 | 15 | 20.1 | 0.02 | −7 | — | — | — |

TABLE 101-continued

Genes showing improved plant performance under standard growth conditions

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LAB396 | 65926.1 | — | — | — | 21.1 | 0.22 | −3 | — | — | — |
| CONT. | — | 967.0 | — | — | 21.7 | — | — | — | — | — |

Table 101.
"CONT."—Control;
"Ave."— Average;
"% Incr." = % increment;
"p-val."—p-value;
"L" means that p-value is less than 0.01.
The transgenes were under the transcriptional regulation of the new At6669 promoter (SEQ ID NO: 7724).

TABLE 102

Genes showing improved plant performance under standard growth conditions

| Gene Name | Event # | Leaf Blade Area [cm²] Ave. | P-Val. | % Incr. | Leaf Number Ave. | P-Val. | % Incr. | Plot Coverage [cm²] Ave. | P-Val. | % Incr. |
|---|---|---|---|---|---|---|---|---|---|---|
| LAB609 | 65708.2 | 1.1 | L | 21 | 11.1 | 0.01 | 8 | 65.9 | L | 24 |
| LAB609 | 65709.3 | 1.0 | 0.15 | 6 | — | — | — | — | — | — |
| LAB609 | 65711.1 | 1.2 | 0.03 | 27 | — | — | — | 67.1 | 0.06 | 26 |
| LAB609 | 65711.2 | 1.2 | L | 29 | — | — | — | 68.8 | 0.13 | 29 |
| LAB605 | 65978.1 | 1.1 | 0.28 | 24 | — | — | — | 65.3 | 0.14 | 23 |
| LAB605 | 65980.1 | 1.0 | 0.10 | 12 | — | — | — | — | — | — |
| LAB605 | 65980.3 | 1.1 | 0.05 | 22 | — | — | — | 65.1 | 0.03 | 22 |
| LAB605 | 65982.2 | — | — | — | 10.8 | 0.22 | 5 | 68.3 | 0.30 | 28 |
| LAB585 | 65396.1 | 1.2 | L | 28 | — | — | — | 69.0 | L | 30 |
| LAB585 | 65399.1 | 1.1 | L | 18 | — | — | — | 62.5 | 0.01 | 17 |
| LAB585 | 65400.1 | 1.2 | 0.16 | 29 | 10.9 | 0.15 | 6 | 67.7 | 0.06 | 27 |
| LAB573 | 65572.1 | — | — | — | — | — | — | 58.2 | 0.21 | 9 |
| LAB573 | 65572.3 | 1.2 | L | 27 | — | — | — | 66.0 | L | 24 |
| LAB573 | 65573.2 | 1.1 | 0.26 | 17 | — | — | — | — | — | — |
| LAB570 | 65557.1 | 1.0 | 0.06 | 9 | — | — | — | 56.1 | 0.25 | 5 |
| LAB570 | 65557.3 | 1.1 | 0.10 | 15 | — | — | — | 61.1 | 0.04 | 15 |
| LAB568 | 65617.3 | 1.0 | 0.09 | 9 | — | — | — | — | — | — |
| LAB568 | 65620.1 | 1.0 | 0.29 | 10 | — | — | — | — | — | — |
| LAB568 | 65620.4 | 1.0 | 0.29 | 5 | — | — | — | — | — | — |
| LAB534 | 65876.2 | 1.0 | 0.27 | 4 | — | — | — | 57.5 | 0.27 | 8 |
| LAB510 | 65991.1 | 1.2 | 0.06 | 29 | 11.2 | L | 9 | 69.1 | L | 30 |
| LAB510 | 65991.2 | 1.1 | L | 17 | 11.1 | 0.08 | 9 | 67.4 | L | 27 |
| LAB510 | 65992.4 | 1.0 | 0.06 | 10 | — | — | — | 60.2 | 0.13 | 13 |
| LAB504 | 66016.2 | 1.1 | 0.29 | 13 | — | — | — | — | — | — |
| LAB468 | 65834.2 | — | — | — | 10.8 | 0.22 | 5 | — | — | — |
| LAB468 | 65837.1 | — | — | — | 11.2 | 0.12 | 9 | — | — | — |
| LAB460 | 65645.2 | 1.0 | 0.05 | 10 | — | — | — | 60.5 | 0.02 | 14 |
| LAB460 | 65647.2 | 1.1 | 0.02 | 16 | 10.6 | 0.17 | 4 | 63.3 | 0.03 | 19 |
| LAB460 | 65647.4 | 1.2 | 0.10 | 33 | — | — | — | 68.3 | 0.18 | 28 |
| LAB458 | 65805.4 | 1.2 | L | 31 | — | — | — | 69.3 | L | 30 |
| LAB455 | 66008.3 | 1.0 | 0.04 | 12 | — | — | — | — | — | — |
| LAB455 | 66011.1 | 1.1 | L | 22 | — | — | — | 63.2 | L | 19 |
| LAB455 | 66011.3 | 1.0 | 0.25 | 11 | — | — | — | — | — | — |
| LAB440 | 65955.1 | 1.0 | 0.22 | 8 | — | — | — | 57.2 | 0.26 | 7 |
| LAB440 | 65956.1 | — | — | — | — | — | — | 62.7 | 0.24 | 18 |
| LAB440 | 65957.2 | 1.0 | 0.06 | 8 | — | — | — | 57.0 | 0.21 | 7 |
| LAB440 | 65957.4 | 1.2 | 0.01 | 27 | 10.7 | 0.10 | 4 | 70.8 | 0.02 | 33 |
| LAB426 | 65636.1 | 1.2 | 0.18 | 31 | — | — | — | 72.0 | 0.27 | 35 |
| LAB426 | 65636.2 | 1.0 | 0.28 | 4 | — | — | — | — | — | — |
| LAB426 | 65640.4 | 1.1 | L | 14 | — | — | — | 63.7 | L | 20 |
| LAB410 | 65402.1 | 1.0 | 0.08 | 7 | — | — | — | 57.8 | 0.15 | 9 |
| LAB410 | 65402.4 | 1.1 | 0.25 | 16 | — | — | — | 62.9 | 0.24 | 18 |
| LAB410 | 65406.2 | 1.1 | L | 22 | 11.0 | 0.11 | 8 | 69.5 | L | 31 |
| LAB406 | 65517.3 | 1.0 | 0.04 | 11 | — | — | — | 60.6 | 0.08 | 14 |
| LAB406 | 65519.3 | 1.1 | 0.26 | 16 | — | — | — | — | — | — |
| CONT. | — | 0.9 | — | — | 10.2 | — | — | 53.2 | — | — |
| LAB589 | 65918.5 | — | — | — | 10.8 | 0.03 | 8 | — | — | — |
| LAB589 | 65919.2 | — | — | — | 10.6 | 0.15 | 5 | — | — | — |
| LAB589 | 65919.4 | 1.5 | 0.30 | 17 | — | — | — | — | — | — |

TABLE 102-continued

Genes showing improved plant performance under standard growth conditions

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB571 | 65564.4 | 1.3 | 0.28 | 6 | — | — | — | — | — | — |
| LAB571 | 65568.1 | — | — | — | 10.4 | 0.24 | 4 | — | — | — |
| LAB571 | 65568.2 | 1.5 | 0.22 | 22 | — | — | — | — | — | — |
| LAB554 | 66236.3 | 1.4 | L | 14 | — | — | — | 73.0 | L | 9 |
| LAB550 | 65900.1 | 1.5 | 0.08 | 18 | — | — | — | 80.0 | 0.14 | 20 |
| LAB550 | 65901.2 | 1.4 | 0.25 | 11 | — | — | — | — | — | — |
| LAB550 | 65903.2 | 1.4 | 0.27 | 8 | — | — | — | — | — | — |
| LAB547 | 65822.1 | — | — | — | — | — | — | 71.8 | 0.02 | 8 |
| LAB547 | 65824.2 | — | — | — | 10.8 | 0.16 | 8 | — | — | — |
| LAB547 | 65825.1 | — | — | — | 10.5 | 0.15 | 5 | — | — | — |
| LAB530 | 66264.2 | 1.5 | 0.14 | 20 | — | — | — | 84.0 | 0.22 | 26 |
| LAB529 | 65389.1 | 1.4 | 0.18 | 10 | — | — | — | — | — | — |
| LAB529 | 65391.2 | 1.3 | 0.13 | 4 | — | — | — | — | — | — |
| LAB502 | 65972.2 | 1.3 | 0.13 | 6 | — | — | — | 72.7 | 0.01 | 9 |
| LAB502 | 65976.6 | — | — | — | 10.6 | 0.07 | 6 | — | — | — |
| LAB496 | 65961.2 | 1.3 | 0.28 | 6 | — | — | — | — | — | — |
| LAB496 | 65962.3 | 1.6 | 0.15 | 26 | 10.4 | 0.25 | 4 | 84.6 | 0.18 | 27 |
| LAB484 | 65847.2 | 1.5 | L | 21 | 10.5 | 0.15 | 5 | 81.0 | 0.02 | 21 |
| LAB484 | 65850.3 | — | — | — | 10.4 | 0.25 | 4 | — | — | — |
| LAB483 | 65841.2 | 1.4 | 0.10 | 13 | 10.6 | 0.10 | 5 | 74.8 | 0.04 | 12 |
| LAB483 | 65841.3 | 1.6 | L | 25 | — | — | — | 78.8 | L | 18 |
| LAB483 | 65843.2 | 1.6 | 0.14 | 25 | 10.8 | 0.25 | 7 | 87.8 | 0.10 | 32 |
| LAB483 | 65844.2 | 1.4 | 0.28 | 14 | 10.7 | 0.05 | 7 | 78.1 | 0.02 | 17 |
| LAB452 | 66171.2 | 1.3 | 0.24 | 7 | — | — | — | — | — | — |
| LAB452 | 66171.3 | 1.4 | 0.25 | 14 | — | — | — | 77.1 | 0.23 | 16 |
| LAB432 | 66002.5 | 1.3 | 0.19 | 5 | — | — | — | — | — | — |
| LAB432 | 66003.3 | 1.4 | L | 12 | — | — | — | 76.3 | 0.05 | 14 |
| LAB432 | 66004.4 | 1.4 | L | 16 | — | — | — | 74.4 | L | 12 |
| LAB432 | 66004.5 | 1.3 | 0.29 | 3 | — | — | — | 68.9 | 0.22 | 3 |
| LAB430 | 66206.2 | 1.3 | 0.03 | 6 | — | — | — | 73.7 | L | 11 |
| LAB430 | 66207.3 | — | — | — | 10.8 | 0.16 | 8 | — | — | — |
| LAB430 | 66207.4 | 1.4 | L | 11 | — | — | — | 72.5 | 0.25 | 9 |
| LAB399 | 65503.1 | 1.4 | L | 12 | 10.7 | 0.05 | 7 | 75.1 | L | 13 |
| LAB399 | 65506.1 | 1.4 | 0.18 | 8 | — | — | — | — | — | — |
| CONT. | — | 1.3 | — | — | 10.0 | — | — | 66.7 | — | — |
| LAB578 | 65582.3 | 1.2 | 0.05 | 18 | — | — | — | 66.9 | 0.20 | 14 |
| LAB578 | 65582.6 | — | — | — | 11.1 | 0.14 | 3 | — | — | — |
| LAB577 | 65575.2 | 1.1 | 0.25 | 9 | — | — | — | 66.2 | 0.13 | 13 |
| LAB577 | 65577.3 | — | — | — | — | — | — | 64.8 | 0.23 | 10 |
| LAB577 | 65577.4 | 1.2 | 0.15 | 13 | 11.8 | 0.02 | 10 | 71.8 | 0.06 | 22 |
| LAB577 | 65578.4 | — | — | — | 11.2 | 0.18 | 4 | — | — | — |
| LAB576 | 65329.2 | — | — | — | 11.0 | 0.20 | 2 | — | — | — |
| LAB576 | 65332.2 | 1.2 | 0.18 | 12 | — | — | — | 72.4 | 0.11 | 23 |
| LAB576 | 65332.3 | 1.1 | 0.27 | 7 | 11.4 | L | 6 | — | — | — |
| LAB562 | 65611.1 | 1.2 | 0.27 | 14 | — | — | — | 67.0 | 0.17 | 14 |
| LAB562 | 65612.2 | — | — | — | 11.6 | L | 8 | — | — | — |
| LAB562 | 65614.4 | — | — | — | 11.6 | L | 8 | — | — | — |
| LAB546 | 65155.2 | 1.2 | 0.04 | 16 | 11.6 | 0.17 | 8 | 68.4 | 0.10 | 17 |
| LAB524 | 65135.2 | — | — | — | — | — | — | 66.1 | 0.14 | 13 |
| LAB513 | 65124.3 | — | — | — | 11.1 | 0.14 | 3 | — | — | — |
| LAB513 | 65125.1 | — | — | — | — | — | — | 63.6 | 0.27 | 8 |
| LAB506 | 65115.3 | 1.1 | 0.29 | 8 | — | — | — | — | — | — |
| LAB506 | 65115.4 | 1.3 | 0.29 | 27 | — | — | — | — | — | — |
| LAB505 | 65105.1 | 1.2 | 0.02 | 18 | 11.3 | 0.02 | 5 | 71.2 | 0.06 | 21 |
| LAB505 | 65110.2 | 1.3 | L | 25 | — | — | — | 76.1 | L | 30 |
| LAB457 | 65100.1 | 1.2 | 0.04 | 15 | — | — | — | 69.3 | 0.04 | 18 |
| LAB450 | 65306.1 | 1.3 | 0.02 | 22 | — | — | — | 73.2 | 0.07 | 25 |
| LAB450 | 65309.2 | — | — | — | 11.1 | 0.14 | 4 | — | — | — |
| LAB449 | 65098.4 | — | — | — | 11.2 | 0.07 | 5 | 67.2 | 0.14 | 15 |
| LAB446 | 65091.2 | 1.2 | 0.11 | 12 | — | — | — | 68.6 | 0.09 | 17 |
| LAB446 | 65093.2 | 1.2 | 0.28 | 11 | — | — | — | 67.0 | 0.18 | 14 |
| LAB444 | 65085.4 | 1.1 | 0.18 | 9 | — | — | — | 64.8 | 0.18 | 10 |
| LAB444 | 65086.1 | 1.2 | 0.11 | 11 | 11.1 | 0.14 | 4 | 68.6 | 0.09 | 17 |
| LAB428 | 65079.3 | — | — | — | 11.1 | 0.14 | 4 | 65.1 | 0.21 | 11 |
| LAB428 | 65082.2 | — | — | — | — | — | — | 66.3 | 0.21 | 13 |
| LAB423 | 65527.3 | 1.3 | 0.09 | 23 | — | — | — | 74.3 | 0.18 | 27 |
| LAB423 | 65528.2 | — | — | — | 11.5 | 0.25 | 7 | — | — | — |
| CONT. | — | 1.0 | — | — | 10.7 | — | — | 58.7 | — | — |
| LAB572 | 66117.3 | — | — | — | 9.8 | 0.28 | 4 | — | — | — |
| LAB569 | 65257.4 | 1.2 | 0.09 | 13 | — | — | — | 62.7 | 0.13 | 13 |
| LAB569 | 65260.3 | 1.1 | 0.20 | 6 | — | — | — | — | — | — |
| LAB567 | 66068.1 | — | — | — | 10.1 | 0.14 | 6 | — | — | — |

TABLE 102-continued

Genes showing improved plant performance under standard growth conditions

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB567 | 66072.4 | — | — | — | 11.3 | 0.13 | 20 | — | — | — |
| LAB566 | 66140.3 | — | — | — | 10.4 | 0.08 | 10 | — | — | — |
| LAB558 | 65323.1 | — | — | — | 10.4 | 0.29 | 10 | — | — | — |
| LAB555 | 65607.2 | 1.1 | 0.11 | 4 | 10.2 | 0.06 | 8 | 60.3 | 0.04 | 9 |
| LAB548 | 65703.2 | — | — | — | 10.1 | 0.08 | 7 | 58.3 | 0.23 | 6 |
| LAB548 | 65703.4 | 1.3 | 0.18 | 23 | 10.9 | L | 15 | 71.8 | 0.20 | 30 |
| LAB545 | 65698.1 | — | — | — | 10.7 | 0.06 | 13 | — | — | — |
| LAB541 | 65412.8 | 1.3 | 0.23 | 21 | 10.2 | 0.05 | 8 | — | — | — |
| LAB526 | 65667.3 | 1.1 | 0.18 | 8 | 10.2 | 0.05 | 8 | 61.5 | 0.24 | 11 |
| LAB526 | 65668.2 | — | — | — | 10.4 | 0.02 | 10 | — | — | — |
| LAB526 | 65669.4 | 1.2 | 0.21 | 16 | 10.8 | L | 14 | 66.6 | 0.25 | 21 |
| LAB521 | 65599.1 | — | L | — | 10.0 | 0.23 | 6 | — | — | — |
| LAB518 | 66023.1 | 1.4 | L | 39 | 11.2 | L | 18 | 83.4 | L | 51 |
| LAB518 | 66023.3 | — | — | — | 11.3 | 0.02 | 20 | 70.0 | 0.28 | 27 |
| LAB498 | 66041.1 | — | — | — | 10.2 | 0.05 | 8 | 59.0 | 0.11 | 7 |
| LAB467 | 66130.1 | — | — | — | — | — | — | 66.5 | 0.03 | 20 |
| LAB467 | 66130.2 | 1.2 | 0.26 | 14 | 10.8 | L | 14 | 66.5 | 0.24 | 20 |
| LAB467 | 66131.2 | — | — | — | 10.4 | 0.29 | 10 | — | — | — |
| LAB467 | 66131.4 | 1.1 | 0.24 | 8 | — | — | — | — | — | — |
| LAB439 | 65950.1 | 1.1 | 0.11 | 6 | — | — | — | 59.1 | 0.21 | 7 |
| LAB405 | 66122.1 | — | — | — | 10.0 | 0.23 | 6 | — | — | — |
| LAB405 | 66124.4 | — | — | — | 10.1 | 0.10 | 6 | — | — | — |
| LAB396 | 65924.1 | 1.5 | 0.12 | 45 | 11.3 | L | 20 | 86.6 | 0.11 | 57 |
| LAB396 | 65925.4 | 1.4 | 0.07 | 33 | 10.4 | 0.02 | 10 | 76.2 | 0.07 | 38 |
| CONT. | — | 1.0 | — | — | 9.4 | — | — | 55.2 | — | — |

Table 102.
"CONT."—Control;
"Ave."— Average;
"% Incr." = % increment;
"p-val."—p-value;
"L" means that p-value is less than 0.01.
The transgenes were under the transcriptional regulation of the new At6669 promoter (SEQ ID NO: 7724).

TABLE 103

Genes showing improved plant performance and growth rate under standard growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LAB609 | 65708.2 | — | — | — | 9.3 | 0.02 | 23 | 0.5 | 0.30 | 9 |
| LAB609 | 65710.2 | — | — | — | — | — | — | 0.5 | 0.26 | 11 |
| LAB609 | 65711.1 | — | — | — | 9.6 | L | 28 | 0.5 | 0.06 | 17 |
| LAB609 | 65711.2 | — | — | — | 9.9 | L | 32 | 0.5 | 0.09 | 16 |
| LAB605 | 65978.1 | — | — | — | 9.4 | 0.02 | 25 | 0.5 | 0.11 | 14 |
| LAB605 | 65980.3 | — | — | — | 9.4 | 0.02 | 25 | 0.5 | 0.11 | 14 |
| LAB605 | 65982.2 | — | — | — | 9.7 | 0.02 | 29 | 0.5 | 0.16 | 14 |
| LAB585 | 65396.1 | — | — | — | 9.7 | L | 29 | — | — | — |
| LAB585 | 65399.1 | — | — | — | 9.0 | 0.05 | 20 | — | — | — |
| LAB585 | 65400.1 | — | — | — | 9.8 | L | 31 | — | — | — |
| LAB573 | 65572.3 | — | — | — | 9.4 | 0.02 | 26 | 0.5 | 0.18 | 12 |
| LAB573 | 65573.2 | — | — | — | 8.9 | 0.11 | 19 | 0.5 | 0.17 | 12 |
| LAB570 | 65557.3 | — | — | — | 8.8 | 0.09 | 17 | 0.5 | 0.25 | 10 |
| LAB568 | 65620.1 | — | — | — | 8.4 | 0.26 | 12 | 0.5 | 0.26 | 10 |
| LAB534 | 65879.4 | — | — | — | 8.6 | 0.19 | 15 | — | — | — |
| LAB510 | 65991.1 | — | — | — | 9.9 | L | 32 | 0.5 | 0.04 | 17 |
| LAB510 | 65991.2 | — | — | — | 9.6 | L | 28 | 0.5 | 0.15 | 12 |
| LAB510 | 65992.4 | — | — | — | 8.4 | 0.23 | 12 | — | — | — |
| LAB504 | 66016.2 | — | — | — | 8.4 | 0.24 | 13 | — | — | — |
| LAB468 | 65837.1 | 0.8 | 0.26 | 13 | — | — | — | — | — | — |
| LAB460 | 65645.2 | — | — | — | 8.6 | 0.14 | 15 | — | — | — |
| LAB460 | 65647.2 | — | — | — | 9.1 | 0.04 | 22 | 0.5 | 0.08 | 15 |
| LAB460 | 65647.4 | — | — | — | 9.7 | 0.01 | 29 | 0.5 | 0.02 | 22 |
| LAB458 | 65804.3 | — | — | — | — | — | — | 0.5 | 0.19 | 11 |
| LAB458 | 65805.4 | — | — | — | 9.9 | L | 32 | 0.5 | 0.11 | 14 |

TABLE 103-continued

Genes showing improved plant performance and growth rate under standard growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LAB458 | 65807.3 | 0.8 | 0.19 | 15 | — | — | — | — | — | — |
| LAB455 | 66008.3 | 0.9 | 0.17 | 20 | 8.5 | 0.21 | 13 | 0.5 | 0.18 | 12 |
| LAB455 | 66011.1 | — | — | — | 9.2 | 0.02 | 23 | 0.5 | 0.12 | 13 |
| LAB455 | 66011.3 | — | — | — | 8.7 | 0.14 | 15 | — | — | — |
| LAB440 | 65954.1 | — | — | — | 8.9 | 0.14 | 19 | 0.5 | 0.25 | 11 |
| LAB440 | 65956.1 | — | — | — | 8.9 | 0.08 | 18 | — | — | — |
| LAB440 | 65957.4 | — | — | — | 10.2 | L | 36 | 0.5 | 0.12 | 13 |
| LAB426 | 65636.1 | — | — | — | 10.4 | L | 38 | 0.5 | 0.11 | 17 |
| LAB426 | 65640.4 | — | — | — | 9.1 | 0.04 | 21 | — | — | — |
| LAB410 | 65402.4 | — | — | — | 9.0 | 0.07 | 20 | — | — | — |
| LAB410 | 65405.4 | — | — | — | 8.4 | 0.29 | 11 | — | — | — |
| LAB410 | 65406.2 | — | — | — | 9.9 | L | 32 | 0.5 | 0.10 | 14 |
| LAB406 | 65517.3 | — | — | — | 8.5 | 0.18 | 13 | — | — | — |
| LAB406 | 65519.4 | — | — | — | 9.0 | 0.16 | 19 | — | — | — |
| CONT. | — | 0.7 | — | — | 7.5 | — | — | 0.4 | — | — |
| LAB589 | 65918.5 | 0.8 | 0.07 | 21 | 9.9 | 0.21 | 16 | — | — | — |
| LAB589 | 65919.2 | 0.8 | 0.27 | 12 | — | — | — | — | — | — |
| LAB589 | 65919.4 | — | — | — | 10.1 | 0.15 | 18 | — | — | — |
| LAB589 | 65921.3 | — | — | — | 10.7 | 0.06 | 26 | 0.5 | 0.07 | 14 |
| LAB571 | 65567.2 | 0.8 | 0.18 | 16 | — | — | — | — | — | — |
| LAB571 | 65568.1 | 0.8 | 0.08 | 19 | — | — | — | — | — | — |
| LAB571 | 65568.2 | — | — | — | 10.5 | 0.08 | 23 | 0.5 | 0.08 | 13 |
| LAB554 | 66237.5 | 0.8 | 0.20 | 14 | — | — | — | — | — | — |
| LAB550 | 65900.1 | — | — | — | 10.2 | 0.09 | 19 | 0.5 | 0.16 | 8 |
| LAB550 | 65902.4 | — | — | — | — | — | — | 0.5 | 0.23 | 7 |
| LAB547 | 65825.1 | 0.8 | 0.18 | 14 | — | — | — | — | — | — |
| LAB530 | 66262.3 | 0.8 | 0.07 | 20 | — | — | — | — | — | — |
| LAB530 | 66264.2 | — | — | — | 10.7 | 0.04 | 25 | 0.5 | 0.05 | 11 |
| LAB502 | 65976.6 | — | — | — | 10.2 | 0.13 | 19 | — | — | — |
| LAB496 | 65962.3 | — | — | — | 10.7 | 0.03 | 26 | 0.5 | 0.09 | 11 |
| LAB484 | 65846.3 | — | — | — | 9.9 | 0.20 | 17 | 0.5 | 0.27 | 8 |
| LAB484 | 65847.2 | 0.8 | 0.27 | 12 | 10.2 | 0.09 | 19 | 0.5 | 0.17 | 8 |
| LAB484 | 65848.3 | 0.8 | 0.23 | 12 | — | — | — | — | — | — |
| LAB483 | 65841.3 | — | — | — | 10.1 | 0.12 | 18 | 0.5 | 0.08 | 10 |
| LAB483 | 65843.2 | — | — | — | 11.0 | 0.02 | 29 | — | — | — |
| LAB483 | 65844.2 | 0.8 | 0.26 | 12 | 9.9 | 0.17 | 16 | 0.5 | 0.08 | 10 |
| LAB456 | 66186.3 | 0.8 | 0.23 | 13 | — | — | — | — | — | — |
| LAB453 | 66177.1 | 0.8 | 0.24 | 12 | — | — | — | — | — | — |
| LAB453 | 66177.2 | 0.8 | 0.19 | 15 | — | — | — | — | — | — |
| LAB452 | 66171.3 | — | — | — | 9.7 | 0.25 | 13 | — | — | — |
| LAB432 | 66002.5 | 0.8 | 0.13 | 16 | — | — | — | — | — | — |
| LAB432 | 66003.3 | — | — | — | 9.7 | 0.22 | 14 | 0.5 | 0.15 | 8 |
| LAB432 | 66004.4 | — | — | — | — | — | — | 0.5 | 0.23 | 7 |
| LAB430 | 66206.2 | 0.8 | 0.24 | 12 | — | — | — | — | — | — |
| LAB430 | 66207.3 | — | — | — | 9.6 | 0.28 | 13 | 0.5 | 0.20 | 8 |
| CONT. | — | 0.7 | — | — | 8.5 | — | — | 0.4 | — | — |
| LAB610 | 65343.2 | — | — | — | — | — | — | 0.4 | 0.27 | 9 |
| LAB610 | 65343.5 | 0.8 | 0.05 | 20 | — | — | — | — | — | — |
| LAB595 | 65270.3 | 0.8 | 0.01 | 27 | — | — | — | — | — | — |
| LAB595 | 65273.2 | 0.8 | 0.07 | 21 | 8.5 | 0.24 | 19 | — | — | — |
| LAB578 | 65581.3 | 0.7 | 0.28 | 12 | — | — | — | — | — | — |
| LAB578 | 65582.3 | — | — | — | 8.3 | 0.25 | 16 | — | — | — |
| LAB578 | 65582.6 | 0.8 | 0.03 | 23 | — | — | — | — | — | — |
| LAB577 | 65575.2 | — | — | — | — | — | — | 0.4 | 0.27 | 9 |
| LAB577 | 65577.4 | 0.8 | 0.10 | 19 | 8.9 | 0.08 | 25 | 0.4 | 0.13 | 13 |
| LAB577 | 65579.2 | 0.8 | 0.08 | 19 | 9.1 | 0.09 | 28 | 0.4 | 0.30 | 11 |
| LAB576 | 65329.2 | 0.8 | 0.05 | 21 | — | — | — | — | — | — |
| LAB576 | 65332.2 | — | — | — | 8.7 | 0.12 | 22 | — | — | — |
| LAB576 | 65332.3 | 0.8 | 0.03 | 24 | — | — | — | 0.4 | 0.29 | 9 |
| LAB562 | 65611.1 | — | — | — | 8.2 | 0.25 | 16 | — | — | — |
| LAB562 | 65612.2 | 0.9 | L | 32 | — | — | — | — | — | — |
| LAB562 | 65613.2 | 0.7 | 0.26 | 13 | — | — | — | — | — | — |
| LAB562 | 65614.4 | 0.8 | 0.02 | 28 | — | — | — | — | — | — |
| LAB546 | 65155.2 | 0.7 | 0.20 | 13 | 8.4 | 0.17 | 18 | — | — | — |
| LAB546 | 65156.2 | — | — | — | — | — | — | 0.4 | 0.14 | 13 |
| LAB546 | 65157.4 | 0.7 | 0.16 | 16 | — | — | — | 0.4 | 0.18 | 11 |
| LAB524 | 65135.2 | — | — | — | — | — | — | 0.4 | 0.30 | 9 |
| LAB524 | 65136.4 | 0.7 | 0.18 | 15 | — | — | — | — | — | — |
| LAB513 | 65125.1 | 0.8 | 0.14 | 17 | — | — | — | 0.4 | 0.26 | 9 |
| LAB506 | 65115.3 | 0.7 | 0.15 | 15 | — | — | — | — | — | — |
| LAB506 | 65115.4 | — | — | — | 9.0 | 0.09 | 26 | — | — | — |

TABLE 103-continued

Genes showing improved plant performance and growth rate under standard growth conditions

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LAB505 | 65105.1 | — | — | — | 8.9 | 0.08 | 24 | 0.5 | 0.13 | 13 |
| LAB505 | 65108.3 | 0.8 | 0.03 | 23 | — | — | — | — | — | — |
| LAB505 | 65109.2 | 0.7 | 0.24 | 13 | — | — | — | — | — | — |
| LAB505 | 65110.2 | — | — | — | 9.3 | 0.04 | 30 | 0.5 | 0.07 | 15 |
| LAB457 | 65100.1 | — | — | — | 8.4 | 0.19 | 18 | 0.4 | 0.21 | 11 |
| LAB450 | 65306.1 | 0.7 | 0.30 | 11 | 9.0 | 0.08 | 26 | 0.4 | 0.15 | 12 |
| LAB450 | 65309.1 | 0.8 | 0.10 | 19 | — | — | — | — | — | — |
| LAB449 | 65098.4 | — | — | — | 8.2 | 0.29 | 14 | — | — | — |
| LAB446 | 65091.2 | — | — | — | 8.4 | 0.19 | 18 | — | — | — |
| LAB446 | 65093.2 | — | — | — | 8.2 | 0.29 | 14 | — | — | — |
| LAB444 | 65085.4 | 0.8 | 0.05 | 22 | — | — | — | 0.4 | 0.22 | 10 |
| LAB444 | 65086.1 | 0.8 | 0.07 | 20 | 8.5 | 0.16 | 19 | 0.4 | 0.13 | 13 |
| LAB444 | 65086.2 | 0.7 | 0.17 | 15 | — | — | — | 0.4 | 0.21 | 11 |
| LAB444 | 65088.5 | 0.7 | 0.22 | 14 | — | — | — | — | — | — |
| LAB428 | 65082.2 | — | — | — | 8.3 | 0.25 | 16 | 0.5 | 0.03 | 19 |
| LAB423 | 65527.3 | — | — | — | 9.2 | 0.05 | 29 | 0.5 | 0.07 | 16 |
| LAB423 | 65528.2 | 0.8 | 0.04 | 23 | — | — | — | — | — | — |
| LAB423 | 65528.3 | 0.7 | 0.29 | 13 | 8.2 | 0.29 | 14 | — | — | — |
| CONT. | — | 0.6 | — | — | 7.1 | — | — | 0.4 | — | — |
| LAB572 | 66117.2 | — | — | — | 7.8 | 0.29 | 15 | — | — | — |
| LAB569 | 65257.4 | — | — | — | 7.8 | 0.20 | 14 | — | — | — |
| LAB567 | 66072.4 | 0.8 | 0.28 | 19 | 8.4 | 0.09 | 23 | — | — | — |
| LAB555 | 65607.2 | 0.7 | 0.25 | 18 | 7.7 | 0.21 | 14 | 0.4 | 0.02 | 11 |
| LAB548 | 65703.2 | — | — | — | — | — | — | 0.4 | 0.08 | 8 |
| LAB548 | 65703.4 | — | — | — | 8.9 | 0.02 | 32 | 0.5 | L | 16 |
| LAB545 | 65698.1 | 0.8 | 0.12 | 25 | — | — | — | 0.4 | 0.29 | 5 |
| LAB541 | 65412.8 | — | — | — | 8.6 | 0.04 | 26 | 0.4 | 0.05 | 10 |
| LAB526 | 65668.2 | — | — | — | 8.1 | 0.10 | 20 | 0.5 | L | 15 |
| LAB526 | 65669.4 | 0.7 | 0.27 | 16 | 8.1 | 0.10 | 20 | — | — | — |
| LAB518 | 66023.1 | — | — | — | 10.5 | L | 55 | 0.5 | L | 28 |
| LAB518 | 66023.3 | 0.8 | 0.09 | 26 | 8.8 | 0.02 | 30 | 0.5 | L | 15 |
| LAB498 | 66039.1 | — | — | — | — | — | — | 0.4 | 0.29 | 5 |
| LAB467 | 66130.1 | — | — | — | 8.0 | 0.10 | 18 | — | — | — |
| LAB467 | 66130.2 | — | — | — | 8.4 | 0.06 | 24 | 0.4 | 0.04 | 10 |
| LAB443 | 65552.2 | 0.8 | 0.17 | 23 | — | — | — | 0.4 | 0.19 | 9 |
| LAB439 | 65950.1 | — | — | — | — | — | — | 0.4 | 0.26 | 5 |
| LAB439 | 65950.2 | — | — | — | — | — | — | 0.4 | 0.28 | 5 |
| LAB405 | 66122.1 | — | — | — | 7.8 | 0.19 | 15 | — | — | — |
| LAB405 | 66124.4 | — | — | — | — | — | — | 0.4 | 0.06 | 10 |
| LAB396 | 65924.1 | — | — | — | 10.9 | L | 60 | 0.5 | L | 22 |
| LAB396 | 65925.4 | — | — | — | 9.5 | L | 40 | 0.5 | L | 17 |
| LAB396 | 65926.1 | — | — | — | 7.7 | 0.23 | 14 | 0.4 | 0.24 | 5 |
| CONT. | — | 0.6 | — | — | 6.8 | — | — | 0.4 | — | — |

Table 103.
"CONT."—Control;
"Ave."— Average;
"% Incr." = % increment;
"p-val."—p-value;
"L" means that p-value is less than 0.01.
The transgenes were under the transcriptional regulation of the new At6669 promoter (SEQ ID NO: 7724).

TABLE 104

Genes showing improved plant performance under standard growth conditions

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB609 | 65708.2 | — | — | — | 8.2 | L | 24 | 5.0 | L | 12 |
| LAB609 | 65711.1 | — | — | — | 8.4 | 0.06 | 26 | 5.0 | 0.05 | 12 |
| LAB609 | 65711.2 | — | — | — | 8.6 | 0.13 | 29 | 5.0 | L | 13 |
| LAB605 | 65978.1 | — | — | — | 8.2 | 0.14 | 23 | 5.0 | 0.01 | 13 |
| LAB605 | 65980.3 | — | — | — | 8.1 | 0.03 | 22 | 5.0 | L | 12 |
| LAB605 | 65982.2 | — | — | — | 8.5 | 0.30 | 28 | — | — | — |
| LAB585 | 65396.1 | — | — | — | 8.6 | L | 30 | 5.0 | L | 12 |
| LAB585 | 65399.1 | — | — | — | 7.8 | 0.01 | 17 | — | — | — |

TABLE 104-continued

Genes showing improved plant performance under standard growth conditions

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB585 | 65400.1 | — | — | — | 8.5 | 0.06 | 27 | 4.9 | 0.13 | 10 |
| LAB573 | 65572.1 | — | — | — | 7.3 | 0.21 | 9 | 4.7 | 0.14 | 5 |
| LAB573 | 65572.3 | — | — | — | 8.2 | L | 24 | 5.0 | 0.04 | 11 |
| LAB570 | 65557.1 | — | — | — | 7.0 | 0.25 | 5 | 4.6 | 0.19 | 3 |
| LAB570 | 65557.3 | — | — | — | 7.6 | 0.04 | 15 | 4.8 | 0.05 | 8 |
| LAB568 | 65617.3 | 0.5 | 0.29 | 8 | — | — | — | — | — | — |
| LAB568 | 65620.1 | — | — | — | — | — | — | 4.7 | 0.07 | 7 |
| LAB568 | 65620.4 | — | — | — | — | — | — | 4.6 | 0.12 | 4 |
| LAB534 | 65876.2 | — | — | — | 7.2 | 0.27 | 8 | 4.7 | 0.14 | 5 |
| LAB534 | 65877.2 | — | — | — | — | — | — | 4.6 | 0.15 | 4 |
| LAB534 | 65878.3 | — | — | — | — | — | — | 4.6 | 0.23 | 3 |
| LAB510 | 65991.1 | — | — | — | 8.6 | L | 30 | 5.0 | L | 13 |
| LAB510 | 65991.2 | — | — | — | 8.4 | L | 27 | 4.9 | L | 11 |
| LAB510 | 65992.4 | 0.5 | 0.14 | 6 | 7.5 | 0.13 | 13 | 4.8 | 0.02 | 7 |
| LAB504 | 66016.2 | — | — | — | — | — | — | 4.8 | 0.29 | 7 |
| LAB460 | 65645.2 | — | — | — | 7.6 | 0.02 | 14 | 4.7 | 0.29 | 6 |
| LAB460 | 65647.2 | — | — | — | 7.9 | 0.03 | 19 | 4.8 | 0.17 | 9 |
| LAB460 | 65647.4 | — | — | — | 8.5 | 0.18 | 28 | 5.2 | 0.05 | 18 |
| LAB458 | 65804.3 | — | — | — | — | — | — | 4.8 | 0.03 | 8 |
| LAB458 | 65805.1 | 0.5 | 0.19 | 8 | — | — | — | — | — | — |
| LAB458 | 65805.4 | — | — | — | 8.7 | L | 30 | 5.1 | L | 15 |
| LAB455 | 66008.3 | — | — | — | — | — | — | 4.8 | 0.15 | 8 |
| LAB455 | 66011.1 | — | — | — | 7.9 | L | 19 | 4.9 | L | 11 |
| LAB440 | 65954.1 | — | — | — | — | — | — | 4.9 | 0.30 | 10 |
| LAB440 | 65955.1 | — | — | — | 7.2 | 0.26 | 7 | — | — | — |
| LAB440 | 65956.1 | — | — | — | 7.8 | 0.24 | 18 | 4.8 | 0.27 | 8 |
| LAB440 | 65957.2 | — | — | — | 7.1 | 0.21 | 7 | 4.8 | 0.02 | 8 |
| LAB440 | 65957.4 | — | — | — | 8.9 | 0.02 | 33 | 5.1 | L | 14 |
| LAB426 | 65636.1 | — | — | — | 9.0 | 0.27 | 35 | — | — | — |
| LAB426 | 65640.4 | — | — | — | 8.0 | L | 20 | 4.8 | L | 9 |
| LAB410 | 65402.1 | — | — | — | 7.2 | 0.15 | 9 | 4.7 | 0.08 | 5 |
| LAB410 | 65402.4 | — | — | — | 7.9 | 0.24 | 18 | 4.8 | 0.19 | 8 |
| LAB410 | 65405.4 | — | — | — | — | — | — | 4.7 | 0.27 | 5 |
| LAB410 | 65406.2 | — | — | — | 8.7 | L | 31 | 5.0 | L | 13 |
| LAB406 | 65517.3 | — | — | — | 7.6 | 0.08 | 14 | 4.7 | 0.04 | 7 |
| CONT. | — | 0.4 | — | — | 6.7 | — | — | 4.4 | — | — |
| LAB589 | 65918.5 | 0.5 | 0.26 | 9 | — | — | — | — | — | — |
| LAB589 | 65919.2 | 0.5 | 0.05 | 23 | — | — | — | — | — | — |
| LAB589 | 65919.4 | 0.5 | 0.16 | 9 | — | — | — | 5.2 | 0.26 | 10 |
| LAB589 | 65921.2 | 0.5 | 0.14 | 11 | — | — | — | — | — | — |
| LAB571 | 65564.4 | — | — | — | — | — | — | 4.9 | 0.05 | 4 |
| LAB571 | 65567.2 | 0.5 | 0.12 | 10 | — | — | — | — | — | — |
| LAB571 | 65568.1 | 0.5 | 0.27 | 15 | — | — | — | — | — | — |
| LAB571 | 65568.2 | — | — | — | — | — | — | 5.4 | 0.27 | 14 |
| LAB554 | 66236.3 | 0.5 | 0.26 | 22 | 9.1 | L | 9 | 5.0 | L | 7 |
| LAB550 | 65900.1 | — | — | — | 10.0 | 0.14 | 20 | 5.3 | 0.11 | 12 |
| LAB550 | 65902.4 | 0.5 | 0.10 | 11 | — | — | — | — | — | — |
| LAB550 | 65903.2 | — | — | — | — | — | — | 5.0 | 0.25 | 5 |
| LAB547 | 65822.1 | — | — | — | 9.0 | 0.02 | 8 | — | — | — |
| LAB547 | 65824.2 | 0.4 | 0.30 | 7 | — | — | — | — | — | — |
| LAB530 | 66261.4 | 0.5 | 0.02 | 24 | — | — | — | — | — | — |
| LAB530 | 66262.3 | 0.5 | 0.26 | 13 | — | — | — | — | — | — |
| LAB530 | 66262.5 | 0.5 | 0.06 | 26 | — | — | — | — | — | — |
| LAB530 | 66264.2 | — | — | — | 10.5 | 0.22 | 26 | 5.4 | 0.21 | 14 |
| LAB529 | 65389.1 | 0.5 | 0.07 | 12 | — | — | — | 4.9 | 0.27 | 4 |
| LAB529 | 65391.3 | — | — | — | — | — | — | 5.0 | 0.15 | 5 |
| LAB529 | 65392.2 | 0.5 | 0.16 | 14 | — | — | — | — | — | — |
| LAB529 | 65393.3 | 0.5 | 0.26 | 17 | — | — | — | — | — | — |
| LAB503 | 66213.5 | 0.5 | 0.07 | 14 | — | — | — | — | — | — |
| LAB503 | 66216.1 | 0.5 | 0.04 | 24 | — | — | — | — | — | — |
| LAB502 | 65972.2 | — | — | — | 9.1 | 0.01 | 9 | 5.0 | 0.21 | 5 |
| LAB502 | 65974.1 | 0.4 | 0.30 | 7 | — | — | — | — | — | — |
| LAB502 | 65975.1 | 0.5 | 0.26 | 23 | — | — | — | — | — | — |
| LAB502 | 65976.6 | — | — | — | — | — | — | 5.2 | 0.26 | 10 |
| LAB496 | 65962.3 | — | — | — | 10.6 | 0.18 | 27 | 5.4 | 0.15 | 14 |
| LAB496 | 65964.3 | 0.5 | 0.02 | 20 | — | — | — | — | — | — |
| LAB484 | 65847.2 | 0.5 | 0.21 | 15 | 10.1 | 0.02 | 21 | 5.2 | 0.03 | 11 |
| LAB483 | 65840.3 | 0.5 | 0.18 | 9 | — | — | — | — | — | — |
| LAB483 | 65841.2 | — | — | — | 9.4 | 0.04 | 12 | 5.0 | 0.28 | 7 |
| LAB483 | 65841.3 | — | — | — | 9.9 | L | 18 | 5.2 | L | 11 |
| LAB483 | 65843.2 | — | — | — | 11.0 | 0.10 | 32 | 5.4 | 0.10 | 14 |
| LAB483 | 65844.2 | — | — | — | 9.8 | 0.02 | 17 | 5.2 | L | 11 |
| LAB456 | 66182.2 | 0.5 | 0.06 | 13 | — | — | — | — | — | — |

TABLE 104-continued

Genes showing improved plant performance under standard growth conditions

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB453 | 66176.4 | 0.5 | 0.08 | 12 | — | — | — | — | — | — |
| LAB453 | 66177.2 | 0.5 | 0.21 | 15 | — | — | — | — | — | — |
| LAB453 | 66178.4 | 0.5 | 0.07 | 15 | — | — | — | — | — | — |
| LAB452 | 66171.2 | 0.5 | 0.03 | 16 | — | — | — | 5.0 | 0.25 | 7 |
| LAB452 | 66171.3 | 0.5 | 0.18 | 13 | 9.6 | 0.23 | 16 | 5.1 | 0.17 | 9 |
| LAB452 | 66172.4 | 0.5 | 0.13 | 21 | — | — | — | 4.8 | 0.27 | 2 |
| LAB452 | 66172.7 | 0.5 | 0.20 | 13 | — | — | — | — | — | — |
| LAB452 | 66173.3 | 0.5 | 0.05 | 17 | — | — | — | — | — | — |
| LAB432 | 66003.3 | — | — | — | 9.5 | 0.05 | 14 | 5.1 | 0.03 | 9 |
| LAB432 | 66003.4 | 0.5 | 0.07 | 15 | — | — | — | — | — | — |
| LAB432 | 66004.4 | 0.5 | 0.17 | 13 | 9.3 | L | 12 | 5.0 | L | 7 |
| LAB432 | 66004.5 | 0.5 | 0.03 | 22 | 8.6 | 0.22 | 3 | 4.9 | 0.05 | 3 |
| LAB430 | 66206.2 | — | — | — | 9.2 | L | 11 | 4.9 | L | 4 |
| LAB430 | 66207.3 | — | — | — | — | — | — | 5.1 | 0.17 | 9 |
| LAB430 | 66207.4 | — | — | — | 9.1 | 0.25 | 9 | 4.9 | 0.02 | 4 |
| LAB430 | 66209.4 | 0.5 | 0.13 | 12 | — | — | — | — | — | — |
| LAB430 | 66210.2 | 0.5 | 0.27 | 15 | — | — | — | — | — | — |
| LAB399 | 65503.1 | 0.5 | 0.12 | 22 | 9.4 | L | 13 | 5.1 | L | 9 |
| LAB399 | 65506.1 | — | — | — | — | — | — | 4.8 | 0.30 | 2 |
| LAB399 | 65507.1 | 0.5 | 0.07 | 13 | — | — | — | — | — | — |
| CONT. | — | 0.4 | — | — | 8.3 | — | — | 4.7 | — | — |
| LAB610 | 65342.5 | 0.3 | 0.16 | 6 | — | — | — | — | — | — |
| LAB595 | 65269.5 | 0.4 | 0.18 | 9 | — | — | — | — | — | — |
| LAB578 | 65582.3 | — | — | — | 8.4 | 0.23 | 12 | — | — | — |
| LAB577 | 65575.2 | — | — | — | 8.3 | 0.14 | 11 | 4.8 | 0.22 | 5 |
| LAB577 | 65577.3 | — | — | — | 8.1 | 0.27 | 8 | — | — | — |
| LAB577 | 65577.4 | — | — | — | 9.0 | 0.07 | 20 | 4.9 | 0.10 | 8 |
| LAB576 | 65332.2 | 0.3 | 0.20 | 5 | 9.1 | 0.13 | 21 | 4.9 | 0.25 | 8 |
| LAB562 | 65611.1 | — | — | — | 8.4 | 0.21 | 12 | — | — | — |
| LAB546 | 65155.2 | — | — | — | 8.6 | 0.11 | 15 | — | — | — |
| LAB546 | 65156.2 | — | — | — | — | — | — | 4.8 | 0.24 | 6 |
| LAB524 | 65135.2 | — | — | — | 8.3 | 0.15 | 11 | — | — | — |
| LAB513 | 65124.5 | 0.4 | 0.10 | 11 | — | — | — | — | — | — |
| LAB513 | 65125.1 | — | — | — | — | — | — | 4.8 | 0.25 | 5 |
| LAB505 | 65105.1 | — | — | — | 8.9 | 0.08 | 19 | 5.0 | 0.12 | 10 |
| LAB505 | 65110.2 | — | — | — | 9.5 | L | 27 | 5.3 | L | 16 |
| LAB457 | 65100.1 | — | — | — | 8.7 | 0.04 | 16 | 4.9 | 0.25 | 7 |
| LAB457 | 65100.2 | 0.3 | 0.09 | 8 | — | — | — | — | — | — |
| LAB457 | 65102.2 | 0.3 | 0.13 | 8 | — | — | — | — | — | — |
| LAB450 | 65306.1 | — | — | — | 9.2 | 0.09 | 23 | 5.0 | 0.06 | 8 |
| LAB449 | 65098.4 | — | — | — | 8.4 | 0.17 | 12 | 4.8 | 0.29 | 6 |
| LAB446 | 65091.2 | — | — | — | 8.6 | 0.10 | 15 | — | — | — |
| LAB446 | 65093.2 | — | — | — | 8.4 | 0.21 | 12 | — | — | — |
| LAB444 | 65085.4 | — | — | — | 8.1 | 0.19 | 8 | 4.8 | 0.23 | 5 |
| LAB444 | 65086.1 | — | — | — | 8.6 | 0.10 | 15 | 4.9 | 0.10 | 7 |
| LAB428 | 65079.3 | — | — | — | 8.1 | 0.24 | 9 | 4.8 | 0.14 | 6 |
| LAB428 | 65082.2 | — | — | — | 8.3 | 0.25 | 11 | 5.0 | 0.05 | 10 |
| LAB423 | 65527.3 | — | — | — | 9.3 | 0.21 | 24 | 5.1 | 0.13 | 12 |
| LAB423 | 65528.3 | 0.4 | 0.14 | 13 | — | — | — | — | — | — |
| CONT. | — | 0.3 | — | — | 7.5 | — | — | 4.6 | — | — |
| LAB569 | 65257.4 | — | — | — | 7.8 | 0.13 | 13 | — | — | — |
| LAB569 | 65260.7 | 0.5 | 0.06 | 20 | — | — | — | — | — | — |
| LAB566 | 66140.3 | 0.5 | 0.11 | 14 | — | — | — | — | — | — |
| LAB566 | 66142.1 | 0.5 | 0.29 | 7 | — | — | — | — | — | — |
| LAB566 | 66142.5 | 0.5 | 0.11 | 11 | — | — | — | — | — | — |
| LAB566 | 66143.1 | 0.5 | 0.26 | 12 | — | — | — | — | — | — |
| LAB555 | 65607.2 | — | — | — | 7.5 | 0.04 | 9 | — | — | — |
| LAB548 | 65702.3 | 0.5 | 0.30 | 11 | — | — | — | — | — | — |
| LAB548 | 65703.2 | — | — | — | 7.3 | 0.23 | 6 | — | — | — |
| LAB548 | 65703.4 | — | — | — | 9.0 | 0.20 | 30 | 5.1 | 0.23 | 12 |
| LAB548 | 65704.1 | 0.5 | 0.26 | 7 | — | — | — | — | — | — |
| LAB545 | 65700.2 | 0.5 | 0.30 | 14 | — | — | — | — | — | — |
| LAB541 | 65412.8 | — | — | — | — | — | — | 5.0 | 0.29 | 10 |
| LAB526 | 65667.3 | — | — | — | 7.7 | 0.24 | 11 | — | — | — |
| LAB526 | 65668.2 | — | — | — | — | — | — | 5.0 | 0.28 | 9 |
| LAB526 | 65669.4 | — | — | — | 8.3 | 0.25 | 21 | — | — | — |
| LAB518 | 66023.1 | — | — | — | 10.4 | L | 51 | 5.4 | L | 19 |
| LAB518 | 66023.3 | — | — | — | 8.8 | 0.28 | 27 | 5.1 | 0.26 | 12 |
| LAB498 | 66041.1 | — | — | — | 7.4 | 0.11 | 7 | 4.6 | 0.29 | 2 |
| LAB467 | 66130.1 | — | — | — | 8.3 | 0.03 | 20 | 4.8 | 0.18 | 6 |
| LAB467 | 66130.2 | — | — | — | 8.3 | 0.24 | 20 | — | — | — |
| LAB467 | 66131.4 | — | — | — | — | — | — | 4.7 | 0.17 | 2 |
| LAB443 | 65556.1 | 0.5 | 0.18 | 9 | — | — | — | — | — | — |

TABLE 104-continued

Genes showing improved plant performance under standard growth conditions

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LAB439 | 65950.1 | — | — | — | 7.4 | 0.21 | 7 | 4.8 | 0.02 | 5 |
| LAB439 | 65952.1 | — | — | — | — | — | — | 4.6 | 0.30 | 2 |
| LAB405 | 66122.1 | 0.5 | 0.14 | 10 | — | — | — | — | — | — |
| LAB396 | 65924.1 | — | — | — | 10.8 | 0.11 | 57 | 5.5 | 0.09 | 21 |
| LAB396 | 65925.4 | — | — | — | 9.5 | 0.07 | 38 | 5.3 | 0.07 | 16 |
| LAB396 | 65926.1 | — | — | — | — | — | — | 4.9 | 0.23 | 7 |
| CONT. | — | 0.4 | — | — | 6.9 | — | — | 4.6 | — | — |

Table 104.
"CONT."—Control;
"Ave."— Average;
"% Incr." = % increment;
"p-val."—p-value;
"L" means that p-value is less than 0.01.
The transgenes were under the transcriptional regulation of the new At6669 promoter (SEQ ID NO: 7724).

TABLE 105

Genes showing improved plant performance under standard growth conditions

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LAB609 | 65709.3 | — | — | — | 18.1 | 0.13 | 8 |
| LAB609 | 65710.2 | — | — | — | 18.0 | 0.25 | 8 |
| LAB609 | 65711.1 | — | — | — | 19.3 | 0.15 | 15 |
| LAB605 | 65978.1 | — | — | — | 17.7 | 0.01 | 5 |
| LAB573 | 65571.2 | — | — | — | 18.6 | 0.24 | 11 |
| LAB573 | 65572.1 | — | — | — | 17.8 | L | 6 |
| LAB573 | 65572.3 | — | — | — | 17.7 | 0.01 | 6 |
| LAB573 | 65573.2 | — | — | — | 18.1 | 0.07 | 8 |
| LAB573 | 65573.5 | — | — | — | 17.5 | 0.06 | 4 |
| LAB570 | 65557.1 | — | — | — | 18.1 | 0.14 | 8 |
| LAB570 | 65557.3 | 343.3 | 0.14 | 6 | 18.2 | L | 9 |
| LAB570 | 65558.2 | — | — | — | 20.9 | 0.22 | 25 |
| LAB568 | 65617.3 | 358.2 | 0.03 | 11 | — | — | — |
| LAB568 | 65619.2 | 362.2 | 0.07 | 12 | 17.7 | 0.02 | 5 |
| LAB568 | 65620.4 | — | — | — | 17.1 | 0.29 | 2 |
| LAB540 | 65883.1 | 349.2 | 0.14 | 8 | 18.5 | 0.04 | 10 |
| LAB540 | 65884.7 | 343.8 | 0.13 | 7 | 17.7 | 0.02 | 5 |
| LAB540 | 65884.8 | — | — | — | 22.7 | 0.06 | 36 |
| LAB534 | 65876.2 | 344.4 | 0.12 | 7 | 18.9 | L | 12 |
| LAB534 | 65877.3 | — | — | — | 17.8 | 0.15 | 6 |
| LAB534 | 65878.3 | — | — | — | 18.0 | 0.08 | 7 |
| LAB534 | 65879.4 | — | — | — | 17.2 | 0.13 | 3 |
| LAB510 | 65991.1 | — | — | — | 18.0 | 0.08 | 7 |
| LAB510 | 65991.2 | — | — | — | 19.5 | 0.23 | 16 |
| LAB510 | 65992.4 | 338.1 | 0.27 | 5 | 17.6 | 0.06 | 5 |
| LAB510 | 65993.1 | — | — | — | 23.8 | L | 42 |
| LAB504 | 66014.6 | 351.7 | 0.18 | 9 | 22.3 | 0.12 | 33 |
| LAB504 | 66018.1 | 347.1 | 0.09 | 8 | 18.3 | 0.01 | 9 |
| LAB468 | 65837.1 | — | — | — | 18.5 | 0.06 | 11 |
| LAB468 | 65838.1 | 342.7 | 0.15 | 6 | — | — | — |
| LAB468 | 65838.2 | 364.3 | 0.09 | 13 | 20.2 | 0.13 | 20 |
| LAB460 | 65644.3 | — | — | — | 17.6 | 0.13 | 5 |
| LAB460 | 65645.1 | — | — | — | 17.4 | 0.26 | 4 |
| LAB460 | 65645.2 | — | — | — | 17.8 | 0.23 | 6 |
| LAB460 | 65647.4 | — | — | — | 17.7 | 0.03 | 6 |
| LAB458 | 65804.3 | — | — | — | 18.3 | L | 9 |
| LAB458 | 65807.3 | — | — | — | 17.9 | L | 7 |
| LAB455 | 66008.3 | — | — | — | 18.0 | 0.16 | 7 |
| LAB455 | 66009.4 | — | — | — | 17.6 | 0.16 | 5 |
| LAB440 | 65954.1 | — | — | — | 19.1 | 0.15 | 14 |
| LAB440 | 65955.1 | — | — | — | 18.4 | 0.15 | 10 |
| LAB440 | 65956.1 | — | — | — | 20.8 | L | 24 |
| LAB426 | 65636.1 | — | — | — | 17.8 | 0.12 | 6 |
| LAB426 | 65637.2 | — | — | — | 18.3 | 0.26 | 9 |
| LAB426 | 65637.3 | 341.9 | 0.15 | 6 | 17.2 | 0.17 | 2 |
| LAB410 | 65401.2 | — | — | — | 17.2 | 0.21 | 3 |
| LAB410 | 65402.4 | — | — | — | 17.5 | 0.03 | 4 |

TABLE 105-continued

Genes showing improved plant performance under standard growth conditions

| Gene | | Seed Yield [mg] | | | 1000 Seed Weight [mg] | | |
|---|---|---|---|---|---|---|---|
| Name | Event # | Ave. | P-Val. | % Incr. | Ave. | P-Val. | % Incr. |
| LAB410 | 65405.4 | — | — | — | 17.7 | 0.02 | 5 |
| LAB406 | 65515.2 | — | — | — | 18.2 | L | 9 |
| LAB406 | 65516.2 | — | — | — | 18.0 | 0.16 | 7 |
| LAB406 | 65517.3 | — | — | — | 17.2 | 0.24 | 3 |
| CONT. | — | 322.5 | — | — | 16.8 | — | — |
| LAB589 | 65919.2 | 491.4 | 0.01 | 17 | — | — | — |
| LAB589 | 65919.4 | 469.6 | 0.11 | 12 | — | — | — |
| LAB589 | 65921.3 | 457.4 | 0.26 | 9 | — | — | — |
| LAB571 | 65567.2 | 458.8 | 0.23 | 9 | — | — | — |
| LAB554 | 66237.5 | 484.6 | 0.02 | 16 | 19.5 | 0.12 | 6 |
| LAB550 | 65902.2 | — | — | — | 19.9 | 0.06 | 8 |
| LAB550 | 65902.4 | 478.7 | 0.16 | 14 | — | — | — |
| LAB530 | 66261.4 | 484.8 | 0.02 | 16 | — | — | — |
| LAB530 | 66262.3 | — | — | — | 20.6 | 0.01 | 12 |
| LAB530 | 66262.5 | 480.2 | 0.22 | 14 | — | — | — |
| LAB529 | 65389.1 | 463.0 | 0.10 | 10 | 20.2 | 0.22 | 9 |
| LAB529 | 65392.2 | — | — | — | 19.3 | 0.22 | 4 |
| LAB503 | 66213.5 | 471.2 | 0.04 | 12 | — | — | — |
| LAB503 | 66216.1 | — | — | — | 21.1 | 0.05 | 14 |
| LAB502 | 65975.1 | 476.2 | 0.03 | 14 | 20.5 | 0.08 | 11 |
| LAB496 | 65964.3 | — | — | — | 20.2 | 0.20 | 9 |
| LAB484 | 65847.2 | 471.0 | 0.17 | 12 | — | — | — |
| LAB483 | 65843.2 | — | — | — | 22.7 | 0.12 | 23 |
| LAB483 | 65844.2 | — | — | — | 22.6 | 0.28 | 22 |
| LAB456 | 66182.2 | 457.0 | 0.22 | 9 | 20.9 | L | 13 |
| LAB456 | 66186.3 | — | — | — | 19.8 | 0.07 | 7 |
| LAB453 | 66177.2 | 451.6 | 0.18 | 8 | — | — | — |
| LAB453 | 66178.4 | 456.4 | 0.12 | 9 | — | — | — |
| LAB452 | 66171.2 | 487.9 | 0.02 | 16 | — | — | — |
| LAB452 | 66172.7 | — | — | — | 20.9 | 0.11 | 13 |
| LAB452 | 66173.3 | — | — | — | 20.3 | 0.15 | 10 |
| LAB432 | 66004.4 | 476.8 | 0.05 | 14 | — | — | — |
| LAB432 | 66004.5 | 489.9 | 0.22 | 17 | — | — | — |
| LAB430 | 66206.2 | — | — | — | 21.4 | 0.08 | 16 |
| LAB399 | 65503.1 | 507.7 | 0.05 | 21 | — | — | — |
| LAB399 | 65507.1 | 458.4 | 0.29 | 9 | — | — | — |
| CONT. | — | 419.5 | — | — | 18.5 | — | — |
| LAB610 | 65341.4 | — | — | — | 16.6 | 0.04 | 5 |
| LAB610 | 65342.3 | — | — | — | 19.5 | 0.13 | 23 |
| LAB610 | 65342.5 | 306.1 | 0.07 | 16 | 16.3 | 0.17 | 4 |
| LAB610 | 65343.5 | 311.9 | 0.10 | 19 | 16.2 | 0.14 | 3 |
| LAB595 | 65270.2 | — | — | — | 16.9 | 0.08 | 7 |
| LAB595 | 65273.2 | 296.5 | 0.24 | 13 | 18.1 | 0.10 | 15 |
| LAB578 | 65581.3 | 299.5 | 0.03 | 14 | — | — | — |
| LAB578 | 65582.3 | 306.2 | 0.01 | 16 | — | — | — |
| LAB577 | 65577.4 | 283.0 | 0.21 | 8 | — | — | — |
| LAB577 | 65579.2 | — | — | — | 16.4 | 0.05 | 4 |
| LAB576 | 65329.2 | — | — | — | 16.2 | 0.10 | 2 |
| LAB576 | 65330.2 | 318.8 | 0.20 | 21 | 16.7 | L | 6 |
| LAB576 | 65332.3 | — | — | — | 16.1 | 0.30 | 2 |
| LAB562 | 65611.1 | 282.7 | 0.15 | 8 | 16.7 | 0.08 | 6 |
| LAB562 | 65612.2 | 301.7 | 0.14 | 15 | 16.6 | 0.02 | 5 |
| LAB562 | 65613.2 | — | — | — | 16.6 | L | 5 |
| LAB546 | 65156.2 | 306.9 | 0.06 | 17 | 17.5 | L | 11 |
| LAB546 | 65157.4 | — | — | — | 17.4 | L | 11 |
| LAB524 | 65135.1 | — | — | — | 20.6 | 0.18 | 30 |
| LAB524 | 65136.4 | — | — | — | 16.7 | 0.22 | 6 |
| LAB524 | 65139.4 | — | — | — | 17.5 | 0.17 | 11 |
| LAB506 | 65111.7 | — | — | — | 17.1 | 0.22 | 8 |
| LAB506 | 65115.3 | — | — | — | 16.7 | L | 6 |
| LAB506 | 65115.4 | — | — | — | 17.4 | 0.07 | 10 |
| LAB505 | 65105.1 | 302.9 | 0.02 | 15 | 16.2 | 0.10 | 3 |
| LAB505 | 65110.2 | — | — | — | 20.6 | 0.08 | 31 |
| LAB505 | 65110.4 | — | — | — | 19.2 | 0.08 | 22 |
| LAB457 | 65100.1 | — | — | — | 16.5 | 0.03 | 5 |
| LAB457 | 65100.2 | 316.4 | L | 20 | 17.6 | 0.05 | 12 |
| LAB457 | 65101.1 | — | — | — | 16.3 | 0.11 | 3 |
| LAB457 | 65101.2 | — | — | — | 20.5 | 0.05 | 30 |
| LAB457 | 65102.2 | 310.9 | L | 18 | 16.9 | 0.02 | 7 |
| LAB450 | 65306.1 | — | — | — | 16.9 | 0.04 | 7 |
| LAB450 | 65306.2 | 283.8 | 0.16 | 8 | 16.7 | 0.08 | 6 |
| LAB449 | 65095.1 | — | — | — | 16.5 | 0.01 | 5 |
| LAB449 | 65098.4 | — | — | — | 16.5 | L | 5 |
| LAB449 | 65098.5 | — | — | — | 16.7 | 0.21 | 6 |

TABLE 105-continued

Genes showing improved plant performance under standard growth conditions

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LAB449 | 65099.4 | — | — | — | 16.9 | L | 7 |
| LAB446 | 65091.2 | — | — | — | 16.7 | L | 6 |
| LAB446 | 65091.3 | — | — | — | 17.4 | 0.03 | 10 |
| LAB444 | 65086.1 | 299.9 | 0.15 | 14 | 16.1 | 0.19 | 2 |
| LAB444 | 65088.5 | — | — | — | 16.2 | 0.08 | 3 |
| LAB428 | 65078.2 | — | — | — | 16.2 | 0.09 | 3 |
| LAB428 | 65082.2 | 312.5 | 0.07 | 19 | 16.5 | 0.01 | 5 |
| LAB423 | 65527.1 | — | — | — | 17.4 | 0.08 | 10 |
| LAB423 | 65528.2 | — | — | — | 16.5 | 0.13 | 5 |
| LAB423 | 65528.3 | — | — | — | 16.6 | 0.29 | 5 |
| CONT. | — | 262.9 | — | — | 15.8 | — | — |
| LAB572 | 66116.5 | — | — | — | 21.2 | 0.09 | 18 |
| LAB572 | 66117.3 | — | — | — | 19.5 | 0.05 | 8 |
| LAB569 | 65260.7 | 492.9 | 0.13 | 15 | 19.2 | 0.17 | 6 |
| LAB567 | 66068.3 | — | — | — | 24.1 | 0.04 | 34 |
| LAB566 | 66142.5 | 480.1 | 0.21 | 12 | 19.5 | 0.04 | 8 |
| LAB558 | 65324.1 | — | — | — | 19.9 | 0.14 | 11 |
| LAB555 | 65607.2 | — | — | — | 20.9 | 0.03 | 16 |
| LAB548 | 65702.3 | — | — | — | 18.7 | 0.17 | 4 |
| LAB548 | 65703.2 | — | — | — | 20.5 | 0.24 | 14 |
| LAB548 | 65703.4 | — | — | — | 21.9 | 0.15 | 22 |
| LAB548 | 65704.1 | — | — | — | 19.1 | 0.30 | 6 |
| LAB545 | 65697.2 | — | — | — | 18.6 | 0.21 | 4 |
| LAB545 | 65698.1 | — | — | — | 20.2 | 0.02 | 12 |
| LAB541 | 65412.8 | 493.5 | 0.22 | 15 | 18.9 | 0.13 | 5 |
| LAB526 | 65667.3 | — | — | — | 20.3 | L | 13 |
| LAB526 | 65668.2 | — | — | — | 20.6 | L | 15 |
| LAB526 | 65669.2 | — | — | — | 19.9 | 0.25 | 11 |
| LAB518 | 66023.1 | 485.1 | 0.20 | 13 | 20.0 | L | 11 |
| LAB518 | 66023.3 | — | — | — | 20.5 | 0.09 | 14 |
| LAB518 | 66024.4 | 485.9 | 0.16 | 13 | — | — | — |
| LAB518 | 66024.5 | — | — | — | 21.4 | L | 19 |
| LAB498 | 66039.1 | 521.1 | 0.20 | 21 | — | — | — |
| LAB498 | 66040.1 | — | — | — | 19.3 | 0.04 | 7 |
| LAB498 | 66041.1 | — | — | — | 22.9 | 0.01 | 27 |
| LAB467 | 66131.4 | — | — | — | 18.6 | 0.26 | 3 |
| LAB443 | 65556.1 | — | — | — | 20.5 | 0.08 | 14 |
| LAB405 | 66122.1 | 495.8 | 0.18 | 15 | 20.0 | 0.06 | 11 |
| LAB405 | 66124.2 | — | — | — | 20.0 | 0.27 | 11 |
| LAB405 | 66126.1 | — | — | — | 21.4 | 0.22 | 19 |
| LAB396 | 65924.1 | — | — | — | 20.2 | 0.12 | 12 |
| LAB396 | 65925.4 | — | — | — | 23.8 | 0.03 | 32 |
| LAB396 | 65926.1 | — | — | — | 26.1 | 0.20 | 45 |
| LAB396 | 65927.1 | — | — | — | 21.7 | 0.22 | 21 |
| LAB396 | 65927.4 | — | — | — | 18.8 | 0.15 | 4 |
| CONT. | — | 429.3 | — | — | 18.0 | — | — |

Table 105.
"CONT."—Control;
"Ave."— Average;
"% Incr." = % increment;
"p-val."—p-value;
"L" means that p-value is less than 0.01.
The transgenes were under the transcriptional regulation of the new At6669 promoter (SEQ ID NO: 7724).

Example 19

Evaluation of Transgenic Arabidopsis ABST, Biomass and Plant Growth Rate Under Abiotic Stress as Well as Under Standard Conditions in Greenhouse Assay Assay 4—ABST measured until bolting stage: plant biomass and plant growth rate under drought conditions and standard growth conditions in greenhouse experiments—This assay follows the plant biomass formation and the rosette area growth of plants grown in the greenhouse under drought conditions and standard growth conditions. Transgenic Arabidopsis seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress (drought conditions). All plants are grown in the greenhouse until bolting stage. At harvest, plant biomass (the above ground tissue) was weighted directly after harvesting the rosette (plant fresh weight [FW]). Thereafter, plants were dried in an oven at 50° C. for 48 hours and weighted (plant dry weight [DW]).

Each construct was validated at its $T_2$ generation (under the control of the AT6669 (SEQ ID NO:7724) promoter).

Transgenic plants transformed with a construct conformed by an empty vector carrying the AT6669 (SEQ ID NO:7724) promoter and the selectable marker was used as control.

The plants were analyzed for their overall size, growth rate, fresh weight and dry matter. Transgenic plants performance was compared to control plants grown in parallel under the same conditions. Mock-transgenic plants with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) is used for capturing images of plant samples.

The image capturing process was repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 (Java based image processing program which was developed at the U.S National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, Petiole Relative Area and leaf petiole length.

Vegetative growth rate: The relative growth rate (RGR) of leaf blade area (Formula XIV), leaf number (Formula VI), rosette area (Formula XV), rosette diameter (Formula XVI), plot coverage (Formula XVII) and Petiole Relative Area (XVIII) as described above.

Plant Fresh and Dry Weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

The genes listed in Tables 106-110 improved plant ABST when grown under drought conditions. The genes listed in Tables 111-1150 improved plant performance when grown under standard growth conditions. The genes were cloned under the regulation of a constitutive (At6669; SEQ ID NO:7724). The evaluation of each gene was performed by testing the performance of different number of events. Event with p-value <0.1 was considered statistically significant.

The genes listed in Tables 106-109 improved ABST when grown under drought conditions. These genes produced larger plants with a larger photosynthetic area and increased biomass (dry weight, fresh weight, rosette diameter, rosette area and plot coverage) when grown under drought conditions.

TABLE 106

Genes showing improved plant performance and plant biomass production under drought conditions

| Gene Name | Event # | Dry Weight [mg] Ave. | P-Val. | % Incr. | Fresh Weight [mg] Ave. | P-Val. | % Incr. |
|---|---|---|---|---|---|---|---|
| LAB572 | 66116.5 | 78.1 | 0.18 | 27 | — | — | — |
| LAB572 | 66119.1 | 75 | 0.08 | 22 | — | — | — |
| LAB572 | 66120.3 | 78.8 | 0.09 | 28 | — | — | — |
| LAB569 | 65257.4 | 90 | 0.05 | 46 | 831.2 | 0.18 | 8 |
| LAB569 | 65260.7 | 74.4 | 0.26 | 21 | — | — | — |
| LAB566 | 66140.1 | 76.2 | 0.08 | 24 | — | — | — |
| LAB566 | 66142.1 | 74.4 | 0.1 | 21 | — | — | — |
| LAB562 | 65612.2 | 77.5 | 0.11 | 26 | — | — | — |
| LAB555 | 65606.2 | 80 | 0.12 | 30 | — | — | — |
| LAB541 | 65407.6 | 83.1 | 0.01 | 35 | — | — | — |
| LAB541 | 65412.4 | 80 | 0.04 | 30 | — | — | — |
| LAB541 | 65412.7 | 73.8 | 0.09 | 20 | — | — | — |
| LAB541 | 65412.8 | 70.6 | 0.27 | 15 | — | — | — |
| LAB526 | 65667.3 | 78.1 | 0.03 | 27 | 856.2 | 0.15 | 11 |
| LAB526 | 65669.2 | 79.4 | 0.21 | 29 | — | — | — |
| LAB521 | 65599.6 | 68.8 | 0.28 | 11 | — | — | — |
| LAB521 | 65601.3 | 72.8 | 0.11 | 18 | — | — | — |
| LAB518 | 66020.1 | 69.4 | 0.25 | 12 | — | — | — |
| LAB518 | 66023.1 | 74.4 | 0.26 | 21 | — | — | — |
| LAB518 | 66024.5 | 71.2 | 0.15 | 16 | — | — | — |
| LAB467 | 66130.2 | — | — | — | 831.2 | 0.21 | 8 |
| LAB467 | 66131.2 | 89.4 | 0.01 | 45 | — | — | — |
| LAB443 | 65552.2 | 69.4 | 0.24 | 12 | — | — | — |
| LAB439 | 65950.2 | 73.7 | 0.19 | 19 | — | — | — |
| LAB396 | 65924.1 | — | — | — | 837.5 | 0.15 | 9 |
| LAB396 | 65926.1 | — | — | — | 887.5 | 0.11 | 15 |
| CONT. | — | 61.7 | — | — | 770.8 | — | — |
| LAB604 | 66494.1 | 194.2 | 0.01 | 13 | 1942.3 | L | 20 |
| LAB604 | 66495.4 | 192.5 | 0.02 | 12 | 2290.6 | 0.18 | 41 |
| LAB604 | 66496.1 | — | — | — | 2060.6 | 0.23 | 27 |
| LAB604 | 66498.2 | 205 | 0.12 | 19 | 1968.8 | 0.11 | 22 |
| LAB593 | 66338.2 | 212.9 | L | 24 | 1986.3 | 0.01 | 23 |
| LAB593 | 66340.1 | — | — | — | 1776.9 | 0.09 | 10 |
| LAB593 | 66340.4 | 200 | 0.25 | 17 | — | — | — |
| LAB575 | 66782.6 | 200.6 | 0.03 | 17 | 1833.8 | 0.04 | 13 |
| LAB575 | 66783.2 | 183.8 | 0.25 | 7 | 1796.9 | 0.19 | 11 |
| LAB508 | 66729.1 | 193.1 | 0.02 | 12 | 1921.9 | 0.26 | 19 |
| LAB508 | 66729.2 | 198.8 | L | 16 | — | — | — |
| LAB508 | 66730.5 | 191.2 | 0.03 | 11 | — | — | — |
| LAB508 | 66733.4 | — | — | — | 1958.1 | 0.02 | 21 |
| LAB507 | 66794.5 | 193.8 | 0.17 | 13 | 1975.6 | L | 22 |
| LAB507 | 66798.5 | 186.9 | 0.26 | 9 | — | — | — |
| LAB476 | 66303.3 | — | — | — | 1967 | L | 21 |
| LAB476 | 66305.1 | — | — | — | 2223.4 | 0.22 | 37 |
| LAB476 | 66306.6 | 183.8 | 0.09 | 7 | 1937.5 | 0.18 | 20 |
| LAB476 | 66307.1 | — | — | — | 1808.1 | 0.22 | 12 |
| LAB476 | 66307.2 | 201.2 | L | 17 | 1850.6 | 0.05 | 14 |
| LAB472 | 66718.7 | — | — | — | 1858.4 | 0.19 | 15 |
| LAB472 | 66719.1 | — | — | — | 1897.1 | 0.26 | 17 |
| LAB472 | 66719.3 | 199 | 0.23 | 16 | 1966 | L | 21 |
| LAB470 | 66627.2 | 196.9 | L | 15 | 1866.2 | 0.07 | 15 |
| LAB470 | 66630.1 | 202.5 | 0.02 | 18 | 2071.2 | 0.02 | 28 |
| LAB470 | 66630.4 | 181.2 | 0.16 | 6 | 1883.8 | 0.02 | 16 |
| LAB462 | 66615.1 | 206.9 | L | 21 | 1952.5 | 0.02 | 21 |
| LAB462 | 66617.1 | 189.4 | 0.1 | 10 | 1853.8 | 0.08 | 14 |
| LAB462 | 66617.3 | 203.1 | 0.21 | 18 | 2466.9 | 0.09 | 52 |
| LAB454 | 66813.1 | 188.1 | 0.18 | 10 | 1811.2 | 0.12 | 12 |
| LAB454 | 66813.3 | 203 | 0.02 | 18 | — | — | — |
| LAB454 | 66813.5 | — | — | — | 1769.4 | 0.11 | 9 |
| LAB454 | 66813.7 | — | — | — | 1982.5 | 0.19 | 22 |

TABLE 106-continued

Genes showing improved plant performance and plant biomass production under drought conditions

| Gene Name | Event # | Dry Weight [mg] Ave. | P-Val. | % Incr. | Fresh Weight [mg] Ave. | P-Val. | % Incr. |
|---|---|---|---|---|---|---|---|
| LAB438 | 66461.2 | — | — | — | 1730 | 0.2 | 7 |
| LAB424 | 66710.9 | 196.2 | 0.06 | 14 | 1951.9 | L | 21 |
| LAB424 | 66713.2 | 178.8 | 0.28 | 4 | — | — | — |
| LAB424 | 66715.1 | — | — | — | 1946.6 | L | 20 |
| LAB422 | 65936.2 | 194.2 | 0.3 | 13 | 2083.3 | 0.07 | 29 |
| LAB422 | 65936.3 | — | — | — | 1866.2 | 0.02 | 15 |
| LAB422 | 65937.4 | 201.9 | 0.01 | 18 | — | — | — |
| LAB418 | 66825.1 | — | — | — | 1866.4 | 0.26 | 15 |
| LAB418 | 66825.8 | 182.9 | 0.13 | 7 | 1862.1 | 0.03 | 15 |
| LAB418 | 66826.2 | 201.9 | 0.03 | 18 | 2033.8 | 0.02 | 26 |
| LAB418 | 66827.5 | — | — | — | 2005.6 | L | 24 |
| LAB404 | 66778.1 | 214.4 | 0.21 | 25 | 1921.3 | L | 19 |
| LAB404 | 66778.2 | 221.2 | 0.09 | 29 | 2217.5 | 0.2 | 37 |
| LAB403 | 66800.3 | 180 | 0.21 | 5 | 1880 | 0.02 | 16 |
| LAB403 | 66802.6 | 217.5 | 0.16 | 27 | 2038.1 | 0.04 | 26 |
| LAB403 | 66802.7 | 199.4 | 0.1 | 16 | 2286.9 | 0.23 | 41 |
| LAB403 | 66804.5 | 210.6 | 0.11 | 23 | 2055.6 | L | 27 |
| LAB402 | 66570.3 | — | — | — | — | — | — |
| CONT. | — | 171.7 | — | — | 1619.2 | — | — |
| LAB604 | 66496.3 | 217.5 | 0.17 | 16 | — | — | — |
| LAB593 | 66340.2 | — | — | — | 2218.8 | 0.22 | 13 |
| LAB593 | 66340.4 | — | — | — | 2200 | 0.23 | 12 |
| LAB593 | 66341.1 | 240.6 | 0.19 | 28 | 2393.8 | 0.06 | 22 |
| LAB575 | 66783.2 | — | — | — | 2450 | 0.04 | 25 |
| LAB575 | 66783.4 | — | — | — | 2375 | 0.06 | 21 |
| LAB508 | 66728.5 | — | — | — | 2237.5 | 0.18 | 14 |
| LAB507 | 66798.2 | — | — | — | 2268.8 | 0.14 | 15 |
| LAB472 | 66717.8 | — | — | — | 2262.5 | 0.19 | 15 |
| LAB466 | 66622.4 | — | — | — | 2300 | 0.12 | 17 |
| LAB462 | 66617.3 | — | — | — | 2212.5 | 0.22 | 13 |
| LAB454 | 66813.5 | — | — | — | 2256.2 | 0.15 | 15 |
| LAB422 | 65936.2 | — | — | — | 2343.8 | 0.14 | 19 |
| LAB422 | 65939.2 | 215.6 | 0.25 | 15 | 2268.8 | 0.16 | 15 |
| LAB418 | 66826.2 | — | — | — | 2243.8 | 0.17 | 14 |
| LAB418 | 66829.2 | — | — | — | 2437.5 | 0.06 | 24 |
| LAB404 | 66778.1 | — | — | — | 2237.5 | 0.17 | 14 |
| LAB404 | 66778.2 | — | — | — | 2312.5 | 0.11 | 18 |
| CONT. | — | 187.3 | — | — | 1964.6 | — | — |
| LAB609 | 65708.2 | 69.4 | 0.02 | 26 | 712.5 | 0.09 | 28 |
| LAB609 | 65709.3 | 83.1 | 0.14 | 51 | 793.8 | 0.02 | 43 |
| LAB585 | 65396.1 | 66.2 | L | 20 | 631.2 | 0.06 | 13 |
| LAB585 | 65398.1 | 72.5 | 0.16 | 32 | 756.2 | 0.23 | 36 |
| LAB585 | 65399.1 | 68.8 | 0.2 | 25 | — | — | — |
| LAB585 | 65400.1 | — | — | — | 662.5 | 0.24 | 19 |
| LAB573 | 65572.1 | 61.9 | 0.09 | 12 | 612.5 | 0.2 | 10 |
| LAB570 | 65557.1 | 62.5 | 0.27 | 14 | — | — | — |
| LAB570 | 65558.2 | 68.8 | L | 25 | 706.2 | L | 27 |
| LAB568 | 65619.2 | — | — | — | 693.8 | 0.27 | 25 |
| LAB540 | 65883.1 | — | — | — | 593.8 | 0.26 | 7 |
| LAB540 | 65884.8 | 71.9 | 0.02 | 31 | 675 | 0.28 | 21 |
| LAB534 | 65877.2 | 65 | 0.28 | 18 | 625 | 0.27 | 12 |
| LAB534 | 65877.3 | 88.1 | 0.15 | 60 | 756.2 | 0.27 | 36 |
| LAB510 | 65990.3 | — | — | — | 587.5 | 0.25 | 6 |
| LAB504 | 66015.2 | 71.9 | 0.19 | 31 | 643.8 | 0.14 | 16 |
| LAB460 | 65644.3 | 63.1 | 0.2 | 15 | 643.8 | L | 16 |
| LAB460 | 65645.2 | 60.2 | 0.27 | 9 | 600.9 | 0.13 | 8 |
| LAB460 | 65647.2 | 66.2 | 0.08 | 20 | — | — | — |
| LAB458 | 65804.3 | 61.9 | L | 12 | 643.8 | L | 16 |
| LAB458 | 65805.4 | 60 | 0.06 | 9 | — | — | — |
| LAB458 | 65807.3 | 62.5 | 0.27 | 14 | — | — | — |
| LAB455 | 66008.3 | 68.6 | L | 25 | — | — | — |
| LAB455 | 66011.1 | — | — | — | 650 | 0.18 | 17 |
| LAB455 | 66011.3 | — | — | — | 625 | 0.14 | 12 |
| LAB440 | 65956.1 | 65.6 | 0.23 | 19 | 643.8 | L | 16 |
| LAB426 | 65637.3 | 70 | 0.13 | 27 | 700 | 0.17 | 26 |
| LAB410 | 65401.2 | — | — | — | 731.2 | 0.1 | 31 |
| LAB410 | 65406.2 | 62.5 | 0.15 | 14 | — | — | — |
| LAB406 | 65515.2 | 65.1 | 0.19 | 18 | 605.4 | 0.17 | 9 |
| LAB406 | 65516.2 | 61.2 | 0.03 | 11 | — | — | — |
| LAB406 | 65517.3 | 59.4 | 0.19 | 8 | — | — | — |
| CONT. | — | 55 | — | — | 556.2 | — | — |
| LAB595 | 65273.3 | — | — | — | 300 | 0.14 | 13 |
| LAB576 | 65329.2 | — | — | — | 356.2 | 0.07 | 34 |
| LAB576 | 65332.2 | 44.4 | L | 64 | — | — | — |
| LAB576 | 65332.3 | — | — | — | 343.8 | 0.09 | 29 |
| LAB546 | 65155.2 | 32.1 | 0.13 | 18 | — | — | — |
| LAB546 | 65156.1 | — | — | — | 293.8 | 0.07 | 10 |
| LAB546 | 65156.2 | — | — | — | — | — | — |
| LAB546 | 65157.4 | — | — | — | 293.8 | 0.07 | 10 |
| LAB544 | 65691.4 | 45 | 0.05 | 66 | — | — | — |
| LAB544 | 65693.2 | 35.7 | 0.24 | 32 | — | — | — |
| LAB524 | 65135.1 | — | — | — | 350 | 0.25 | 31 |
| LAB524 | 65136.1 | 40.6 | 0.05 | 50 | — | — | — |
| LAB524 | 65136.4 | 41.2 | 0.16 | 52 | — | — | — |
| LAB524 | 65139.4 | 38.1 | 0.17 | 41 | — | — | — |
| LAB517 | 65656.4 | 33.8 | 0.14 | 25 | 287.5 | 0.3 | 8 |
| LAB517 | 65657.1 | 40.6 | L | 50 | — | — | — |
| LAB517 | 65657.2 | 35 | 0.1 | 29 | — | — | — |
| LAB513 | 65124.3 | 32.1 | 0.21 | 19 | — | — | — |
| LAB513 | 65124.5 | 32.5 | 0.22 | 20 | — | — | — |
| LAB513 | 65126.1 | 41.9 | L | 55 | — | — | — |
| LAB513 | 65126.2 | 44.4 | 0.03 | 64 | — | — | — |
| LAB509 | 65118.3 | 35 | 0.1 | 29 | 343.8 | L | 29 |
| LAB509 | 65118.4 | — | — | — | 287.5 | 0.3 | 8 |
| LAB509 | 65121.2 | 45.6 | 0.02 | 69 | 343.8 | L | 29 |
| LAB506 | 65114.2 | 38.1 | 0.08 | 41 | — | — | — |
| LAB505 | 65105.1 | 41.9 | 0.24 | 55 | — | — | — |
| LAB505 | 65109.2 | 36.2 | 0.17 | 34 | — | — | — |
| LAB457 | 65100.1 | 34.4 | 0.08 | 27 | 281.2 | 0.27 | 6 |
| LAB449 | 65096.1 | 31.2 | 0.21 | 16 | — | — | — |
| LAB446 | 65091.2 | 41.9 | 0.24 | 55 | 343.8 | 0.09 | 29 |
| LAB446 | 65091.3 | 33.1 | 0.25 | 22 | — | — | — |
| LAB446 | 65093.2 | — | — | — | 318.8 | L | 20 |
| LAB446 | 65094.1 | 38.1 | 0.08 | 41 | — | — | — |
| LAB444 | 65086.1 | 43.8 | 0.24 | 62 | — | — | — |
| LAB444 | 65086.2 | 43.6 | 0.2 | 61 | 286.6 | 0.11 | 8 |
| LAB442 | 65545.3 | 35.6 | 0.14 | 32 | 312.5 | L | 17 |
| LAB442 | 65545.5 | 56.5 | 0.13 | 109 | 354.5 | 0.05 | 33 |
| LAB442 | 65546.2 | 36.2 | 0.07 | 34 | — | — | — |
| LAB428 | 65079.1 | 33.1 | 0.08 | 22 | 325 | 0.05 | 22 |
| LAB428 | 65082.3 | 38.8 | L | 43 | 331.2 | 0.26 | 24 |
| LAB423 | 65527.1 | 33.2 | 0.11 | 23 | — | — | — |
| LAB423 | 65530.2 | 42.5 | 0.07 | 57 | 293.8 | 0.07 | 10 |
| CONT. | — | 27.1 | — | — | 266.4 | — | — |
| LAB588 | 66332.2 | 234.4 | 0.21 | 13 | — | — | — |
| LAB584 | 66074.1 | 242.5 | 0.13 | 17 | — | — | — |
| LAB584 | 66074.5 | — | — | — | 2100 | 0.1 | 15 |
| LAB584 | 66076.3 | 239.6 | 0.14 | 16 | 1995.5 | 0.21 | 10 |
| LAB576 | 65332.3 | — | — | — | 2056.2 | 0.12 | 13 |
| LAB564 | 66063.4 | — | — | — | 2081.2 | 0.13 | 14 |
| LAB539 | 66136.2 | 262.5 | 0.05 | 27 | 2162.5 | 0.03 | 19 |
| LAB516 | 65870.2 | 229.5 | 0.29 | 11 | 2025 | 0.15 | 11 |
| LAB516 | 65871.2 | 231.5 | 0.29 | 12 | 2036.9 | 0.19 | 12 |
| LAB516 | 65875.2 | 238.8 | 0.16 | 15 | 2056.2 | 0.1 | 13 |
| LAB511 | 66254.3 | — | — | — | 2025 | 0.18 | 11 |
| LAB511 | 66258.2 | 295 | L | 42 | 2033 | 0.25 | 12 |
| LAB474 | 66470.4 | 239.4 | 0.3 | 16 | — | — | — |
| LAB474 | 66475.1 | 233.8 | 0.22 | 13 | 2062.5 | 0.22 | 13 |
| LAB465 | 66112.4 | 248.3 | 0.08 | 20 | 2079.2 | 0.09 | 14 |
| LAB465 | 66114.2 | — | — | — | 2031.2 | 0.23 | 12 |
| LAB444 | 65085.1 | 248.8 | 0.08 | 20 | 2062.5 | 0.14 | 13 |
| LAB444 | 65085.4 | — | — | — | 2018.7 | 0.2 | 11 |
| LAB437 | 66452.2 | 234.4 | 0.21 | 13 | 1993.8 | 0.2 | 9 |
| LAB434 | 66446.1 | — | — | — | 1975 | 0.25 | 8 |
| CONT. | — | 207.1 | — | — | 1821.7 | — | — |
| LAB589 | 65919.4 | 209.7 | 0.01 | 24 | 1663.4 | 0.21 | 7 |
| LAB554 | 66241.3 | — | — | — | 1637.5 | 0.25 | 6 |
| LAB550 | 65902.4 | — | — | — | 1750 | 0.02 | 13 |
| LAB530 | 66264.2 | 190 | 0.15 | 12 | 1725 | 0.03 | 11 |
| LAB503 | 66212.3 | — | — | — | 1725 | 0.03 | 11 |
| LAB503 | 66213.5 | — | — | — | 1650 | 0.14 | 6 |
| LAB503 | 66216.1 | — | — | — | 1700 | 0.05 | 10 |
| LAB484 | 65847.2 | — | — | — | 1625 | 0.25 | 5 |
| LAB484 | 65848.3 | — | — | — | 1725 | 0.24 | 11 |

TABLE 106-continued

Genes showing improved plant performance and plant biomass production under drought conditions

| Gene Name | Event # | Dry Weight [mg] Ave. | P-Val. | % Incr. | Fresh Weight [mg] Ave. | P-Val. | % Incr. |
|---|---|---|---|---|---|---|---|
| LAB452 | 66172.4 | 203.1 | 0.11 | 20 | 1631.2 | 0.21 | 5 |
| LAB452 | 66173.3 | — | — | — | 1743.8 | 0.23 | 12 |
| LAB437 | 66453.4 | 181.9 | 0.25 | 7 | — | — | — |
| LAB432 | 66003.3 | — | — | — | 1712.5 | 0.06 | 10 |
| LAB399 | 65503.1 | — | — | — | 1743.8 | 0.13 | 12 |
| LAB399 | 65504.4 | — | — | — | 1681.2 | 0.07 | 8 |
| LAB399 | 65506.1 | 223.4 | L | 32 | — | — | — |
| CONT. | — | 169.6 | — | — | 1550 | — | — |
| LAB610 | 65342.3 | 77.5 | L | 27 | 743.8 | L | 34 |
| LAB596 | 65593.5 | — | — | — | — | — | — |
| LAB596 | 65594.2 | 73.8 | 0.1 | 20 | 662.5 | 0.05 | 20 |
| LAB596 | 65597.1 | 77.5 | 0.06 | 27 | 687.5 | 0.01 | 24 |
| LAB590 | 65349.4 | — | — | — | — | — | — |
| LAB590 | 65350.2 | — | — | — | — | — | — |
| LAB578 | 65581.2 | 75 | L | 22 | 643.8 | 0.04 | 16 |
| LAB577 | 65575.2 | 70 | 0.18 | 14 | 637.5 | 0.2 | 15 |
| LAB577 | 65577.4 | — | — | — | — | — | — |
| LAB577 | 65578.4 | 76.2 | L | 24 | 681.2 | 0.01 | 23 |
| LAB557 | 65317.6 | 68.8 | 0.13 | 12 | 625 | 0.1 | 13 |
| LAB552 | 65312.1 | 72 | 0.02 | 17 | 660.7 | 0.02 | 19 |
| LAB531 | 65678.1 | — | — | — | 681.2 | 0.28 | 23 |
| LAB531 | 65681.4 | — | — | — | 625 | 0.26 | 13 |
| LAB527 | 65672.2 | — | — | — | 618.8 | 0.11 | 12 |
| LAB527 | 65673.2 | — | — | — | 675 | 0.02 | 22 |
| LAB527 | 65675.3 | 83.8 | 0.07 | 37 | 706.2 | L | 27 |
| LAB523 | 65660.3 | — | — | — | 631.2 | 0.28 | 14 |
| LAB523 | 65661.2 | 67.5 | 0.18 | 10 | 650 | 0.04 | 17 |
| LAB522 | 65132.2 | 66.9 | 0.13 | 9 | — | — | — |
| LAB494 | 65650.1 | 72.5 | 0.01 | 18 | — | — | — |
| LAB494 | 65651.1 | — | — | — | 625 | 0.15 | 13 |
| LAB494 | 65651.4 | — | — | — | 631.2 | 0.07 | 14 |
| LAB450 | 65309.1 | — | — | — | 637.5 | 0.06 | 15 |
| LAB409 | 65524.5 | — | — | — | 675 | 0.26 | 22 |
| LAB409 | 65525.2 | 65.6 | 0.27 | 7 | — | — | — |
| LAB409 | 65526.1 | 69.4 | 0.15 | 13 | 668.8 | 0.02 | 21 |
| LAB401 | 65728.1 | 78.1 | 0.2 | 28 | 712.5 | 0.12 | 29 |
| LAB401 | 65728.4 | 71.9 | 0.09 | 17 | — | — | — |
| LAB401 | 65729.2 | — | — | — | 600 | 0.25 | 8 |
| LAB401 | 65731.2 | — | — | — | — | — | — |
| LAB400 | 65509.2 | 71.2 | 0.02 | 16 | 625 | 0.15 | 13 |
| LAB400 | 65510.2 | 79.4 | L | 30 | 668.8 | 0.07 | 21 |
| LAB400 | 65511.2 | 75.6 | 0.04 | 23 | 637.5 | 0.06 | 15 |
| CONT. | — | 61.2 | — | — | 554.2 | — | — |
| LAB608 | 65907.2 | 110 | 0.29 | 10 | — | — | — |
| LAB590 | 65347.2 | 111.9 | 0.23 | 12 | — | — | — |
| LAB565 | 65724.2 | 120 | 0.15 | 20 | 1193.8 | 0.19 | 19 |
| LAB558 | 65323.1 | 116.9 | 0.1 | 17 | 1137.5 | 0.16 | 13 |
| LAB558 | 65325.2 | 122.9 | 0.05 | 23 | 1208 | 0.05 | 20 |
| LAB557 | 65317.4 | 110.5 | 0.27 | 11 | — | — | — |
| LAB557 | 65318.2 | 118.1 | 0.09 | 18 | 1204.5 | 0.12 | 20 |
| LAB552 | 65313.1 | 111.9 | 0.29 | 12 | 1175 | 0.12 | 17 |
| LAB535 | 65688.1 | 131.2 | 0.08 | 32 | 1218.8 | 0.05 | 21 |
| LAB531 | 65679.3 | — | — | — | 1235.7 | 0.29 | 23 |
| LAB531 | 65680.1 | 110 | 0.3 | 10 | — | — | — |
| LAB531 | 65681.4 | 120 | 0.15 | 20 | 1162.5 | 0.27 | 16 |
| LAB522 | 65131.2 | 124.4 | 0.08 | 25 | 1187.5 | 0.07 | 18 |
| LAB516 | 65871.1 | 151.2 | 0.19 | 52 | 1618.8 | 0.1 | 61 |
| LAB516 | 65874.2 | 117.5 | 0.16 | 18 | 1137.5 | 0.25 | 13 |
| LAB494 | 65648.4 | 115.6 | 0.13 | 16 | — | — | — |
| LAB494 | 65649.3 | 159.4 | L | 60 | 1731.2 | L | 72 |
| LAB427 | 65539.12 | 125.6 | 0.03 | 26 | 1268.8 | 0.02 | 26 |
| LAB427 | 65539.6 | 123.3 | 0.17 | 24 | 1255.4 | 0.25 | 25 |
| LAB409 | 65525.2 | 112.5 | 0.25 | 13 | — | — | — |
| LAB409 | 65526.1 | 111.5 | 0.24 | 12 | — | — | — |
| LAB401 | 65728.4 | 111.9 | 0.22 | 12 | — | — | — |
| LAB401 | 65731.2 | 114.3 | 0.16 | 15 | 1200 | 0.07 | 20 |
| LAB400 | 65510.2 | 121.9 | 0.05 | 22 | 1425 | L | 42 |
| CONT. | — | 99.8 | — | — | 1004.2 | — | — |
| LAB544 | 65690.4 | 65 | 0.1 | 15 | 743.8 | 0.16 | 10 |
| LAB544 | 65694.1 | 71.9 | 0.23 | 27 | 818.8 | 0.04 | 21 |
| LAB442 | 65549.2 | 63.8 | 0.07 | 12 | — | — | — |
| LAB425 | 65538.2 | 65 | 0.04 | 15 | — | — | — |
| CONT. | — | 56.7 | — | — | 675 | — | — |
| LAB588 | 66335.1 | — | — | — | 986.9 | 0.22 | 15 |
| LAB584 | 66075.3 | 126.9 | 0.04 | 43 | 1182.5 | L | 38 |
| LAB564 | 66063.4 | 105.6 | 0.11 | 19 | 1003.7 | 0.09 | 17 |
| LAB564 | 66065.2 | 100 | 0.25 | 13 | — | — | — |
| LAB553 | 66057.1 | 101.9 | 0.2 | 15 | — | — | — |
| LAB553 | 66061.2 | 106.9 | 0.29 | 20 | 1013.7 | 0.21 | 19 |
| LAB553 | 66061.3 | 144.4 | 0.13 | 63 | 1238.1 | L | 45 |
| LAB539 | 66135.4 | 100.6 | 0.23 | 13 | 1067.5 | 0.03 | 25 |
| LAB539 | 66136.2 | 143.1 | 0.1 | 61 | 1288.1 | 0.12 | 51 |
| LAB539 | 66137.4 | — | — | — | — | — | — |
| LAB539 | 66138.2 | 111.9 | 0.04 | 26 | 1030 | 0.29 | 20 |
| LAB519 | 66323.2 | 108.1 | 0.07 | 22 | — | — | — |
| LAB519 | 66324.1 | 104.4 | 0.22 | 18 | 1020.6 | 0.08 | 19 |
| LAB511 | 66255.1 | 108.1 | 0.23 | 22 | 1041.2 | 0.11 | 22 |
| LAB492 | 66051.3 | 125 | 0.08 | 41 | 1166.2 | 0.02 | 36 |
| LAB492 | 66054.4 | — | — | — | 1043.8 | 0.21 | 22 |
| LAB480 | 66248.5 | 101.2 | 0.21 | 14 | — | — | — |
| LAB474 | 66470.4 | 103.8 | 0.18 | 17 | 957.5 | 0.21 | 12 |
| LAB474 | 66475.3 | 105.6 | 0.11 | 19 | 1009.4 | 0.09 | 18 |
| LAB471 | 66188.2 | 99.4 | 0.27 | 12 | — | — | — |
| LAB471 | 66191.2 | 110.6 | 0.08 | 25 | 1027.5 | 0.21 | 20 |
| LAB465 | 66112.4 | 125 | 0.16 | 41 | — | — | — |
| LAB447 | 66350.4 | — | — | — | 970.8 | 0.2 | 14 |
| LAB447 | 66353.4 | — | — | — | 1014.4 | 0.13 | 19 |
| LAB434 | 66448.2 | 124.4 | L | 40 | 1148.1 | L | 34 |
| LAB434 | 66448.4 | 118.1 | 0.17 | 33 | 1149.4 | 0.17 | 34 |
| LAB407 | 66246.4 | 105.6 | 0.16 | 19 | — | — | — |
| LAB393 | 66287.2 | 105.6 | 0.16 | 19 | — | — | — |
| LAB393 | 66288.2 | 107.5 | 0.11 | 21 | 1015 | 0.13 | 19 |
| CONT. | — | 88.8 | — | — | 854.8 | — | — |

Table 106.
"CONT."—Control;
"Ave."—Average;
"% Incr." = % increment;
"p-Val."—p-value,
L—p < 0.01.

TABLE 107

Genes showing improved plant performance and biomass production under drought conditions

| Gene Name | Event # | Rosette Diameter [cm] Ave. | P-Val. | % Incr. | Rosette Area [cm²] Ave. | P-Val. | % Incr. | Plot Coverage [cm²] Ave. | P-Val. | % Incr. |
|---|---|---|---|---|---|---|---|---|---|---|
| LAB604 | 66495.4 | 5.2 | 0.05 | 8 | 9.3 | 0.06 | 18 | 74.7 | 0.06 | 18 |
| LAB604 | 66498.2 | 5.2 | 0.24 | 7 | 9.2 | 0.15 | 17 | 73.8 | 0.15 | 17 |
| LAB593 | 66340.4 | 5.5 | 0.04 | 13 | 10.3 | L | 30 | 82.2 | L | 30 |

TABLE 107-continued

Genes showing improved plant performance and biomass production under drought conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB575 | 66782.6 | 5.1 | 0.09 | 7 | 9.3 | 0.03 | 18 | 74.8 | 0.03 | 18 |
| LAB508 | 66729.1 | 5.2 | 0.19 | 7 | 9.1 | 0.13 | 15 | 72.6 | 0.13 | 15 |
| LAB508 | 66729.2 | 5.3 | 0.02 | 11 | 10 | 0.07 | 26 | 79.7 | 0.07 | 26 |
| LAB508 | 66730.5 | 5 | 0.23 | 4 | — | — | — | — | — | — |
| LAB508 | 66733.4 | 5.1 | 0.14 | 7 | 9.2 | 0.16 | 16 | 73.4 | 0.16 | 16 |
| LAB507 | 66794.5 | 5.2 | 0.06 | 8 | 9.2 | 0.04 | 17 | 73.6 | 0.04 | 17 |
| LAB507 | 66798.5 | 5.1 | 0.18 | 5 | 9 | 0.07 | 14 | 72.1 | 0.07 | 14 |
| LAB470 | 66627.2 | 5.1 | 0.23 | 6 | 9.1 | 0.16 | 15 | 72.9 | 0.16 | 15 |
| LAB470 | 66630.1 | 5.4 | 0.29 | 12 | 9.4 | 0.03 | 19 | 75.1 | 0.03 | 19 |
| LAB462 | 66615.1 | 5.1 | 0.3 | 6 | — | — | — | — | — | — |
| LAB462 | 66617.3 | — | — | — | 10.2 | 0.26 | 29 | 81.7 | 0.26 | 29 |
| LAB454 | 66813.1 | 5.2 | 0.3 | 9 | 9.2 | 0.05 | 17 | 73.9 | 0.05 | 17 |
| LAB454 | 66813.3 | 5.1 | 0.11 | 7 | 9 | 0.1 | 14 | 72 | 0.1 | 14 |
| LAB438 | 66461.2 | 5.2 | 0.13 | 8 | 9.3 | 0.04 | 18 | 74.7 | 0.04 | 18 |
| LAB424 | 66710.9 | 5 | 0.29 | 4 | — | — | — | — | — | — |
| LAB424 | 66713.2 | — | — | — | 8.5 | 0.26 | 8 | 68.2 | 0.26 | 8 |
| LAB422 | 65936.2 | 5.3 | 0.03 | 10 | 9.3 | 0.07 | 18 | 74.4 | 0.07 | 18 |
| LAB422 | 65937.4 | 5.3 | 0.09 | 10 | 10.1 | L | 28 | 81.1 | L | 28 |
| LAB418 | 66826.2 | 5.2 | 0.13 | 8 | 9.6 | 0.04 | 21 | 76.4 | 0.04 | 21 |
| LAB404 | 66778.1 | 5.6 | 0.22 | 16 | — | — | — | — | — | — |
| LAB404 | 66778.2 | 5.9 | 0.27 | 23 | 12.4 | 0.28 | 57 | 98.9 | 0.28 | 57 |
| LAB403 | 66802.6 | 5.5 | 0.06 | 15 | 10.8 | 0.13 | 36 | 86.2 | 0.13 | 36 |
| LAB403 | 66802.7 | 5.4 | 0.01 | 13 | 10 | L | 27 | 80.3 | L | 27 |
| LAB403 | 66804.5 | 5.5 | L | 15 | 10.9 | L | 38 | 87.1 | L | 38 |
| CONT. | — | 4.8 | — | — | 7.9 | — | — | 63.2 | — | — |
| LAB593 | 66340.1 | — | — | — | 9.6 | 0.16 | 9 | 77 | 0.16 | 9 |
| LAB593 | 66341.1 | 5.5 | L | 13 | 11.9 | L | 35 | 94.9 | L | 35 |
| LAB575 | 66783.2 | 5.7 | L | 16 | 12.6 | 0.03 | 43 | 100.9 | 0.03 | 43 |
| LAB575 | 66783.4 | — | — | — | 10.4 | 0.17 | 18 | 83.3 | 0.17 | 18 |
| LAB507 | 66798.2 | 5.3 | L | 8 | 9.7 | 0.21 | 10 | 77.4 | 0.21 | 10 |
| LAB476 | 66306.6 | 5.4 | 0.29 | 10 | — | — | — | — | — | — |
| LAB472 | 66717.8 | — | — | — | 9.4 | 0.13 | 7 | 75.2 | 0.13 | 7 |
| LAB470 | 66630.1 | 5.2 | 0.02 | 6 | 10.3 | L | 17 | 82.5 | L | 17 |
| LAB470 | 66630.4 | 5.3 | 0.25 | 7 | 10.3 | 0.03 | 17 | 82.1 | 0.03 | 17 |
| LAB466 | 66621.2 | 5.3 | 0.16 | 8 | 9.8 | 0.02 | 11 | 78.2 | 0.02 | 11 |
| LAB466 | 66622.4 | 5.6 | L | 14 | 10.8 | 0.13 | 23 | 86.4 | 0.13 | 23 |
| LAB462 | 66617.3 | 5.1 | 0.13 | 4 | 10.2 | L | 15 | 81.3 | L | 15 |
| LAB454 | 66813.3 | — | — | — | 9.4 | 0.16 | 7 | 75.5 | 0.16 | 7 |
| LAB454 | 66813.6 | 5.3 | 0.3 | 8 | — | — | — | — | — | — |
| LAB438 | 66460.1 | 5.2 | 0.1 | 7 | 10 | 0.26 | 13 | 79.6 | 0.26 | 13 |
| LAB438 | 66461.5 | 5.1 | 0.06 | 5 | 9.4 | 0.21 | 6 | — | — | — |
| LAB422 | 65936.2 | 5.5 | 0.07 | 12 | 11 | 0.21 | 25 | 88 | 0.21 | 25 |
| LAB422 | 65938.3 | 5.3 | L | 8 | 9.6 | 0.08 | 9 | 76.6 | 0.08 | 9 |
| LAB422 | 65939.2 | 5.1 | 0.29 | 4 | 10.1 | 0.17 | 15 | 80.8 | 0.17 | 15 |
| LAB418 | 66826.2 | 5.2 | 0.1 | 7 | 9.5 | 0.06 | 8 | 76.3 | 0.06 | 8 |
| LAB418 | 66829.2 | 5.2 | 0.29 | 6 | — | — | — | — | — | — |
| LAB404 | 66778.1 | 5.3 | 0.23 | 9 | 10.5 | 0.12 | 19 | 83.7 | 0.12 | 19 |
| LAB404 | 66778.2 | 5.3 | 0.01 | 8 | 10.4 | L | 19 | 83.6 | L | 19 |
| LAB403 | 66800.3 | 5.1 | 0.09 | 4 | 10 | 0.01 | 13 | 79.8 | 0.01 | 13 |
| LAB403 | 66804.5 | 5.2 | 0.17 | 6 | 10.1 | L | 15 | 80.8 | L | 15 |
| LAB403 | 66804.8 | 5 | 0.21 | 3 | — | — | — | — | — | — |
| LAB402 | 66570.4 | 5 | 0.28 | 2 | 9.6 | 0.1 | 9 | 76.9 | 0.1 | 9 |
| CONT. | — | 4.9 | — | — | 8.8 | — | — | 70.5 | — | — |
| LAB609 | 65708.2 | 5 | 0.1 | 13 | 9 | 0.03 | 29 | 72.3 | 0.03 | 29 |
| LAB609 | 65709.3 | 5.3 | L | 22 | 10.3 | L | 48 | 82.7 | L | 48 |
| LAB609 | 65710.2 | 4.5 | 0.25 | 3 | 7.5 | 0.08 | 7 | 59.9 | 0.08 | 7 |
| LAB609 | 65711.2 | — | — | — | 7.5 | 0.09 | 7 | 59.6 | 0.09 | 7 |
| LAB605 | 65982.2 | 4.6 | 0.18 | 4 | 7.4 | 0.28 | 6 | 59.3 | 0.28 | 6 |
| LAB585 | 65396.1 | 4.5 | 0.17 | 2 | 7.3 | 0.25 | 4 | 58.3 | 0.25 | 4 |
| LAB585 | 65398.1 | — | — | — | 9.6 | 0.16 | 38 | 76.9 | 0.16 | 38 |
| LAB570 | 65558.2 | 5 | L | 13 | 8.4 | 0.2 | 21 | 67.6 | 0.2 | 21 |
| LAB568 | 65619.2 | 5.1 | 0.16 | 15 | 9.4 | 0.11 | 35 | 75.6 | 0.11 | 35 |
| LAB568 | 65621.1 | 4.5 | 0.13 | 2 | — | — | — | — | — | — |
| LAB540 | 65883.1 | 4.6 | 0.02 | 5 | 7.5 | 0.28 | 7 | 59.7 | 0.28 | 7 |
| LAB540 | 65884.8 | 4.7 | 0.19 | 8 | 8.2 | 0.27 | 18 | 65.8 | 0.27 | 18 |
| LAB534 | 65877.2 | 4.6 | 0.24 | 4 | 7.5 | 0.12 | 7 | 59.6 | 0.12 | 7 |
| LAB534 | 65877.3 | 5 | 0.15 | 14 | 9.2 | 0.16 | 32 | 73.9 | 0.16 | 32 |
| LAB534 | 65878.3 | — | — | — | 7.6 | 0.12 | 9 | 60.8 | 0.12 | 9 |
| LAB510 | 65990.3 | — | — | — | 7.9 | 0.27 | 13 | 62.9 | 0.27 | 13 |
| LAB510 | 65991.2 | 4.9 | 0.26 | 11 | — | — | — | — | — | — |
| LAB460 | 65644.3 | 4.7 | 0.06 | 8 | 8.2 | 0.06 | 17 | 65.4 | 0.06 | 17 |

TABLE 107-continued

Genes showing improved plant performance and biomass production under drought conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB460 | 65647.4 | 5 | 0.26 | 14 | — | — | — | — | — | — |
| LAB458 | 65804.3 | 4.7 | 0.13 | 6 | 8 | L | 15 | 64.2 | L | 15 |
| LAB458 | 65805.1 | 4.7 | L | 6 | 7.9 | 0.1 | 13 | 63.1 | 0.1 | 13 |
| LAB458 | 65805.4 | 4.6 | 0.17 | 4 | 7.5 | 0.1 | 7 | 59.8 | 0.1 | 7 |
| LAB455 | 66011.1 | 4.8 | 0.03 | 9 | 7.9 | 0.01 | 13 | 63 | 0.01 | 13 |
| LAB455 | 66011.3 | 4.7 | 0.15 | 8 | 7.9 | 0.13 | 14 | 63.5 | 0.13 | 14 |
| LAB440 | 65956.1 | 4.8 | L | 9 | 8.1 | L | 16 | 65 | L | 16 |
| LAB426 | 65637.2 | — | — | — | 7.4 | 0.17 | 5 | 58.9 | 0.17 | 5 |
| LAB426 | 65637.3 | 4.8 | 0.05 | 9 | 8.3 | 0.05 | 18 | 66.1 | 0.05 | 18 |
| LAB410 | 65401.2 | 5 | 0.24 | 13 | 9.1 | 0.2 | 31 | 73.2 | 0.2 | 31 |
| LAB410 | 65405.4 | 4.6 | 0.21 | 5 | 7.5 | 0.18 | 7 | 59.9 | 0.18 | 7 |
| LAB406 | 65515.2 | 4.8 | L | 9 | 7.9 | 0.02 | 13 | 63 | 0.02 | 13 |
| LAB406 | 65517.3 | 4.7 | L | 7 | 7.9 | 0.13 | 13 | 62.9 | 0.13 | 13 |
| CONT. | — | 4.4 | — | — | 7 | — | — | 55.9 | — | — |
| LAB576 | 65329.2 | 4.6 | L | 14 | 8.1 | L | 27 | 65.1 | L | 27 |
| LAB576 | 65332.3 | 4.4 | 0.13 | 10 | 7.7 | L | 21 | 61.8 | L | 21 |
| LAB546 | 65156.2 | 4.3 | 0.05 | 7 | 7 | 0.1 | 10 | 56.4 | 0.1 | 10 |
| LAB546 | 65157.4 | 4.3 | 0.08 | 7 | 7.4 | 0.2 | 15 | 59.1 | 0.2 | 15 |
| LAB513 | 65124.5 | 4.2 | 0.2 | 5 | 7.1 | 0.16 | 11 | 56.6 | 0.16 | 11 |
| LAB509 | 65118.3 | 4.5 | L | 11 | 8 | 0.02 | 25 | 63.8 | 0.02 | 25 |
| LAB509 | 65121.2 | — | — | — | 6.9 | 0.27 | 7 | 55 | 0.27 | 7 |
| LAB505 | 65109.2 | 4.2 | 0.17 | 4 | — | — | — | — | — | — |
| LAB449 | 65098.5 | 4.4 | 0.02 | 9 | 7.5 | 0.02 | 17 | 59.9 | 0.02 | 17 |
| LAB446 | 65091.2 | 4.4 | 0.05 | 10 | 8.1 | L | 26 | 64.4 | L | 26 |
| LAB446 | 65093.2 | 4.2 | 0.19 | 4 | 7 | 0.14 | 9 | 55.8 | 0.14 | 9 |
| LAB428 | 65079.1 | 4.4 | 0.07 | 10 | 7.7 | 0.02 | 20 | 61.7 | 0.02 | 20 |
| LAB423 | 65528.2 | 4.3 | 0.07 | 6 | 7.1 | 0.06 | 11 | 57 | 0.06 | 11 |
| CONT. | — | 4 | — | — | 6.4 | — | — | 51.2 | — | — |
| LAB588 | 66332.2 | 5.2 | 0.01 | 16 | 9.5 | L | 31 | 76.2 | L | 31 |
| LAB584 | 66074.5 | 4.9 | 0.14 | 9 | 8.7 | 0.1 | 19 | 69.7 | 0.1 | 19 |
| LAB584 | 66075.2 | 4.8 | 0.23 | 5 | 8 | 0.23 | 10 | 64.1 | 0.23 | 10 |
| LAB584 | 66076.3 | 4.7 | 0.3 | 5 | 8.1 | 0.17 | 11 | 65 | 0.17 | 11 |
| LAB584 | 66077.2 | 4.9 | 0.07 | 9 | 8.4 | 0.11 | 15 | 67 | 0.11 | 15 |
| LAB576 | 65332.2 | — | — | — | 8.1 | 0.2 | 11 | 64.5 | 0.2 | 11 |
| LAB576 | 65332.3 | — | — | — | 8.4 | 0.15 | 16 | 67.5 | 0.15 | 16 |
| LAB553 | 66059.1 | 4.9 | 0.12 | 8 | 8.5 | 0.17 | 16 | 67.8 | 0.17 | 16 |
| LAB553 | 66060.1 | 4.9 | 0.07 | 9 | 9 | 0.05 | 24 | 72.1 | 0.05 | 24 |
| LAB553 | 66061.2 | 4.9 | 0.2 | 8 | 8.4 | 0.15 | 15 | — | — | — |
| LAB553 | 66061.3 | 5.3 | 0.1 | 18 | 10.2 | 0.01 | 40 | 81.8 | 0.01 | 40 |
| LAB546 | 65156.2 | 5 | 0.04 | 11 | 8.6 | 0.05 | 19 | 69.1 | 0.05 | 19 |
| LAB539 | 66136.2 | 5 | 0.13 | 11 | 9 | 0.12 | 23 | 71.8 | 0.12 | 23 |
| LAB519 | 66324.1 | 4.7 | 0.28 | 5 | 7.9 | 0.28 | 9 | 63.4 | 0.28 | 9 |
| LAB516 | 65870.3 | 4.8 | 0.24 | 6 | 8.4 | 0.18 | 15 | 66.9 | 0.18 | 15 |
| LAB516 | 65875.2 | 4.8 | 0.16 | 6 | 8.8 | 0.03 | 21 | 70.8 | 0.03 | 21 |
| LAB511 | 66254.3 | — | — | — | 8.1 | 0.18 | 11 | 64.9 | 0.18 | 11 |
| LAB511 | 66258.4 | 4.8 | 0.25 | 7 | 8.6 | 0.21 | 18 | 68.6 | 0.21 | 18 |
| LAB492 | 66053.3 | 5.2 | 0.27 | 15 | — | — | — | — | — | — |
| LAB492 | 66053.4 | 4.9 | 0.28 | 9 | 8.5 | 0.17 | 17 | 68.3 | 0.17 | 17 |
| LAB474 | 66475.1 | 5.1 | 0.03 | 12 | 9.4 | L | 29 | 75.1 | L | 29 |
| LAB474 | 66475.2 | 4.8 | 0.15 | 7 | 8.4 | 0.17 | 15 | 67.3 | 0.17 | 15 |
| LAB465 | 66112.4 | 4.7 | 0.28 | 5 | 8.2 | 0.13 | 13 | 65.7 | 0.13 | 13 |
| LAB465 | 66114.1 | 5.3 | 0.2 | 17 | 10.1 | 0.09 | 38 | 80.6 | 0.09 | 38 |
| LAB465 | 66114.2 | 5 | 0.06 | 10 | 8.4 | 0.09 | 15 | 67 | 0.09 | 15 |
| LAB444 | 65085.1 | 5.1 | 0.05 | 12 | 9.6 | 0.01 | 31 | 76.4 | 0.01 | 31 |
| LAB444 | 65085.4 | 5 | 0.24 | 10 | 8.7 | 0.28 | 19 | 69.4 | 0.28 | 19 |
| LAB444 | 65086.1 | 4.8 | 0.29 | 7 | 8.2 | 0.13 | 13 | 66 | 0.13 | 13 |
| LAB437 | 66452.2 | 5 | 0.19 | 10 | — | — | — | — | — | — |
| LAB437 | 66454.2 | — | — | — | 8.5 | 0.13 | 17 | 68 | 0.13 | 17 |
| LAB434 | 66446.1 | — | — | — | 8.1 | 0.27 | 11 | 64.7 | 0.27 | 11 |
| LAB434 | 66448.4 | 4.8 | 0.25 | 6 | 8.2 | 0.2 | 12 | 65.4 | 0.2 | 12 |
| LAB434 | 66449.3 | 4.9 | 0.08 | 9 | 8.6 | 0.05 | 18 | 69 | 0.05 | 18 |
| LAB427 | 65544.1 | 4.8 | 0.21 | 6 | 8.4 | 0.09 | 15 | 67 | 0.09 | 15 |
| CONT. | — | 4.5 | — | — | 7.3 | — | — | 58.3 | — | — |
| LAB550 | 65902.4 | 5 | 0.13 | 5 | 9.6 | 0.2 | 6 | 76.7 | 0.2 | 6 |
| LAB530 | 66264.2 | 5.2 | 0.03 | 8 | 10.1 | 0.03 | 12 | 81 | 0.03 | 12 |
| LAB484 | 65847.2 | 5 | 0.09 | 4 | — | — | — | — | — | — |
| LAB484 | 65848.3 | 5.1 | 0.01 | 7 | 9.6 | 0.18 | 7 | 76.7 | 0.18 | 7 |
| LAB452 | 66171.3 | 4.9 | 0.15 | 3 | — | — | — | — | — | — |
| LAB437 | 66452.4 | 4.9 | 0.26 | 2 | — | — | — | — | — | — |
| LAB437 | 66454.4 | 5.1 | 0.03 | 6 | 10.1 | 0.03 | 12 | 81 | 0.03 | 12 |
| LAB432 | 66003.4 | 4.9 | 0.26 | 2 | — | — | — | — | — | — |

TABLE 107-continued

Genes showing improved plant performance and biomass production under drought conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB432 | 66004.5 | 5 | 0.14 | 4 | 9.6 | 0.2 | 6 | 76.4 | 0.2 | 6 |
| LAB399 | 65504.4 | 5 | 0.22 | 5 | — | — | — | — | — | — |
| CONT. | — | 4.8 | — | — | 9 | — | — | 72 | — | — |
| LAB610 | 65342.3 | 4.7 | L | 17 | 9.6 | L | 34 | 76.8 | L | 34 |
| LAB596 | 65594.2 | 4.6 | 0.25 | 13 | 8.8 | 0.19 | 22 | 70.3 | 0.19 | 22 |
| LAB596 | 65597.1 | 4.5 | L | 11 | 8.4 | 0.11 | 17 | 67.3 | 0.11 | 17 |
| LAB590 | 65347.2 | — | — | — | 8 | 0.22 | 12 | 64.2 | 0.22 | 12 |
| LAB590 | 65348.1 | 4.3 | 0.29 | 6 | — | — | — | — | — | — |
| LAB590 | 65349.4 | 4.4 | 0.03 | 8 | 8.3 | 0.05 | 15 | 66 | 0.05 | 15 |
| LAB590 | 65350.2 | 4.4 | 0.05 | 9 | 8 | 0.07 | 11 | 63.7 | 0.07 | 11 |
| LAB577 | 65575.2 | 4.4 | 0.02 | 8 | 8 | 0.05 | 12 | 64.3 | 0.05 | 12 |
| LAB577 | 65577.3 | 4.2 | 0.23 | 3 | — | — | — | — | — | — |
| LAB577 | 65578.4 | 4.6 | 0.09 | 14 | 9.1 | 0.07 | 27 | 73.2 | 0.07 | 27 |
| LAB577 | 65579.2 | 4.2 | 0.11 | 5 | 7.7 | 0.21 | 7 | 61.6 | 0.21 | 7 |
| LAB565 | 65724.2 | 4.2 | 0.11 | 4 | — | — | — | — | — | — |
| LAB557 | 65317.4 | 4.3 | 0.17 | 6 | — | — | — | — | — | — |
| LAB557 | 65317.6 | 4.3 | 0.28 | 6 | — | — | — | — | — | — |
| LAB557 | 65318.2 | 4.2 | 0.1 | 4 | — | — | — | — | — | — |
| LAB552 | 65312.1 | 4.3 | 0.06 | 5 | 7.8 | 0.22 | 9 | 62.7 | 0.22 | 9 |
| LAB531 | 65678.1 | 4.4 | 0.2 | 9 | 8.4 | 0.14 | 17 | 67 | 0.14 | 17 |
| LAB531 | 65681.4 | 4.3 | 0.03 | 6 | 7.8 | 0.11 | 9 | 62.6 | 0.11 | 9 |
| LAB527 | 65673.2 | 4.3 | 0.09 | 6 | 7.8 | 0.23 | 9 | 62.5 | 0.23 | 9 |
| LAB527 | 65675.3 | 4.4 | 0.18 | 9 | 8.4 | 0.24 | 17 | 67.3 | 0.24 | 17 |
| LAB523 | 65660.3 | 4.3 | 0.22 | 5 | — | — | — | — | — | — |
| LAB523 | 65661.2 | 4.2 | 0.14 | 4 | 7.6 | 0.23 | 7 | 61.2 | 0.23 | 7 |
| LAB523 | 65663.5 | 4.3 | 0.25 | 7 | — | — | — | — | — | — |
| LAB494 | 65650.1 | 4.2 | 0.16 | 4 | — | — | — | — | — | — |
| LAB494 | 65651.4 | 4.2 | 0.22 | 4 | — | — | — | — | — | — |
| LAB409 | 65524.2 | 4.2 | 0.22 | 3 | — | — | — | — | — | — |
| LAB409 | 65524.5 | 4.6 | L | 13 | 8.8 | 0.01 | 22 | 70 | 0.01 | 22 |
| LAB409 | 65525.2 | 4.3 | 0.09 | 6 | 8 | 0.11 | 11 | 63.8 | 0.11 | 11 |
| LAB409 | 65526.1 | 4.3 | 0.03 | 6 | 8.2 | 0.03 | 14 | 65.3 | 0.03 | 14 |
| LAB401 | 65728.1 | 4.5 | L | 11 | 8.6 | L | 19 | 68.5 | L | 19 |
| LAB401 | 65729.2 | 4.4 | 0.08 | 9 | 8.1 | 0.06 | 13 | 64.8 | 0.06 | 13 |
| LAB400 | 65509.2 | 4.3 | 0.06 | 5 | 7.9 | 0.11 | 10 | 63 | 0.11 | 10 |
| LAB400 | 65510.2 | 4.6 | 0.03 | 13 | 9.2 | 0.15 | 28 | 73.3 | 0.15 | 28 |
| CONT. | — | 4.1 | — | — | 7.2 | — | — | 57.4 | — | — |
| LAB608 | 65907.2 | 5.3 | 0.04 | 11 | 9.3 | 0.14 | 14 | 74.5 | 0.14 | 14 |
| LAB590 | 65348.1 | — | — | — | 9 | 0.26 | 10 | 71.6 | 0.26 | 10 |
| LAB565 | 65722.3 | 5.1 | 0.15 | 7 | — | — | — | — | — | — |
| LAB565 | 65724.2 | 5.3 | 0.25 | 11 | 10.4 | 0.19 | 27 | 83 | 0.19 | 27 |
| LAB558 | 65323.1 | 5.1 | 0.23 | 6 | 9.1 | 0.25 | 11 | 72.4 | 0.25 | 11 |
| LAB557 | 65318.2 | 5.4 | 0.08 | 13 | 9.9 | 0.08 | 21 | 78.9 | 0.08 | 21 |
| LAB557 | 65320.2 | 5.4 | 0.03 | 12 | 9.9 | 0.13 | 21 | 78.8 | 0.13 | 21 |
| LAB557 | 65320.3 | 5.2 | 0.11 | 8 | 9.4 | 0.11 | 15 | 75.1 | 0.11 | 15 |
| LAB535 | 65688.1 | 5.4 | 0.04 | 13 | 10.6 | 0.03 | 29 | 84.6 | 0.03 | 29 |
| LAB531 | 65681.4 | 5.3 | 0.15 | 10 | 10 | 0.17 | 23 | 80.1 | 0.17 | 23 |
| LAB522 | 65130.6 | 5.3 | 0.03 | 12 | 10.1 | 0.03 | 24 | 80.9 | 0.03 | 24 |
| LAB522 | 65131.2 | 5.3 | 0.06 | 10 | 9.9 | 0.07 | 21 | 79.1 | 0.07 | 21 |
| LAB516 | 65871.1 | 5.6 | 0.02 | 18 | 10.9 | 0.24 | 33 | 86.9 | 0.24 | 33 |
| LAB516 | 65874.2 | 5.2 | 0.08 | 10 | 9.9 | 0.05 | 22 | 79.5 | 0.05 | 22 |
| LAB494 | 65649.3 | 5.7 | 0.02 | 20 | 11.8 | L | 44 | 94.1 | L | 44 |
| LAB427 | 65544.1 | 5 | 0.3 | 5 | — | — | — | — | — | — |
| LAB409 | 65524.5 | 5 | 0.28 | 5 | — | — | — | — | — | — |
| CONT. | — | 4.8 | — | — | 8.2 | — | — | 65.3 | — | — |
| LAB544 | 65690.4 | 4.6 | 0.07 | 6 | — | — | — | — | — | — |
| LAB544 | 65694.1 | 4.9 | 0.1 | 14 | 8.9 | 0.19 | 20 | 70.8 | 0.19 | 20 |
| LAB509 | 65119.2 | 4.5 | 0.24 | 4 | — | — | — | — | — | — |
| LAB425 | 65538.2 | 4.6 | 0.05 | 7 | — | — | — | — | — | — |
| CONT. | — | 4.3 | — | — | 7.4 | — | — | 58.8 | — | — |
| LAB597 | 66273.1 | 4.8 | 0.23 | 6 | 8.5 | 0.17 | 11 | 67.7 | 0.17 | 11 |
| LAB588 | 66335.1 | 4.9 | 0.08 | 8 | 8.9 | 0.06 | 17 | 71.2 | 0.06 | 17 |
| LAB588 | 66336.3 | 4.8 | 0.23 | 6 | 9 | 0.04 | 19 | 72.3 | 0.04 | 19 |
| LAB584 | 66075.3 | 5.2 | L | 16 | 10.2 | L | 34 | 81.3 | L | 34 |
| LAB584 | 66077.2 | 4.9 | 0.08 | 8 | 8.9 | 0.06 | 18 | 71.5 | 0.06 | 18 |
| LAB564 | 66063.4 | 4.8 | 0.13 | 6 | 8.8 | 0.06 | 16 | 70.7 | 0.06 | 16 |
| LAB564 | 66065.2 | — | — | — | 8.7 | 0.26 | 15 | 69.8 | 0.26 | 15 |
| LAB553 | 66057.1 | 4.9 | 0.05 | 9 | 9.5 | 0.01 | 26 | 76.4 | 0.01 | 26 |
| LAB553 | 66061.2 | 4.8 | 0.26 | 6 | 8.5 | 0.16 | 12 | 68 | 0.16 | 12 |
| LAB553 | 66061.3 | 5.1 | 0.03 | 13 | 9.7 | L | 28 | 77.7 | L | 28 |
| LAB539 | 66135.4 | 4.9 | 0.08 | 8 | 9.1 | 0.03 | 20 | 72.8 | 0.03 | 20 |

TABLE 107-continued

Genes showing improved plant performance and biomass production under drought conditions

| Gene Name | Event # | Rosette Diameter [cm] Ave. | P-Val. | % Incr. | Rosette Area [cm$^2$] Ave. | P-Val. | % Incr. | Plot Coverage [cm$^2$] Ave. | P-Val. | % Incr. |
|---|---|---|---|---|---|---|---|---|---|---|
| LAB539 | 66136.2 | 5.4 | 0.02 | 19 | 10.8 | 0.05 | 42 | 86.2 | 0.05 | 42 |
| LAB539 | 66138.2 | 5 | 0.1 | 10 | 9.7 | 0.05 | 27 | 77.5 | 0.05 | 27 |
| LAB519 | 66321.2 | 4.8 | 0.16 | 6 | 8.9 | 0.22 | 17 | 71 | 0.22 | 17 |
| LAB519 | 66324.1 | 4.8 | 0.15 | 7 | 9.1 | 0.06 | 19 | 72.5 | 0.06 | 19 |
| LAB511 | 66255.1 | 4.8 | 0.19 | 6 | 8.3 | 0.24 | 9 | 66.4 | 0.24 | 9 |
| LAB492 | 66051.3 | 5.1 | 0.03 | 12 | 9.5 | 0.04 | 25 | 76 | 0.04 | 25 |
| LAB492 | 66054.4 | 4.9 | 0.15 | 7 | 9.1 | 0.05 | 20 | 72.8 | 0.05 | 20 |
| LAB480 | 66248.5 | 4.7 | 0.27 | 5 | — | — | — | — | — | — |
| LAB474 | 66470.2 | 4.8 | 0.23 | 5 | 8.3 | 0.26 | 10 | 66.7 | 0.26 | 10 |
| LAB471 | 66188.2 | — | — | — | 8.5 | 0.13 | 12 | 67.9 | 0.13 | 12 |
| LAB471 | 66190.2 | — | — | — | 8.4 | 0.18 | 10 | 67 | 0.18 | 10 |
| LAB471 | 66191.2 | 5 | 0.12 | 10 | 9.5 | 0.01 | 25 | 75.7 | 0.01 | 25 |
| LAB465 | 66111.2 | — | — | — | 9.1 | 0.22 | 19 | 72.6 | 0.22 | 19 |
| LAB465 | 66114.2 | 4.9 | 0.25 | 8 | 9.2 | 0.25 | 21 | 73.3 | 0.25 | 21 |
| LAB447 | 66353.4 | — | — | — | 8.3 | 0.22 | 9 | 66.2 | 0.22 | 9 |
| LAB434 | 66447.4 | 4.8 | 0.2 | 6 | 8.4 | 0.16 | 11 | 67.3 | 0.16 | 11 |
| LAB434 | 66448.2 | 5 | 0.04 | 10 | 9.2 | 0.03 | 21 | 73.5 | 0.03 | 21 |
| LAB434 | 66448.4 | 4.9 | 0.06 | 9 | 9.2 | 0.02 | 21 | 73.4 | 0.02 | 21 |
| LAB393 | 66288.2 | 4.8 | 0.11 | 7 | 8.9 | 0.08 | 18 | 71.4 | 0.08 | 18 |
| CONT. | — | 4.5 | — | — | 7.6 | — | — | 60.8 | — | — |

Table 107.
"CONT."—Control;
"Ave."—Average;
"% Incr." = % increment;
"p-Val."—p-value,
L—p < 0.01.

TABLE 108

Genes showing improved plant performance and photosynthetic capacity under drought conditions

| Gene Name | Event # | Leaf Number Ave. | P-Val. | % Incr. | Leaf Blade Area [cm$^2$] Ave | P-Val | % Incr. | Leaf Petiole Length [cm] Ave. | P-Val. | % Incr. |
|---|---|---|---|---|---|---|---|---|---|---|
| LAB557 | 65318.2 | 10.625 | 0.003 | 14 | 1.36 | 0.039 | 19 | — | — | — |
| CONT. | — | 9.312 | — | — | 1.14 | — | — | — | — | — |
| LAB396 | 65926.1 | 12.1 | 0.2 | 3 | — | — | — | — | — | — |
| CONT. | — | 11.8 | — | — | — | — | — | — | — | — |
| LAB604 | 66498.2 | 11.3 | 0.21 | 4 | — | — | — | — | — | — |
| LAB593 | 66340.1 | 11.2 | 0.2 | 4 | — | — | — | — | — | — |
| LAB575 | 66782.6 | 11.2 | 0.22 | 4 | — | — | — | — | — | — |
| LAB508 | 66729.2 | 11.7 | 0.05 | 8 | — | — | — | — | — | — |
| LAB508 | 66733.4 | 11.2 | 0.22 | 4 | — | — | — | — | — | — |
| LAB470 | 66627.2 | 11.4 | 0.08 | 6 | — | — | — | — | — | — |
| LAB470 | 66630.1 | 11.4 | 0.08 | 6 | — | — | — | — | — | — |
| LAB462 | 66617.3 | 11.8 | 0.02 | 8 | — | — | — | — | — | — |
| LAB454 | 66813.3 | 11.6 | 0.05 | 7 | — | — | — | — | — | — |
| LAB424 | 66713.2 | 11.3 | 0.21 | 4 | — | — | — | — | — | — |
| LAB422 | 65937.4 | 11.7 | 0.14 | 8 | — | — | — | — | — | — |
| LAB404 | 66778.1 | 11.9 | 0.17 | 10 | — | — | — | — | — | — |
| LAB404 | 66778.2 | 11.4 | 0.08 | 6 | — | — | — | — | — | — |
| LAB403 | 66802.7 | 11.6 | 0.1 | 7 | — | — | — | — | — | — |
| LAB402 | 66570.3 | 11.6 | 0.18 | 7 | — | — | — | — | — | — |
| CONT. | — | 10.8 | — | — | — | — | — | — | — | — |
| LAB604 | 66496.1 | 11.9 | 0.2 | 3 | — | — | — | — | — | — |
| LAB593 | 66340.2 | 12.2 | 0.12 | 7 | — | — | — | — | — | — |
| LAB593 | 66341.1 | 12.8 | 0.07 | 11 | — | — | — | — | — | — |
| LAB575 | 66783.2 | 13.3 | 0.04 | 16 | — | — | — | — | — | — |
| LAB508 | 66729.1 | 11.9 | 0.2 | 3 | — | — | — | — | — | — |
| LAB508 | 66729.2 | 12.4 | 0.12 | 8 | — | — | — | — | — | — |
| LAB507 | 66794.8 | 12 | 0.1 | 4 | — | — | — | — | — | — |
| LAB507 | 66798.2 | 11.9 | 0.2 | 3 | — | — | — | — | — | — |
| LAB472 | 66717.5 | 12 | 0.1 | 4 | — | — | — | — | — | — |
| LAB472 | 66718.7 | 12.2 | 0.21 | 6 | — | — | — | — | — | — |

TABLE 108-continued

Genes showing improved plant performance and photosynthetic capacity under drought conditions

| Gene Name | Event # | Leaf Number | | | Leaf Blade Area [cm$^2$] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| LAB472 | 66719.1 | 11.9 | 0.11 | 4 | — | — | — | — | — | — |
| LAB472 | 66719.3 | 12.1 | 0.04 | 5 | — | — | — | — | — | — |
| LAB470 | 66630.1 | 11.9 | 0.2 | 3 | — | — | — | — | — | — |
| LAB466 | 66621.2 | 12.4 | 0.12 | 8 | — | — | — | — | — | — |
| LAB466 | 66622.5 | 12.3 | 0.16 | 7 | — | — | — | — | — | — |
| LAB462 | 66615.1 | 11.8 | 0.23 | 3 | — | — | — | — | — | — |
| LAB462 | 66615.11 | 12.2 | 0.08 | 6 | — | — | — | — | — | — |
| LAB454 | 66813.3 | 12.3 | 0.05 | 7 | — | — | — | — | — | — |
| LAB438 | 66460.1 | 12.2 | 0.03 | 6 | — | — | — | — | — | — |
| LAB422 | 65936.2 | 12.5 | 0.26 | 9 | — | — | — | — | — | — |
| LAB422 | 65938.3 | 12.1 | 0.04 | 5 | — | — | — | — | — | — |
| LAB422 | 65939.2 | 13.1 | 0.18 | 14 | — | — | — | — | — | — |
| LAB418 | 66829.2 | 12.4 | 0.3 | 8 | — | — | — | — | — | — |
| LAB412 | 66698.2 | 12.5 | 0.26 | 9 | — | — | — | — | — | — |
| LAB404 | 66778.2 | 13.1 | 0.2 | 14 | — | — | — | — | — | — |
| LAB404 | 66780.6 | 11.9 | 0.11 | 4 | — | — | — | — | — | — |
| LAB403 | 66802.6 | 12.4 | 0.03 | 8 | — | — | — | — | — | — |
| LAB402 | 66567.1 | 12.1 | 0.04 | 5 | — | — | — | — | — | — |
| LAB402 | 66568.1 | 12.2 | 0.12 | 7 | — | — | — | — | — | — |
| CONT. | — | 11.5 | — | — | — | — | — | — | — | — |
| LAB609 | 65709.3 | 11.2 | 0.02 | 10 | — | — | — | — | — | — |
| LAB609 | 65710.2 | 10.8 | 0.13 | 5 | — | — | — | — | — | — |
| LAB585 | 65398.1 | 12.3 | L | 20 | — | — | — | — | — | — |
| LAB585 | 65399.1 | 10.7 | 0.22 | 4 | — | — | — | — | — | — |
| LAB534 | 65877.3 | 11.2 | 0.11 | 9 | — | — | — | — | — | — |
| LAB468 | 65836.2 | 10.6 | 0.28 | 4 | — | — | — | — | — | — |
| LAB460 | 65647.4 | 10.8 | 0.19 | 5 | — | — | — | — | — | — |
| LAB458 | 65804.3 | 10.6 | 0.28 | 4 | — | — | — | — | — | — |
| LAB458 | 65805.3 | 10.7 | 0.28 | 4 | — | — | — | — | — | — |
| CONT. | — | 10.2 | — | — | — | — | — | — | — | — |
| LAB576 | 65329.2 | 11.4 | 0.03 | 10 | — | — | — | — | — | — |
| LAB576 | 65332.3 | 11.1 | 0.09 | 7 | — | — | — | — | — | — |
| LAB546 | 65155.2 | 11.5 | 0.02 | 11 | — | — | — | — | — | — |
| LAB546 | 65156.1 | 11.1 | 0.09 | 7 | — | — | — | — | — | — |
| LAB546 | 65156.2 | 11 | 0.13 | 6 | — | — | — | — | — | — |
| LAB544 | 65690.1 | 11 | 0.13 | 6 | — | — | — | — | — | — |
| LAB544 | 65693.2 | 11.1 | 0.13 | 7 | — | — | — | — | — | — |
| LAB544 | 65694.1 | 11.8 | 0.14 | 13 | — | — | — | — | — | — |
| LAB524 | 65135.1 | 11.6 | 0.17 | 12 | — | — | — | — | — | — |
| LAB524 | 65136.1 | 11.1 | 0.23 | 7 | — | — | — | — | — | — |
| LAB513 | 65125.1 | 11.1 | 0.09 | 7 | — | — | — | — | — | — |
| LAB509 | 65118.3 | 12.1 | L | 16 | — | — | — | — | — | — |
| LAB509 | 65119.5 | 11.9 | 0.02 | 15 | — | — | — | — | — | — |
| LAB505 | 65105.1 | 11.1 | 0.13 | 7 | — | — | — | — | — | — |
| LAB505 | 65110.4 | 10.9 | 0.19 | 6 | — | — | — | — | — | — |
| LAB449 | 65098.5 | 11 | 0.13 | 6 | — | — | — | — | — | — |
| LAB446 | 65091.2 | 11.8 | 0.07 | 13 | — | — | — | — | — | — |
| LAB446 | 65094.1 | 11.4 | 0.03 | 10 | — | — | — | — | — | — |
| LAB444 | 65085.4 | 11 | 0.13 | 6 | — | — | — | — | — | — |
| LAB444 | 65087.1 | 11.6 | 0.22 | 12 | — | — | — | — | — | — |
| LAB442 | 65545.3 | 10.8 | 0.29 | 4 | — | — | — | — | — | — |
| LAB428 | 65079.1 | 11.2 | 0.25 | 8 | — | — | — | — | — | — |
| LAB428 | 65082.3 | 11.3 | 0.29 | 9 | — | — | — | — | — | — |
| CONT. | — | 10.4 | — | — | — | — | — | — | — | — |
| LAB588 | 66332.2 | 11.4 | 0.13 | 10 | — | — | — | — | — | — |
| LAB584 | 66074.5 | 11.2 | L | 8 | — | — | — | — | — | — |
| LAB584 | 66075.2 | 11.1 | L | 7 | — | — | — | — | — | — |
| LAB576 | 65331.1 | 10.8 | 0.19 | 4 | — | — | — | — | — | — |
| LAB576 | 65332.2 | 11.6 | L | 11 | — | — | — | — | — | — |
| LAB576 | 65332.3 | 10.9 | 0.12 | 5 | — | — | — | — | — | — |
| LAB564 | 66065.2 | 10.6 | 0.28 | 2 | — | — | — | — | — | — |
| LAB553 | 66057.1 | 11 | 0.03 | 6 | — | — | — | — | — | — |
| LAB553 | 66059.1 | 11.1 | 0.02 | 7 | — | — | — | — | — | — |
| LAB553 | 66061.2 | 11.2 | 0.11 | 8 | — | — | — | — | — | — |
| LAB553 | 66061.3 | 11.1 | L | 7 | — | — | — | — | — | — |
| LAB546 | 65153.2 | 11.6 | L | 12 | — | — | — | — | — | — |
| LAB539 | 66137.4 | 11.8 | L | 13 | — | — | — | — | — | — |
| LAB519 | 66321.1 | 10.8 | 0.12 | 4 | — | — | — | — | — | — |
| LAB516 | 65875.2 | 11 | 0.03 | 6 | — | — | — | — | — | — |
| LAB513 | 65124.5 | 11.2 | L | 8 | — | — | — | — | — | — |
| LAB511 | 66258.4 | 11.5 | 0.07 | 11 | — | — | — | — | — | — |

TABLE 108-continued

Genes showing improved plant performance and photosynthetic capacity under drought conditions

| Gene Name | Event # | Leaf Number | | | Leaf Blade Area [cm$^2$] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| LAB492 | 66053.3 | 10.9 | 0.24 | 5 | — | — | — | — | — | — |
| LAB492 | 66053.4 | 11.2 | 0.01 | 8 | — | — | — | — | — | — |
| LAB492 | 66054.4 | 11.6 | L | 11 | — | — | — | — | — | — |
| LAB474 | 66470.2 | 10.9 | 0.24 | 5 | — | — | — | — | — | — |
| LAB474 | 66475.1 | 11.4 | 0.09 | 10 | — | — | — | — | — | — |
| LAB474 | 66475.2 | 11.1 | 0.02 | 7 | — | — | — | — | — | — |
| LAB465 | 66112.2 | 11.3 | L | 9 | — | — | — | — | — | — |
| LAB465 | 66112.4 | 11 | L | 6 | — | — | — | — | — | — |
| LAB465 | 66114.1 | 11.7 | 0.18 | 13 | — | — | — | — | — | — |
| LAB444 | 65085.1 | 11.1 | 0.23 | 7 | — | — | — | — | — | — |
| LAB444 | 65086.1 | 10.9 | 0.24 | 5 | — | — | — | — | — | — |
| LAB437 | 66452.2 | 10.8 | 0.03 | 4 | — | — | — | — | — | — |
| LAB437 | 66454.2 | 11.4 | 0.22 | 10 | — | — | — | — | — | — |
| LAB434 | 66448.2 | 11.3 | L | 9 | — | — | — | — | — | — |
| LAB434 | 66448.4 | 10.7 | 0.09 | 3 | — | — | — | — | — | — |
| LAB434 | 66449.3 | 11.8 | 0.22 | 14 | — | — | — | — | — | — |
| LAB427 | 65543.2 | 10.7 | 0.09 | 3 | — | — | — | — | — | — |
| LAB427 | 65544.1 | 11.1 | 0.14 | 7 | — | — | — | — | — | — |
| CONT. | — | 10.4 | — | — | — | — | — | — | — | — |
| LAB554 | 66236.3 | 11.8 | 0.1 | 5 | — | — | — | — | — | — |
| LAB554 | 66237.5 | 11.6 | 0.22 | 3 | — | — | — | — | — | — |
| LAB550 | 65902.4 | 12.3 | 0.02 | 10 | — | — | — | — | — | — |
| LAB547 | 65824.2 | 11.8 | 0.26 | 5 | — | — | — | — | — | — |
| LAB530 | 66262.2 | 11.9 | 0.03 | 6 | — | — | — | — | — | — |
| LAB530 | 66264.2 | 11.8 | 0.12 | 5 | — | — | — | — | — | — |
| LAB503 | 66216.2 | 11.7 | 0.19 | 4 | — | — | — | — | — | — |
| LAB502 | 65975.1 | 12.1 | 0.15 | 7 | — | — | — | — | — | — |
| LAB483 | 65841.2 | 11.8 | 0.08 | 5 | — | — | — | — | — | — |
| LAB483 | 65843.2 | 12.3 | L | 10 | — | — | — | — | — | — |
| LAB483 | 65844.2 | 12.1 | 0.02 | 8 | — | — | — | — | — | — |
| LAB453 | 66176.2 | 11.6 | 0.22 | 3 | — | — | — | — | — | — |
| LAB437 | 66452.4 | 12 | 0.03 | 7 | — | — | — | — | — | — |
| LAB437 | 66453.4 | 11.9 | 0.04 | 6 | — | — | — | — | — | — |
| LAB437 | 66454.2 | 12.1 | 0.01 | 8 | — | — | — | — | — | — |
| LAB437 | 66454.4 | 11.8 | 0.26 | 5 | — | — | — | — | — | — |
| LAB432 | 66003.4 | 11.6 | 0.19 | 4 | — | — | — | — | — | — |
| LAB432 | 66004.4 | 11.6 | 0.19 | 4 | — | — | — | — | — | — |
| LAB399 | 65506.1 | 11.6 | 0.19 | 4 | — | — | — | — | — | — |
| CONT. | — | 11.2 | — | — | — | — | — | — | — | — |
| LAB610 | 65342.3 | 12.3 | 0.08 | 6 | — | — | — | — | — | — |
| LAB596 | 65593.5 | 11.9 | 0.26 | 3 | — | — | — | — | — | — |
| LAB590 | 65349.4 | 12.8 | 0.12 | 10 | — | — | — | — | — | — |
| LAB590 | 65350.2 | 12.6 | 0.01 | 8 | — | — | — | — | — | — |
| LAB578 | 65581.2 | 12.2 | 0.29 | 6 | — | — | — | — | — | — |
| LAB577 | 65577.4 | 12 | 0.19 | 3 | — | — | — | — | — | — |
| LAB531 | 65678.1 | 12.2 | 0.26 | 5 | — | — | — | — | — | — |
| LAB522 | 65130.6 | 11.9 | 0.26 | 3 | — | — | — | — | — | — |
| LAB494 | 65649.3 | 12.2 | 0.29 | 6 | — | — | — | — | — | — |
| LAB401 | 65731.2 | 12.5 | 0.18 | 8 | — | — | — | — | — | — |
| LAB400 | 65510.2 | 12.4 | 0.02 | 7 | — | — | — | — | — | — |
| CONT. | — | 11.6 | — | — | — | — | — | — | — | — |
| LAB608 | 65907.2 | 11.4 | 0.05 | 7 | — | — | — | — | — | — |
| LAB596 | 65595.2 | 11.2 | 0.2 | 5 | — | — | — | — | — | — |
| LAB590 | 65347.2 | — | — | — | — | — | — | — | — | — |
| LAB590 | 65349.4 | 11.3 | 0.07 | 6 | — | — | — | — | — | — |
| LAB590 | 65350.2 | 11.1 | 0.19 | 4 | — | — | — | — | — | — |
| LAB565 | 65722.3 | 11.1 | 0.29 | 4 | — | — | — | — | — | — |
| LAB565 | 65724.2 | 11.9 | 0.11 | 11 | — | — | — | — | — | — |
| LAB558 | 65327.4 | 11.1 | 0.29 | 4 | — | — | — | — | — | — |
| LAB557 | 65317.4 | 11.2 | 0.11 | 5 | — | — | — | — | — | — |
| LAB557 | 65318.2 | 11.1 | 0.29 | 4 | — | — | — | — | — | — |
| LAB552 | 65311.1 | 11.1 | 0.17 | 4 | — | — | — | — | — | — |
| LAB531 | 65680.1 | 11.1 | 0.29 | 4 | — | — | — | — | — | — |
| LAB531 | 65681.4 | 11.5 | 0.03 | 8 | — | — | — | — | — | — |
| LAB527 | 65672.2 | 11.3 | 0.07 | 6 | — | — | — | — | — | — |
| LAB522 | 65131.5 | 11.4 | 0.06 | 7 | — | — | — | — | — | — |
| LAB494 | 65649.3 | 11.1 | 0.29 | 4 | — | — | — | — | — | — |
| LAB409 | 65524.5 | 11.4 | 0.17 | 7 | — | — | — | — | — | — |
| LAB401 | 65728.4 | 11.3 | 0.23 | 6 | — | — | — | — | — | — |
| CONT. | — | 10.7 | — | — | — | — | — | — | — | — |
| LAB597 | 66272.8 | 11.5 | 0.25 | 2 | — | — | — | — | — | — |

TABLE 108-continued

Genes showing improved plant performance and photosynthetic capacity under drought conditions

| Gene Name | Event # | Leaf Number Ave. | P-Val. | % Incr. | Leaf Blade Area [cm²] Ave | P-Val | % Incr. | Leaf Petiole Length [cm] Ave. | P-Val. | % Incr. |
|---|---|---|---|---|---|---|---|---|---|---|
| LAB588 | 66332.2 | 11.7 | 0.04 | 4 | — | — | — | — | — | — |
| LAB588 | 66335.1 | 12.2 | L | 9 | — | — | — | — | — | — |
| LAB588 | 66336.3 | 12.8 | L | 14 | — | — | — | — | — | — |
| LAB584 | 66075.3 | 11.9 | L | 6 | — | — | — | — | — | — |
| LAB584 | 66077.2 | 11.8 | 0.11 | 5 | — | — | — | — | — | — |
| LAB564 | 66064.2 | 11.7 | 0.04 | 4 | — | — | — | — | — | — |
| LAB564 | 66065.2 | 11.9 | 0.17 | 6 | — | — | — | — | — | — |
| LAB553 | 66057.1 | 12.4 | 0.02 | 11 | — | — | — | — | — | — |
| LAB553 | 66061.2 | 11.5 | 0.16 | 2 | — | — | — | — | — | — |
| LAB539 | 66135.4 | 11.7 | 0.04 | 4 | — | — | — | — | — | — |
| LAB539 | 66136.2 | 12.2 | 0.04 | 9 | — | — | — | — | — | — |
| LAB539 | 66137.4 | 11.8 | 0.11 | 5 | — | — | — | — | — | — |
| LAB492 | 66051.3 | 12 | 0.02 | 7 | — | — | — | — | — | — |
| LAB480 | 66248.3 | 11.6 | 0.28 | 3 | — | — | — | — | — | — |
| LAB474 | 66470.2 | 11.7 | 0.04 | 4 | — | — | — | — | — | — |
| LAB474 | 66470.4 | 12.4 | L | 10 | — | — | — | — | — | — |
| LAB465 | 66111.2 | 11.7 | 0.17 | 4 | — | — | — | — | — | — |
| LAB465 | 66114.2 | 12 | 0.02 | 7 | — | — | — | — | — | — |
| LAB434 | 66446.1 | 11.4 | 0.28 | 2 | — | — | — | — | — | — |
| LAB434 | 66447.4 | 11.6 | 0.06 | 4 | — | — | — | — | — | — |
| LAB407 | 66244.2 | 12.1 | 0.28 | 7 | — | — | — | — | — | — |
| LAB393 | 66288.2 | 12.1 | 0.05 | 7 | — | — | — | — | — | — |
| LAB393 | 66288.3 | 12.1 | 0.17 | 7 | — | — | — | — | — | — |
| CONT. | — | 11.2 | — | — | — | — | — | — | — | — |

Table 108.
"CONT."—Control;
"Ave."—Average;
"% Incr." = % increment;
"p-Val."—p-value;
L—p < 0.01.

TABLE 109

Genes showing improved plant performance under drought conditions

| | | Petiole Relative Area [%] | | |
|---|---|---|---|---|
| Gene Name | Event # | Ave. | P-Val. | % Incr. |
| LAB588 | 66332.2 | 12.536 | 0.055 | 12 |
| CONT. | — | 11.188 | — | — |

Table 114.
"CONT."—Control;
"Ave."—Average;
"% Incr." = % increment;
"p-val."—p-value;
L—p < 0.01.

The genes listed in Table 110 improved plant ABST when grown under drought conditions. These genes produced faster developing plants when grown under drought conditions, compared to control plants as measured by growth rate of leaf number, rosette diameter and plot coverage.

TABLE 110

Genes showing improved plant and rosette growth performance under drought conditions

| Gene Name | Event # | RGR Of Leaf Number Ave. | P-Val. | % Incr. | RGR Of Rosette Diameter Ave. | P-Val. | % Incr. | RGR Of Plot Coverage Ave. | P-Val. | % Incr. |
|---|---|---|---|---|---|---|---|---|---|---|
| LAB467 | 66130.2 | 0.9 | 0.16 | 17 | — | — | — | — | — | — |
| CONT. | — | 0.8 | — | — | — | — | — | — | — | — |
| LAB604 | 66495.4 | — | — | — | — | — | — | 8.3 | 0.27 | 18 |
| LAB593 | 66340.4 | — | — | — | — | — | — | 9.1 | 0.08 | 29 |
| LAB575 | 66782.6 | — | — | — | — | — | — | 8.4 | 0.24 | 19 |
| LAB508 | 66729.2 | — | — | — | — | — | — | 8.9 | 0.11 | 26 |
| LAB507 | 66794.5 | — | — | — | — | — | — | 8.3 | 0.28 | 17 |

TABLE 110-continued

Genes showing improved plant and rosette growth performance under drought conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB476 | 66307.2 | — | — | — | — | — | — | 8.8 | 0.17 | 25 |
| LAB470 | 66630.1 | — | — | — | 0.5 | 0.23 | 15 | 8.4 | 0.22 | 20 |
| LAB462 | 66617.3 | — | — | — | — | — | — | 9.1 | 0.1 | 28 |
| LAB454 | 66813.1 | — | — | — | — | — | — | 8.3 | 0.27 | 17 |
| LAB438 | 66461.2 | — | — | — | — | — | — | 8.3 | 0.26 | 18 |
| LAB422 | 65936.2 | — | — | — | — | — | — | 8.3 | 0.26 | 18 |
| LAB422 | 65937.4 | — | — | — | — | — | — | 9 | 0.09 | 28 |
| LAB418 | 66826.2 | — | — | — | — | — | — | 8.5 | 0.19 | 21 |
| LAB404 | 66778.1 | — | — | — | — | — | — | 9.3 | 0.08 | 31 |
| LAB404 | 66778.2 | — | — | — | 0.5 | 0.13 | 20 | 11 | L | 57 |
| LAB403 | 66802.6 | — | — | — | — | — | — | 9.6 | 0.03 | 37 |
| LAB403 | 66802.7 | — | — | — | — | — | — | 8.9 | 0.11 | 26 |
| LAB403 | 66804.5 | — | — | — | 0.4 | 0.28 | 13 | 9.7 | 0.03 | 37 |
| CONT. | — | — | — | — | 0.4 | — | — | 7 | — | — |
| LAB604 | 66498.1 | 0.7 | 0.19 | 20 | — | — | — | — | — | — |
| LAB593 | 66338.2 | 0.7 | 0.1 | 24 | — | — | — | — | — | — |
| LAB593 | 66340.1 | — | — | — | — | — | — | 8.7 | 0.26 | 12 |
| LAB593 | 66340.4 | 0.7 | 0.14 | 22 | — | — | — | — | — | — |
| LAB593 | 66341.1 | 0.7 | 0.27 | 17 | 0.4 | 0.06 | 16 | 10.7 | L | 38 |
| LAB575 | 66783.2 | 0.7 | 0.17 | 23 | 0.4 | 0.21 | 10 | 11.1 | L | 43 |
| LAB575 | 66783.4 | — | — | — | 0.4 | 0.22 | 13 | 9.2 | 0.09 | 19 |
| LAB575 | 66784.5 | 0.8 | 0.07 | 27 | — | — | — | — | — | — |
| LAB575 | 66784.6 | 0.7 | 0.13 | 22 | — | — | — | — | — | — |
| LAB508 | 66728.5 | 0.7 | 0.2 | 20 | — | — | — | — | — | — |
| LAB508 | 66729.2 | 0.8 | 0.11 | 26 | — | — | — | — | — | — |
| LAB508 | 66730.6 | — | — | — | — | — | — | 9.1 | 0.16 | 18 |
| LAB507 | 66798.2 | — | — | — | 0.4 | 0.27 | 9 | — | — | — |
| LAB476 | 66306.6 | — | — | — | 0.4 | 0.21 | 12 | 9.3 | 0.15 | 20 |
| LAB472 | 66717.5 | 0.7 | 0.2 | 19 | — | — | — | — | — | — |
| LAB472 | 66718.7 | 0.7 | 0.17 | 20 | — | — | — | — | — | — |
| LAB472 | 66719.1 | 0.7 | 0.3 | 16 | — | — | — | — | — | — |
| LAB472 | 66719.3 | 0.7 | 0.21 | 20 | — | — | — | — | — | — |
| LAB470 | 66630.1 | — | — | — | — | — | — | 9.2 | 0.09 | 19 |
| LAB470 | 66630.4 | — | — | — | — | — | — | 9.1 | 0.12 | 18 |
| LAB466 | 66621.2 | — | — | — | — | — | — | 8.6 | 0.28 | 11 |
| LAB466 | 66622.4 | — | — | — | 0.4 | 0.04 | 17 | 9.5 | 0.05 | 23 |
| LAB466 | 66622.5 | 0.7 | 0.26 | 17 | — | — | — | — | — | — |
| LAB462 | 66615.1 | — | — | — | — | — | — | 8.8 | 0.23 | 14 |
| LAB462 | 66617.2 | 0.8 | 0.07 | 28 | — | — | — | — | — | — |
| LAB462 | 66617.3 | — | — | — | — | — | — | 9 | 0.11 | 17 |
| LAB454 | 66813.3 | 0.7 | 0.13 | 22 | — | — | — | — | — | — |
| LAB454 | 66813.4 | 0.7 | 0.28 | 16 | — | — | — | — | — | — |
| LAB454 | 66813.5 | 0.7 | 0.13 | 24 | — | — | — | — | — | — |
| LAB454 | 66813.6 | — | — | — | — | — | — | 9.1 | 0.14 | 17 |
| LAB438 | 66460.1 | — | — | — | 0.4 | 0.15 | 11 | 9 | 0.14 | 17 |
| LAB438 | 66461.5 | — | — | — | 0.4 | 0.17 | 11 | — | — | — |
| LAB422 | 65936.2 | — | — | — | 0.4 | 0.24 | 10 | 9.7 | 0.03 | 26 |
| LAB422 | 65938.3 | — | — | — | 0.4 | 0.16 | 11 | — | — | — |
| LAB422 | 65939.2 | 0.7 | 0.18 | 21 | — | — | — | 9 | 0.14 | 16 |
| LAB418 | 66825.8 | 0.7 | 0.24 | 18 | — | — | — | — | — | — |
| LAB418 | 66826.2 | 0.7 | 0.16 | 24 | 0.4 | 0.27 | 9 | — | — | — |
| LAB418 | 66829.2 | 0.8 | 0.01 | 38 | 0.4 | 0.21 | 11 | 9 | 0.17 | 16 |
| LAB412 | 66698.2 | 0.7 | 0.24 | 19 | — | — | — | — | — | — |
| LAB404 | 66778.1 | — | — | — | — | — | — | 9.3 | 0.07 | 20 |
| LAB404 | 66778.2 | 0.8 | 0.05 | 33 | 0.4 | 0.14 | 12 | 9.4 | 0.05 | 22 |
| LAB404 | 66779.1 | 0.7 | 0.15 | 22 | — | — | — | — | — | — |
| LAB404 | 66780.6 | 0.7 | 0.1 | 24 | — | — | — | — | — | — |
| LAB403 | 66800.3 | — | — | — | — | — | — | 8.7 | 0.27 | 12 |
| LAB403 | 66804.5 | — | — | — | — | — | — | 8.8 | 0.19 | 14 |
| LAB402 | 66567.1 | 0.7 | 0.14 | 21 | — | — | — | — | — | — |
| LAB402 | 66568.1 | 0.7 | 0.14 | 22 | — | — | — | — | — | — |
| CONT. | — | 0.6 | — | — | 0.4 | — | — | 7.7 | — | — |
| LAB609 | 65708.2 | — | — | — | 0.4 | 0.15 | 9 | 8.8 | L | 25 |
| LAB609 | 65709.3 | — | — | — | 0.4 | L | 18 | 10.3 | L | 45 |
| LAB585 | 65398.1 | — | — | — | — | — | — | 9.5 | L | 34 |
| LAB585 | 65399.1 | — | — | — | — | — | — | 8.3 | 0.12 | 18 |
| LAB585 | 65400.1 | — | — | — | — | — | — | 7.9 | 0.22 | 12 |
| LAB570 | 65558.2 | — | — | — | 0.4 | 0.07 | 13 | 8.4 | 0.08 | 18 |
| LAB570 | 65560.2 | — | — | — | 0.4 | 0.23 | 9 | 8.3 | 0.1 | 17 |
| LAB568 | 65619.2 | — | — | — | — | — | — | 9.4 | L | 33 |
| LAB540 | 65884.8 | — | — | — | 0.4 | 0.22 | 8 | 8.3 | 0.07 | 17 |
| LAB534 | 65877.2 | — | — | — | 0.4 | 0.28 | 6 | — | — | — |

TABLE 110-continued

Genes showing improved plant and rosette growth performance under drought conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB534 | 65877.3 | — | — | — | 0.4 | 0.06 | 13 | 9.3 | L | 31 |
| LAB510 | 65990.3 | — | — | — | — | — | — | 8 | 0.17 | 13 |
| LAB510 | 65991.2 | — | — | — | 0.4 | 0.17 | 10 | 8.3 | 0.1 | 17 |
| LAB504 | 66014.6 | — | — | — | — | — | — | 8 | 0.27 | 12 |
| LAB504 | 66015.2 | — | — | — | 0.4 | 0.05 | 13 | 7.8 | 0.29 | 10 |
| LAB460 | 65644.3 | — | — | — | 0.4 | 0.22 | 8 | 8.2 | 0.07 | 16 |
| LAB460 | 65647.4 | — | — | — | 0.4 | 0.02 | 17 | 8.7 | 0.04 | 23 |
| LAB458 | 65804.3 | — | — | — | 0.4 | 0.1 | 11 | 8.2 | 0.09 | 15 |
| LAB458 | 65805.1 | — | — | — | — | — | — | 7.9 | 0.18 | 12 |
| LAB455 | 66011.1 | — | — | — | 0.4 | 0.1 | 10 | 7.9 | 0.18 | 12 |
| LAB455 | 66011.3 | — | — | — | — | — | — | 7.9 | 0.17 | 12 |
| LAB440 | 65954.1 | — | — | — | 0.4 | 0.18 | 10 | 8.1 | 0.14 | 15 |
| LAB440 | 65956.1 | — | — | — | 0.4 | 0.23 | 7 | 8.1 | 0.1 | 15 |
| LAB426 | 65637.3 | — | — | — | 0.4 | 0.02 | 14 | 8.4 | 0.04 | 19 |
| LAB410 | 65401.2 | — | — | — | 0.4 | 0.03 | 17 | 9.3 | L | 31 |
| LAB406 | 65515.2 | — | — | — | 0.4 | 0.16 | 9 | 7.9 | 0.2 | 12 |
| LAB406 | 65517.3 | 0.8 | 0.25 | 14 | — | — | — | 7.9 | 0.2 | 12 |
| CONT. | — | 0.7 | — | — | 0.4 | — | — | 7.1 | — | — |
| LAB576 | 65329.2 | — | — | — | 0.3 | 0.19 | 23 | 7.4 | L | 31 |
| LAB576 | 65332.3 | — | — | — | 0.3 | 0.29 | 18 | 7 | 0.02 | 24 |
| LAB546 | 65155.2 | 0.7 | 0.26 | 19 | — | — | — | — | — | — |
| LAB546 | 65157.4 | — | — | — | — | — | — | 6.6 | 0.1 | 17 |
| LAB524 | 65135.1 | — | — | — | — | — | — | 6.6 | 0.13 | 17 |
| LAB517 | 65656.4 | — | — | — | 0.3 | 0.27 | 18 | — | — | — |
| LAB509 | 65118.3 | 0.8 | 0.05 | 34 | — | — | — | 7.1 | 0.02 | 25 |
| LAB509 | 65119.5 | 0.8 | 0.17 | 23 | — | — | — | 6.7 | 0.13 | 18 |
| LAB449 | 65098.5 | — | — | — | 0.3 | 0.25 | 20 | 6.9 | 0.04 | 21 |
| LAB446 | 65091.2 | — | — | — | — | — | — | 7.4 | L | 31 |
| LAB444 | 65087.1 | — | — | — | — | — | — | 6.5 | 0.2 | 15 |
| LAB442 | 65545.3 | — | — | — | — | — | — | 6.4 | 0.24 | 12 |
| LAB442 | 65545.5 | — | — | — | — | — | — | 6.6 | 0.17 | 16 |
| LAB428 | 65079.1 | — | — | — | — | — | — | 6.7 | 0.06 | 19 |
| LAB428 | 65082.3 | — | — | — | — | — | — | 6.5 | 0.22 | 14 |
| LAB425 | 65538.4 | — | — | — | — | — | — | 6.5 | 0.19 | 14 |
| LAB423 | 65528.2 | — | — | — | — | — | — | 6.4 | 0.19 | 13 |
| CONT. | — | 0.6 | — | — | 0.3 | — | — | 5.7 | — | — |
| LAB588 | 66332.2 | 0.8 | L | 23 | 0.4 | 0.1 | 19 | 8.7 | 0.04 | 33 |
| LAB584 | 66074.5 | 0.7 | 0.15 | 11 | 0.4 | 0.25 | 12 | 7.9 | 0.17 | 21 |
| LAB584 | 66077.2 | — | — | — | — | — | — | 7.5 | 0.3 | 15 |
| LAB576 | 65332.2 | 0.8 | 0.02 | 21 | — | — | — | — | — | — |
| LAB564 | 66063.4 | 0.7 | 0.27 | 11 | — | — | — | 7.6 | 0.27 | 17 |
| LAB553 | 66057.1 | 0.7 | 0.28 | 9 | — | — | — | — | — | — |
| LAB553 | 66060.1 | — | — | — | — | — | — | 8.1 | 0.12 | 24 |
| LAB553 | 66061.2 | 0.7 | 0.07 | 15 | — | — | — | — | — | — |
| LAB553 | 66061.3 | — | — | — | 0.4 | 0.12 | 18 | 9.2 | 0.01 | 41 |
| LAB546 | 65153.2 | 0.7 | 0.13 | 13 | — | — | — | — | — | — |
| LAB546 | 65156.2 | — | — | — | 0.4 | 0.16 | 16 | 7.8 | 0.2 | 19 |
| LAB546 | 65157.4 | 0.7 | 0.08 | 16 | — | — | — | — | — | — |
| LAB539 | 66136.2 | — | — | — | 0.4 | 0.26 | 13 | 8 | 0.14 | 23 |
| LAB539 | 66137.4 | 0.8 | 0.02 | 20 | — | — | — | — | — | — |
| LAB516 | 65870.2 | 0.7 | 0.06 | 17 | — | — | — | — | — | — |
| LAB516 | 65875.2 | — | — | — | — | — | — | 8 | 0.14 | 22 |
| LAB513 | 65124.5 | 0.7 | 0.16 | 12 | — | — | — | — | — | — |
| LAB513 | 65126.2 | 0.8 | 0.05 | 18 | — | — | — | — | — | — |
| LAB511 | 66258.2 | 0.7 | 0.17 | 12 | — | — | — | — | — | — |
| LAB511 | 66258.4 | 0.7 | 0.05 | 15 | — | — | — | 7.6 | 0.27 | 16 |
| LAB492 | 66053.3 | — | — | — | 0.4 | 0.29 | 12 | 8.6 | 0.06 | 32 |
| LAB492 | 66053.4 | 0.7 | 0.17 | 11 | — | — | — | 7.6 | 0.27 | 17 |
| LAB492 | 66054.4 | 0.8 | L | 28 | — | — | — | — | — | — |
| LAB474 | 66470.2 | 0.7 | 0.22 | 11 | — | — | — | — | — | — |
| LAB474 | 66475.1 | — | — | — | — | — | — | 8.3 | 0.07 | 28 |
| LAB465 | 66111.4 | — | — | — | — | — | — | 8 | 0.21 | 23 |
| LAB465 | 66112.2 | 0.7 | 0.25 | 10 | — | — | — | 7.7 | 0.27 | 18 |
| LAB465 | 66114.1 | — | — | — | 0.4 | 0.22 | 14 | 8.9 | 0.03 | 36 |
| LAB444 | 65085.1 | 0.7 | 0.22 | 10 | 0.4 | 0.17 | 15 | 8.6 | 0.04 | 32 |
| LAB444 | 65085.4 | — | — | — | 0.4 | 0.23 | 14 | 7.7 | 0.23 | 19 |
| LAB437 | 66454.2 | 0.7 | 0.08 | 15 | — | — | — | 7.6 | 0.27 | 16 |
| LAB434 | 66448.2 | 0.7 | 0.06 | 16 | — | — | — | — | — | — |
| LAB434 | 66449.3 | 0.7 | 0.09 | 16 | — | — | — | 7.8 | 0.2 | 19 |
| LAB427 | 65544.1 | 0.7 | 0.24 | 10 | — | — | — | 7.6 | 0.28 | 16 |
| CONT. | — | 0.6 | — | — | 0.4 | — | — | 6.5 | — | — |
| LAB589 | 65921.2 | — | — | — | 0.4 | 0.3 | 6 | — | — | — |

TABLE 110-continued

Genes showing improved plant and rosette growth performance under drought conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB589 | 65921.3 | 0.7 | 0.28 | 8 | — | — | — | — | — | — |
| LAB550 | 65902.4 | 0.7 | 0.11 | 12 | — | — | — | — | — | — |
| LAB547 | 65824.2 | 0.7 | 0.15 | 10 | — | — | — | — | — | — |
| LAB530 | 66262.2 | 0.7 | 0.28 | 8 | — | — | — | — | — | — |
| LAB530 | 66264.2 | — | — | — | 0.4 | 0.13 | 8 | 8.1 | 0.27 | 11 |
| LAB503 | 66212.3 | — | — | — | 0.4 | 0.28 | 5 | — | — | — |
| LAB503 | 66216.1 | 0.7 | 0.22 | 10 | — | — | — | — | — | — |
| LAB503 | 66216.2 | 0.7 | 0.14 | 11 | — | — | — | — | — | — |
| LAB502 | 65972.2 | 0.7 | 0.16 | 10 | — | — | — | — | — | — |
| LAB502 | 65975.1 | 0.7 | 0.12 | 13 | — | — | — | — | — | — |
| LAB484 | 65847.2 | — | — | — | 0.4 | 0.11 | 8 | — | — | — |
| LAB484 | 65848.3 | 0.7 | 0.21 | 10 | 0.4 | 0.05 | 11 | — | — | — |
| LAB483 | 65843.2 | 0.7 | 0.07 | 13 | — | — | — | — | — | — |
| LAB483 | 65844.2 | 0.7 | 0.29 | 8 | — | — | — | 8.3 | 0.16 | 15 |
| LAB453 | 66176.2 | 0.7 | 0.29 | 8 | — | — | — | — | — | — |
| LAB453 | 66177.1 | 0.7 | 0.19 | 12 | — | — | — | — | — | — |
| LAB452 | 66171.3 | — | — | — | 0.4 | 0.11 | 8 | — | — | — |
| LAB452 | 66173.3 | 0.7 | 0.24 | 9 | — | — | — | — | — | — |
| LAB437 | 66452.4 | 0.7 | 0.1 | 13 | — | — | — | — | — | — |
| LAB437 | 66454.4 | 0.7 | 0.26 | 8 | — | — | — | 8.1 | 0.22 | 13 |
| LAB432 | 66004.4 | 0.7 | 0.05 | 14 | — | — | — | — | — | — |
| LAB432 | 66004.5 | 0.7 | 0.08 | 14 | 0.4 | 0.26 | 6 | — | — | — |
| LAB399 | 65504.4 | — | — | — | 0.4 | 0.05 | 11 | — | — | — |
| LAB399 | 65506.1 | 0.7 | 0.21 | 10 | — | — | — | — | — | — |
| CONT. | — | 0.6 | — | — | 0.3 | — | — | 7.2 | — | — |
| LAB610 | 65342.3 | — | — | — | — | — | — | 8.5 | L | 34 |
| LAB596 | 65594.2 | — | — | — | 0.3 | 0.17 | 24 | 7.9 | 0.03 | 26 |
| LAB596 | 65595.2 | 0.8 | 0.15 | 21 | — | — | — | — | — | — |
| LAB596 | 65597.1 | — | — | — | 0.3 | 0.29 | 16 | 7.6 | 0.06 | 20 |
| LAB590 | 65347.2 | — | — | — | — | — | — | 7.2 | 0.13 | 15 |
| LAB590 | 65348.1 | — | — | — | — | — | — | 7 | 0.29 | 11 |
| LAB590 | 65350.2 | 0.8 | 0.15 | 22 | — | — | — | 7 | 0.21 | 12 |
| LAB578 | 65582.6 | 0.7 | 0.28 | 15 | — | — | — | — | — | — |
| LAB577 | 65575.2 | — | — | — | — | — | — | 7.3 | 0.1 | 15 |
| LAB577 | 65577.4 | 0.7 | 0.28 | 15 | — | — | — | — | — | — |
| LAB577 | 65578.4 | 0.8 | 0.11 | 24 | 0.3 | 0.19 | 22 | 8.3 | L | 32 |
| LAB565 | 65722.3 | 0.8 | 0.19 | 21 | — | — | — | — | — | — |
| LAB552 | 65312.1 | — | — | — | — | — | — | 7.1 | 0.2 | 12 |
| LAB535 | 65684.1 | 0.8 | 0.22 | 18 | — | — | — | — | — | — |
| LAB535 | 65688.1 | — | — | — | 0.3 | 0.2 | 25 | 7.9 | 0.1 | 25 |
| LAB531 | 65678.1 | — | — | — | — | — | — | 7.4 | 0.07 | 18 |
| LAB531 | 65679.3 | 0.8 | 0.19 | 19 | — | — | — | — | — | — |
| LAB531 | 65681.4 | — | — | — | — | — | — | 6.9 | 0.28 | 10 |
| LAB527 | 65672.1 | — | — | — | — | — | — | 7.1 | 0.23 | 12 |
| LAB527 | 65672.2 | 0.8 | 0.08 | 26 | — | — | — | — | — | — |
| LAB527 | 65673.2 | — | — | — | — | — | — | 7 | 0.28 | 10 |
| LAB527 | 65675.3 | 0.8 | 0.14 | 22 | 0.3 | 0.25 | 17 | 7.6 | 0.05 | 21 |
| LAB523 | 65660.3 | 0.8 | 0.09 | 27 | — | — | — | 7 | 0.26 | 12 |
| LAB523 | 65661.2 | 0.8 | 0.11 | 24 | — | — | — | — | — | — |
| LAB522 | 65132.2 | 0.8 | 0.24 | 17 | — | — | — | — | — | — |
| LAB494 | 65649.3 | 0.8 | 0.13 | 23 | — | — | — | — | — | — |
| LAB494 | 65651.1 | 0.8 | 0.14 | 22 | — | — | — | — | — | — |
| LAB494 | 65651.4 | 0.8 | 0.23 | 17 | 0.3 | 0.21 | 18 | 6.9 | 0.29 | 10 |
| LAB450 | 65307.3 | — | — | — | — | — | — | 7.2 | 0.24 | 15 |
| LAB450 | 65309.2 | 0.8 | 0.24 | 18 | — | — | — | — | — | — |
| LAB409 | 65524.5 | — | — | — | 0.3 | 0.09 | 25 | 7.9 | L | 26 |
| LAB409 | 65525.2 | 0.8 | 0.22 | 19 | — | — | — | 7 | 0.26 | 11 |
| LAB409 | 65526.1 | 0.8 | 0.25 | 18 | — | — | — | 7.2 | 0.14 | 15 |
| LAB401 | 65728.1 | — | — | — | — | — | — | 7.6 | 0.03 | 22 |
| LAB401 | 65728.4 | 0.8 | 0.19 | 20 | — | — | — | — | — | — |
| LAB401 | 65729.2 | 0.8 | 0.25 | 16 | — | — | — | 7.2 | 0.13 | 14 |
| LAB400 | 65509.2 | — | — | — | — | — | — | 7 | 0.22 | 12 |
| LAB400 | 65510.2 | — | — | — | — | — | — | 8.1 | 0.01 | 28 |
| CONT. | — | 0.6 | — | — | 0.2 | — | — | 6.3 | — | — |
| LAB608 | 65907.2 | — | — | — | 0.5 | 0.16 | 16 | 9.3 | 0.25 | 17 |
| LAB565 | 65724.2 | 0.7 | 0.25 | 19 | — | — | — | 10.1 | 0.08 | 28 |
| LAB557 | 65318.2 | — | — | — | 0.5 | 0.18 | 16 | 10 | 0.1 | 25 |
| LAB557 | 65320.2 | — | — | — | 0.5 | 0.28 | 13 | 9.7 | 0.17 | 22 |
| LAB557 | 65320.3 | — | — | — | — | — | — | 9.5 | 0.19 | 20 |
| LAB535 | 65688.1 | — | — | — | 0.5 | 0.2 | 15 | 10.5 | 0.04 | 32 |
| LAB531 | 65678.1 | — | — | — | 0.5 | 0.15 | 19 | 10.1 | 0.09 | 28 |
| LAB531 | 65679.3 | — | — | — | 0.5 | 0.2 | 16 | — | — | — |

TABLE 110-continued

Genes showing improved plant and rosette growth performance under drought conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB531 | 65681.4 | — | — | — | — | — | — | 9.8 | 0.14 | 23 |
| LAB522 | 65130.6 | 0.7 | 0.17 | 23 | 0.5 | 0.27 | 13 | 9.9 | 0.1 | 25 |
| LAB522 | 65131.2 | — | — | — | 0.5 | 0.24 | 14 | 9.8 | 0.13 | 23 |
| LAB522 | 65131.5 | 0.7 | 0.11 | 26 | — | — | — | — | — | — |
| LAB516 | 65871.1 | — | — | — | 0.5 | 0.02 | 28 | 10.9 | 0.03 | 37 |
| LAB516 | 65874.2 | — | — | — | — | — | — | 9.7 | 0.15 | 22 |
| LAB494 | 65649.3 | — | — | — | 0.5 | 0.01 | 30 | 11.8 | L | 49 |
| LAB401 | 65728.4 | 0.7 | 0.29 | 18 | — | — | — | — | — | — |
| CONT. | — | 0.6 | — | — | 0.4 | — | — | 7.9 | — | — |
| LAB544 | 65690.4 | — | — | — | 0.4 | 0.22 | 12 | — | — | — |
| LAB544 | 65694.1 | — | — | — | 0.4 | 0.02 | 25 | 8.5 | 0.04 | 21 |
| LAB509 | 65119.5 | — | — | — | 0.4 | 0.11 | 18 | 8.1 | 0.17 | 15 |
| LAB442 | 65545.5 | — | — | — | 0.4 | 0.17 | 17 | — | — | — |
| LAB442 | 65546.2 | — | — | — | 0.4 | 0.06 | 20 | — | — | — |
| LAB442 | 65549.2 | — | — | — | 0.4 | 0.23 | 13 | — | — | — |
| LAB425 | 65538.2 | — | — | — | 0.4 | 0.04 | 21 | — | — | — |
| CONT. | — | — | — | — | 0.3 | — | — | 7 | — | — |
| LAB588 | 66335.1 | 0.7 | 0.27 | 10 | — | — | — | 7.2 | 0.22 | 16 |
| LAB588 | 66336.3 | — | — | — | — | — | — | 7.3 | 0.17 | 18 |
| LAB584 | 66075.3 | — | — | — | 0.4 | 0.02 | 20 | 8.3 | 0.01 | 34 |
| LAB584 | 66077.2 | — | — | — | 0.4 | 0.19 | 11 | 7.3 | 0.16 | 18 |
| LAB564 | 66063.4 | — | — | — | — | — | — | 7.2 | 0.19 | 17 |
| LAB564 | 66065.2 | — | — | — | — | — | — | 7.1 | 0.24 | 16 |
| LAB553 | 66057.1 | 0.7 | 0.21 | 12 | — | — | — | 7.8 | 0.05 | 26 |
| LAB553 | 66059.1 | — | — | — | 0.4 | 0.27 | 9 | — | — | — |
| LAB553 | 66061.3 | — | — | — | 0.4 | 0.06 | 15 | 8 | 0.03 | 29 |
| LAB539 | 66135.4 | — | — | — | — | — | — | 7.5 | 0.11 | 21 |
| LAB539 | 66136.2 | 0.7 | 0.29 | 9 | 0.4 | L | 25 | 8.9 | L | 44 |
| LAB539 | 66138.2 | — | — | — | — | — | — | 7.9 | 0.04 | 28 |
| LAB519 | 66321.2 | — | — | — | 0.4 | 0.24 | 10 | 7.2 | 0.21 | 17 |
| LAB519 | 66324.1 | — | — | — | — | — | — | 7.4 | 0.15 | 19 |
| LAB511 | 66255.1 | — | — | — | 0.4 | 0.2 | 10 | — | — | — |
| LAB492 | 66051.3 | — | — | — | 0.4 | 0.07 | 15 | 7.8 | 0.06 | 26 |
| LAB492 | 66054.4 | — | — | — | — | — | — | 7.5 | 0.11 | 21 |
| LAB474 | 66470.4 | 0.8 | 0.14 | 14 | — | — | — | — | — | — |
| LAB471 | 66188.2 | 0.7 | 0.18 | 13 | — | — | — | 7 | 0.27 | 14 |
| LAB471 | 66191.2 | 0.7 | 0.3 | 9 | 0.4 | 0.24 | 9 | 7.8 | 0.04 | 26 |
| LAB465 | 66111.2 | — | — | — | — | — | — | 7.4 | 0.15 | 20 |
| LAB465 | 66112.2 | — | — | — | — | — | — | 7.3 | 0.17 | 19 |
| LAB465 | 66114.2 | — | — | — | 0.4 | 0.13 | 13 | 7.5 | 0.12 | 22 |
| LAB434 | 66447.4 | — | — | — | 0.4 | 0.17 | 11 | — | — | — |
| LAB434 | 66448.2 | — | — | — | 0.4 | 0.08 | 14 | 7.5 | 0.11 | 22 |
| LAB434 | 66448.4 | 0.7 | 0.18 | 13 | 0.4 | 0.19 | 11 | 7.5 | 0.11 | 22 |
| LAB407 | 66244.2 | 0.7 | 0.15 | 13 | — | — | — | — | — | — |
| LAB393 | 66288.2 | — | — | — | — | — | — | 7.3 | 0.17 | 18 |
| LAB393 | 66288.3 | 0.7 | 0.15 | 12 | — | — | — | — | — | — |
| CONT. | — | 0.7 | — | — | 0.3 | — | — | 6.2 | — | — |

Table 110.
"CONT."—Control;
"Ave."—Average;
"% Incr." = % increment;
"p-Val."—p-value,
L—p < 0.01.

The genes listed in Tables 111-114 improved plant performance when grown under standard growth conditions. These genes produced larger plants with a larger photosynthetic area and increased biomass (leaf number, dry weight, fresh weight, rosette diameter, rosette area and plot coverage) when grown under standard growth conditions.

TABLE 111

Genes showing improved plant performance and biomass production at standard growth conditions

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB572 | 66120.3 | — | — | — | 1562.5 | 0.28 | 6 |
| LAB569 | 65257.4 | 160 | 0.28 | 18 | 1762.5 | 0.29 | 19 |

TABLE 111-continued

Genes showing improved plant performance and biomass production at standard growth conditions

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB569 | 65260.7 | 167.1 | L | 23 | 1808 | L | 23 |
| LAB569 | 65260.8 | 163.1 | 0.02 | 20 | 1637.5 | 0.12 | 11 |
| LAB567 | 66068.3 | 152.5 | 0.02 | 12 | — | — | — |
| LAB567 | 66071.2 | — | — | — | 1693.8 | 0.14 | 15 |
| LAB567 | 66072.4 | 150.7 | 0.03 | 11 | 1657.1 | 0.05 | 12 |
| LAB566 | 66140.3 | 148.8 | 0.1 | 9 | — | — | — |
| LAB566 | 66142.5 | 161.9 | L | 19 | 1787.5 | L | 21 |
| LAB562 | 65612.3 | 151.2 | 0.03 | 11 | — | — | — |
| LAB548 | 65703.2 | — | — | — | 1562.5 | 0.3 | 6 |
| LAB548 | 65703.4 | 153.8 | 0.13 | 13 | — | — | — |
| LAB541 | 65412.7 | 143.8 | 0.27 | 6 | 1756.2 | 0.23 | 19 |
| LAB541 | 65412.8 | 167.5 | L | 23 | 1593.8 | 0.21 | 8 |
| LAB526 | 65668.2 | 151.6 | 0.15 | 11 | 1713.4 | 0.02 | 16 |
| LAB518 | 66020.1 | — | — | — | 1675 | 0.24 | 14 |
| LAB518 | 66023.1 | 157.5 | L | 16 | 1643.8 | 0.13 | 11 |
| LAB518 | 66024.5 | 172.5 | L | 27 | 1806.2 | L | 22 |
| LAB467 | 66130.1 | — | — | — | 1912.5 | 0.2 | 30 |
| LAB443 | 65552.1 | 145 | 0.28 | 7 | — | — | — |
| LAB443 | 65552.2 | — | — | — | 1631.2 | 0.3 | 11 |
| LAB443 | 65555.2 | 145.6 | 0.22 | 7 | — | — | — |
| LAB443 | 65555.3 | 151.9 | 0.13 | 12 | — | — | — |
| LAB439 | 65948.2 | 163.1 | 0.04 | 20 | — | — | — |
| LAB439 | 65950.2 | 157.5 | L | 16 | — | — | — |
| LAB405 | 66124.4 | — | — | — | 1575 | 0.24 | 7 |
| LAB405 | 66126.1 | — | — | — | 1725 | 0.02 | 17 |
| LAB396 | 65925.4 | 171.2 | 0.06 | 26 | 1742 | 0.01 | 18 |
| LAB396 | 65926.1 | 141.9 | 0.29 | 4 | — | — | — |
| LAB396 | 65927.1 | 165 | 0.02 | 21 | 1781.2 | 0.17 | 21 |
| LAB396 | 65927.4 | 168.1 | L | 24 | 1900 | 0.19 | 29 |
| CONT. | — | 136 ' | — | — | 1475 | — | — |
| LAB604 | 66495.4 | 342.7 | 0.2 | 11 | — | — | — |
| LAB604 | 66498.2 | — | — | — | 3289.6 | 0.11 | 10 |
| LAB593 | 66340.4 | 349.4 | 0.11 | 13 | 3476.9 | 0.02 | 16 |
| LAB575 | 66783.2 | — | — | — | 3383 | 0.22 | 13 |
| LAB508 | 66730.5 | 335 | 0.26 | 9 | 3305.6 | 0.14 | 11 |
| LAB508 | 66733.4 | — | — | — | 3320.6 | 0.17 | 11 |
| LAB507 | 66798.2 | 336.9 | 0.2 | 9 | 3375.6 | 0.05 | 13 |
| LAB472 | 66719.1 | — | — | — | 3320.7 | 0.09 | 11 |
| LAB472 | 66719.3 | — | — | — | 3258.2 | 0.14 | 9 |
| LAB470 | 66630.1 | 345.6 | 0.14 | 12 | — | — | — |
| LAB466 | 66622.4 | — | — | — | 3272.5 | 0.12 | 9 |
| LAB462 | 66617.3 | — | — | — | 3229.4 | 0.18 | 8 |
| LAB454 | 66813.3 | — | — | — | 3295 | 0.11 | 10 |
| LAB454 | 66813.7 | — | — | — | 3570 | 0.07 | 19 |
| LAB424 | 66710.9 | 343.8 | 0.12 | 11 | 3545 | 0.01 | 19 |
| LAB422 | 65936.5 | 337.5 | 0.18 | 9 | 3245.6 | 0.28 | 9 |
| LAB418 | 66825.8 | — | — | — | 3341.1 | 0.15 | 12 |
| LAB404 | 66778.1 | 335 | 0.22 | 9 | — | — | — |
| LAB404 | 66778.2 | 350 | 0.1 | 13 | — | — | — |
| LAB404 | 66780.5 | 337.5 | 0.18 | 9 | — | — | — |
| LAB403 | 66800.3 | — | — | — | 3199.4 | 0.28 | 7 |
| LAB403 | 66802.7 | — | — | — | 3178.8 | 0.27 | 6 |
| LAB402 | 66570.3 | — | — | — | 3413.1 | 0.26 | 14 |
| CONT. | — | 308.6 | — | — | 2990.6 | — | — |
| LAB593 | 66340.2 | 331.2 | 0.07 | 12 | 3250 | 0.04 | 10 |
| LAB593 | 66340.4 | 315 | 0.22 | 7 | — | — | — |
| LAB593 | 66341.1 | — | — | — | 3168.8 | 0.25 | 7 |
| LAB575 | 66782.6 | — | — | — | 3230.4 | 0.29 | 9 |
| LAB575 | 66784.5 | 335.6 | 0.07 | 14 | 3293.8 | 0.19 | 11 |
| LAB508 | 66730.5 | — | — | — | 3086.6 | 0.27 | 4 |
| LAB508 | 66730.6 | — | — | — | 3125 | 0.22 | 5 |
| LAB507 | 66798.2 | — | — | — | 3227.7 | 0.19 | 9 |
| LAB476 | 66303.3 | — | — | — | 3157.1 | 0.25 | 7 |
| LAB476 | 66306.6 | 337.5 | 0.09 | 14 | 3200 | 0.18 | 8 |
| LAB476 | 66307.1 | 323.1 | 0.09 | 9 | — | — | — |
| LAB476 | 66307.2 | 331.2 | 0.23 | 12 | — | — | — |
| LAB470 | 66630.1 | — | — | — | 3175 | 0.09 | 7 |
| LAB470 | 66630.4 | — | — | — | 3087.5 | 0.28 | 4 |
| LAB462 | 66615.1 | 311.2 | 0.29 | 5 | — | — | — |
| LAB454 | 66813.5 | 321.5 | 0.23 | 9 | 3200.9 | 0.06 | 8 |
| LAB454 | 66813.6 | 333.1 | 0.04 | 13 | — | — | — |
| LAB438 | 66461.5 | 327.5 | 0.06 | 11 | 3275 | 0.16 | 11 |
| LAB438 | 66462.1 | 330 | 0.16 | 12 | 3200 | 0.15 | 8 |

TABLE 111-continued

Genes showing improved plant performance and biomass production at standard growth conditions

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB422 | 65938.3 | 323.1 | 0.17 | 9 | 3375 | 0.04 | 14 |
| LAB418 | 66826.2 | 331.9 | 0.04 | 12 | 3243.8 | 0.04 | 9 |
| LAB418 | 66827.6 | 315 | 0.19 | 7 | — | — | — |
| LAB418 | 66829.2 | — | — | — | 3362.5 | 0.06 | 14 |
| LAB412 | 66701.3 | 321.2 | 0.1 | 9 | 3175 | 0.26 | 7 |
| LAB404 | 66778.1 | 332.5 | 0.04 | 13 | 3268.8 | 0.25 | 10 |
| LAB404 | 66778.2 | 343.8 | 0.08 | 16 | 3175 | 0.1 | 7 |
| LAB403 | 66800.3 | 337.5 | 0.03 | 14 | — | — | — |
| CONT. | — | 295.2 | — | — | 2962.5 | — | — |
| LAB609 | 65708.2 | 112.5 | 0.05 | 18 | 1106.2 | 0.08 | 17 |
| LAB609 | 65709.3 | 126.2 | L | 33 | 1212.5 | 0.02 | 29 |
| LAB609 | 65710.2 | 107.5 | 0.26 | 13 | 1206.2 | L | 28 |
| LAB585 | 65399.1 | 114.4 | 0.18 | 20 | 1206.2 | 0.07 | 28 |
| LAB573 | 65571.2 | 108.8 | 0.11 | 14 | 1113.4 | 0.29 | 18 |
| LAB573 | 65573.2 | 111.2 | 0.21 | 17 | 1162.5 | 0.29 | 23 |
| LAB570 | 65558.2 | 111 | 0.11 | 17 | — | — | — |
| LAB570 | 65559.2 | — | — | — | 1043.8 | 0.16 | 11 |
| LAB540 | 65883.2 | 117.5 | 0.02 | 23 | 1200 | 0.09 | 27 |
| LAB540 | 65884.8 | — | — | — | 1068.8 | 0.15 | 13 |
| LAB534 | 65879.4 | — | — | — | 1181.2 | 0.21 | 25 |
| LAB510 | 65991.2 | — | — | — | 1158 | 0.11 | 23 |
| LAB510 | 65992.4 | 107.5 | 0.17 | 13 | 1231.2 | L | 31 |
| LAB504 | 66015.2 | — | — | — | 1100 | 0.11 | 17 |
| LAB504 | 66018.1 | 125 | 0.23 | 31 | 1181.2 | 0.25 | 25 |
| LAB460 | 65644.3 | — | — | — | 1125 | 0.17 | 19 |
| LAB458 | 65805.1 | 103.1 | 0.3 | 8 | 1025 | 0.29 | 9 |
| LAB455 | 66009.4 | — | — | — | 1081.2 | 0.29 | 15 |
| LAB455 | 66011.1 | 109.4 | 0.28 | 15 | 1143.8 | 0.22 | 21 |
| LAB440 | 65957.4 | 113.1 | 0.05 | 19 | 1150 | 0.05 | 22 |
| LAB426 | 65636.1 | — | — | — | 1026.8 | 0.22 | 9 |
| LAB410 | 65401.2 | — | — | — | 1062.5 | 0.25 | 13 |
| LAB410 | 65405.4 | — | — | — | 1043.8 | 0.23 | 11 |
| LAB406 | 65515.2 | 124.4 | L | 31 | 1225 | L | 30 |
| LAB406 | 65517.3 | 105 | 0.22 | 10 | 1087.5 | 0.06 | 15 |
| CONT. | — | 95.2 | — | — | 941.7 | — | — |
| LAB595 | 65270.3 | 92.5 | 0.26 | 52 | 687.5 | 0.07 | 18 |
| LAB595 | 65273.3 | 75 | 0.13 | 23 | 711.6 | 0.29 | 22 |
| LAB576 | 65330.2 | 69.4 | 0.18 | 14 | — | — | — |
| LAB576 | 65332.2 | 72.1 | 0.14 | 18 | 685.7 | 0.08 | 18 |
| LAB546 | 65153.2 | 75.6 | 0.04 | 24 | 731.2 | 0.09 | 26 |
| LAB546 | 65156.2 | — | — | — | 687.5 | 0.21 | 18 |
| LAB546 | 65157.4 | — | — | — | 681.2 | 0.11 | 17 |
| LAB544 | 65694.1 | 81.2 | 0.2 | 33 | 812.5 | L | 40 |
| LAB524 | 65135.1 | 76.2 | 0.04 | 25 | — | — | — |
| LAB517 | 65655.4 | 81.2 | 0.25 | 33 | 693.8 | 0.08 | 19 |
| LAB517 | 65657.1 | 80.6 | 0.01 | 32 | 656.2 | 0.29 | 13 |
| LAB513 | 65126.1 | — | — | — | 631.2 | 0.29 | 9 |
| LAB509 | 65118.3 | 89.4 | L | 46 | 731.2 | 0.01 | 26 |
| LAB509 | 65119.5 | 77.8 | 0.04 | 27 | 798.2 | L | 37 |
| LAB509 | 65121.2 | — | — | — | 812.5 | 0.19 | 40 |
| LAB506 | 65114.2 | — | — | — | 756.2 | 0.28 | 30 |
| LAB506 | 65115.4 | 81.2 | 0.29 | 33 | 650 | 0.14 | 12 |
| LAB505 | 65105.1 | — | — | — | 837.5 | 0.04 | 44 |
| LAB505 | 65109.2 | 73.8 | 0.16 | 21 | — | — | — |
| LAB457 | 65100.1 | — | — | — | 650 | 0.19 | 12 |
| LAB449 | 65099.4 | 75.6 | 0.27 | 24 | 775 | 0.03 | 33 |
| LAB446 | 65090.3 | 83.1 | 0.15 | 36 | 768.8 | L | 32 |
| LAB446 | 65091.2 | — | — | — | 731.2 | 0.09 | 26 |
| LAB446 | 65094.1 | — | — | — | 731.2 | 0.01 | 26 |
| LAB444 | 65086.1 | 67.9 | 0.24 | 11 | 693.8 | 0.16 | 19 |
| LAB444 | 65086.2 | 81.9 | 0.22 | 34 | 650 | 0.14 | 12 |
| LAB444 | 65087.1 | 82.5 | 0.02 | 35 | 812.5 | L | 40 |
| LAB444 | 65088.5 | — | — | — | 762.5 | L | 31 |
| LAB442 | 65545.5 | — | — | — | 737.5 | 0.05 | 27 |
| LAB442 | 65546.2 | 83.8 | 0.29 | 37 | 706.2 | 0.2 | 22 |
| LAB442 | 65549.1 | 70.6 | 0.13 | 16 | 631.2 | 0.25 | 9 |
| LAB442 | 65549.2 | 75 | 0.05 | 23 | 706.2 | 0.02 | 22 |
| LAB428 | 65079.1 | 88.8 | L | 45 | 850 | L | 46 |
| LAB428 | 65082.2 | 71.9 | 0.18 | 18 | — | — | — |
| LAB428 | 65082.3 | 88.1 | 0.26 | 44 | 756.2 | L | 30 |
| LAB425 | 65533.1 | — | — | — | 775 | L | 33 |
| LAB425 | 65534.2 | — | — | — | 731.2 | 0.09 | 26 |
| LAB423 | 65527.1 | 76.9 | 0.19 | 26 | — | — | — |

TABLE 111-continued

Genes showing improved plant performance and biomass production at standard growth conditions

| Gene Name | Event # | Dry Weight [mg] Ave. | P-Val. | % Incr. | Fresh Weight [mg] Ave. | P-Val. | % Incr. |
|---|---|---|---|---|---|---|---|
| LAB423 | 65528.3 | 101.9 | L | 67 | 712.5 | 0.15 | 23 |
| LAB423 | 65530.2 | — | — | — | 662.5 | 0.09 | 14 |
| CONT. | — | 61 | — | — | 581.2 | — | — |
| LAB553 | 66059.1 | — | — | — | 3163.4 | 0.17 | 6 |
| LAB546 | 65156.2 | 370.6 | 0.1 | 21 | 3406.2 | 0.05 | 14 |
| LAB511 | 66254.3 | 331.2 | 0.14 | 8 | 3125 | 0.23 | 4 |
| LAB492 | 66053.3 | — | — | — | 3175 | 0.12 | 6 |
| LAB465 | 66112.2 | — | — | — | 3367 | 0.08 | 12 |
| LAB465 | 66114.2 | 338.8 | 0.21 | 11 | 3287.5 | 0.15 | 10 |
| LAB437 | 66452.2 | — | — | — | 3296.4 | 0.03 | 10 |
| LAB434 | 66446.1 | 326.2 | 0.22 | 7 | — | — | — |
| LAB434 | 66448.4 | 336.2 | 0.09 | 10 | — | — | — |
| CONT. | — | 305.8 | — | — | 2993.8 | — | — |
| LAB550 | 65902.2 | — | — | — | 2918.8 | 0.27 | 6 |
| LAB550 | 65903.2 | 276.9 | 0.01 | 10 | 2925 | 0.26 | 6 |
| LAB530 | 66262.3 | 276.2 | 0.04 | 9 | 3125 | 0.04 | 14 |
| LAB530 | 66264.2 | 283.1 | L | 12 | — | — | — |
| LAB529 | 65391.2 | 266.2 | 0.26 | 6 | 3056.2 | 0.14 | 11 |
| LAB529 | 65393.3 | 281.9 | 0.15 | 12 | 2925 | 0.27 | 6 |
| LAB503 | 66213.5 | 273.1 | 0.29 | 8 | 3231.2 | 0.07 | 18 |
| LAB496 | 65964.2 | 264.4 | 0.14 | 5 | — | — | — |
| LAB484 | 65846.3 | 270 | 0.04 | 7 | — | — | — |
| LAB484 | 65847.2 | 276.2 | 0.04 | 9 | — | — | — |
| LAB483 | 65841.3 | — | — | — | 2962.5 | 0.18 | 8 |
| LAB456 | 66186.2 | — | — | — | 2962.5 | 0.26 | 8 |
| LAB453 | 66177.1 | — | — | — | 3193.8 | 0.03 | 16 |
| LAB453 | 66177.2 | 266.9 | 0.27 | 6 | 3218.8 | 0.1 | 17 |
| LAB452 | 66172.4 | 273.1 | 0.07 | 8 | 2981.2 | 0.15 | 8 |
| LAB452 | 66172.7 | 271.2 | 0.03 | 8 | 3050 | 0.08 | 11 |
| LAB437 | 66454.2 | 269.4 | 0.05 | 7 | — | — | — |
| LAB432 | 66002.5 | 267.5 | 0.07 | 6 | — | — | — |
| LAB432 | 66003.3 | 273.8 | 0.13 | 9 | — | — | — |
| LAB430 | 66207.4 | 280 | 0.15 | 11 | — | — | — |
| LAB399 | 65503.1 | 263.8 | 0.28 | 5 | — | — | — |
| CONT. | — | 252.3 | — | — | 2747.9 | — | — |
| LAB610 | 65342.3 | 166.2 | 0.1 | 38 | 1875 | L | 36 |
| LAB596 | 65595.2 | 142.5 | 0.16 | 18 | — | — | — |
| LAB596 | 65597.1 | 145.6 | 0.02 | 21 | 1587.5 | 0.14 | 15 |
| LAB590 | 65347.2 | 135.6 | 0.09 | 13 | 1493.8 | 0.13 | 8 |
| LAB590 | 65348.1 | 158.8 | 0.21 | 32 | 1825 | 0.19 | 32 |
| LAB590 | 65349.4 | 148.1 | 0.12 | 23 | — | — | — |
| LAB590 | 65350.2 | 165.6 | L | 38 | 1756.2 | 0.08 | 27 |
| LAB578 | 65581.2 | 142.5 | 0.05 | 18 | 1656.2 | 0.01 | 20 |
| LAB578 | 65581.3 | 151.9 | 0.01 | 26 | — | — | — |
| LAB578 | 65582.3 | 138.8 | 0.05 | 15 | — | — | — |
| LAB577 | 65579.2 | 134 | 0.13 | 11 | 1525 | 0.24 | 11 |
| LAB565 | 65722.1 | 145.6 | 0.02 | 21 | 1650 | 0.16 | 20 |
| LAB565 | 65722.3 | 136.2 | 0.08 | 13 | 1468.8 | 0.21 | 6 |
| LAB565 | 65723.2 | 160 | 0.01 | 33 | 1837.5 | L | 33 |
| LAB552 | 65315.2 | — | — | — | 1475 | 0.24 | 7 |
| LAB535 | 65685.1 | 147.5 | 0.01 | 22 | 1687.5 | 0.09 | 22 |
| LAB535 | 65686.1 | 138.1 | 0.16 | 15 | 1512.5 | 0.28 | 10 |
| LAB535 | 65688.2 | 144.4 | 0.02 | 20 | 1581.2 | 0.26 | 15 |
| LAB531 | 65680.1 | 139.4 | 0.14 | 16 | — | — | — |
| LAB531 | 65681.5 | 138.1 | 0.25 | 15 | — | — | — |
| LAB527 | 65675.3 | 136.9 | 0.07 | 14 | 1537.5 | 0.05 | 11 |
| LAB523 | 65660.3 | 146.2 | 0.03 | 21 | — | — | — |
| LAB522 | 65130.1 | 148.1 | 0.06 | 23 | 1581.2 | 0.02 | 15 |
| LAB522 | 65131.2 | 135 | 0.15 | 12 | — | — | — |
| LAB522 | 65132.1 | 155.6 | 0.03 | 29 | 1850 | L | 34 |
| LAB494 | 65648.4 | 138.1 | 0.16 | 15 | — | — | — |
| LAB450 | 65306.1 | 147.5 | 0.01 | 22 | — | — | — |
| LAB450 | 65307.3 | 133.1 | 0.18 | 11 | 1475 | 0.19 | 7 |
| LAB450 | 65309.1 | 134.4 | 0.12 | 12 | 1643.8 | L | 19 |
| LAB409 | 65522.1 | 137.5 | 0.06 | 14 | 1600 | 0.05 | 16 |
| LAB409 | 65524.2 | 140.6 | 0.08 | 17 | — | — | — |
| LAB409 | 65524.5 | 141.2 | 0.22 | 17 | — | — | — |
| LAB400 | 65510.2 | 153.1 | 0.04 | 27 | 1700 | 0.12 | 23 |
| LAB400 | 65511.2 | 145 | 0.04 | 20 | 1693.8 | 0.23 | 23 |
| CONT. | — | 120.4 | — | — | 1379.2 | — | — |
| LAB596 | 65594.2 | 243.8 | 0.15 | 17 | 2662.5 | 0.14 | 21 |
| LAB596 | 65595.3 | — | — | — | 2531.2 | 0.04 | 15 |
| LAB590 | 65348.1 | — | — | — | 2325 | 0.09 | 6 |

TABLE 111-continued

Genes showing improved plant performance and biomass production at standard growth conditions

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB571 | 65564.3 | 220.6 | 0.07 | 6 | — | — | — |
| LAB565 | 65723.3 | — | — | — | 2387.5 | 0.02 | 8 |
| LAB527 | 65673.3 | 240.6 | 0.02 | 16 | 2587.5 | 0.02 | 18 |
| LAB516 | 65871.3 | 223.1 | 0.09 | 7 | 2312.5 | 0.22 | 5 |
| LAB494 | 65648.4 | 216.6 | 0.18 | 4 | — | — | — |
| LAB427 | 65539.6 | — | — | — | 2287.5 | 0.22 | 4 |
| LAB427 | 65544.1 | 238.1 | 0.01 | 14 | 2356.2 | 0.09 | 7 |
| CONT. | — | 208.3 | — | — | 2202.1 | — | — |
| LAB544 | 65690.1 | 102.5 | 0.23 | 18 | 1243.8 | 0.05 | 14 |
| LAB544 | 65690.4 | 94.3 | 0.26 | 8 | 1200 | 0.13 | 10 |
| LAB544 | 65693.2 | 116.2 | L | 33 | 1487.5 | 0.2 | 36 |
| LAB544 | 65694.1 | 110.8 | 0.14 | 27 | 1400 | 0.14 | 28 |
| LAB517 | 65654.1 | 100 | 0.16 | 15 | — | — | — |
| LAB517 | 65655.4 | 103.1 | 0.02 | 18 | 1281.2 | 0.09 | 17 |
| LAB509 | 65118.3 | 111.9 | 0.13 | 28 | 1350 | 0.25 | 24 |
| LAB442 | 65545.5 | 111.2 | 0.12 | 28 | 1431.2 | 0.27 | 31 |
| LAB442 | 65546.2 | 101.2 | 0.03 | 16 | 1275 | 0.02 | 17 |
| LAB442 | 65549.1 | 96.9 | 0.1 | 11 | 1212.5 | 0.07 | 11 |
| LAB425 | 65534.2 | 100.6 | 0.11 | 16 | 1212.5 | 0.25 | 11 |
| LAB425 | 65538.2 | 95.6 | 0.16 | 10 | 1206.2 | 0.17 | 11 |
| CONT. | — | 87.1 | — | — | 1091.4 | — | — |
| LAB588 | 66335.1 | 197.5 | 0.07 | 16 | — | — | — |
| LAB584 | 66075.3 | 215.6 | 0.01 | 27 | 2088.1 | 0.01 | 26 |
| LAB584 | 66077.2 | 197.5 | 0.1 | 16 | 1904.4 | 0.09 | 15 |
| LAB564 | 66063.2 | — | — | — | 2051.9 | 0.1 | 24 |
| LAB564 | 66065.2 | 191.9 | 0.21 | 13 | — | — | — |
| LAB553 | 66057.1 | 203.1 | 0.26 | 20 | 2021.9 | 0.16 | 22 |
| LAB553 | 66060.1 | — | — | — | 1855.6 | 0.17 | 12 |
| LAB539 | 66135.2 | 204.4 | 0.17 | 20 | 2066.9 | 0.17 | 25 |
| LAB539 | 66136.2 | — | — | — | 1867.5 | 0.21 | 13 |
| LAB519 | 66321.2 | 190.6 | 0.14 | 12 | 1961.3 | 0.05 | 18 |
| LAB511 | 66257.1 | 200 | 0.12 | 18 | 1883.1 | 0.11 | 14 |
| LAB492 | 66053.3 | 209 | 0.02 | 23 | 1980.9 | 0.09 | 19 |
| LAB492 | 66053.4 | 188.8 | 0.23 | 11 | — | — | — |
| LAB492 | 66054.4 | — | — | — | 1937.5 | 0.27 | 17 |
| LAB471 | 66188.2 | 194.4 | 0.09 | 15 | — | — | — |
| LAB471 | 66190.2 | 185.6 | 0.27 | 9 | — | — | — |
| LAB465 | 66111.2 | 213.1 | 0.03 | 26 | 1971.2 | 0.18 | 19 |
| LAB447 | 66353.4 | 199.4 | 0.14 | 18 | — | — | — |
| LAB434 | 66446.1 | 184.4 | 0.29 | 9 | — | — | — |
| LAB434 | 66448.4 | — | — | — | 1823.8 | 0.22 | 10 |
| LAB393 | 66287.2 | 191.9 | 0.21 | 13 | 1965.6 | 0.05 | 19 |
| LAB393 | 66288.2 | 195 | 0.13 | 15 | 1940 | 0.21 | 17 |
| CONT. | — | 169.6 | — | — | 1658 | — | — |

Table 111.
"CONT."—Control;
"Ave."—Average;
"% Incr." = % increment;
"p-val."—p-value,
L - p < 0.01.

TABLE 112

Genes showing improved plant performance and biomass production at standard growth conditions

| Gene Name | Event # | Rosette Diameter [cm] | | | Rosette Area [cm$^2$] | | | Plot Coverage [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| LAB572 | 66120.3 | 5.7 | 0.17 | 7 | 11.8 | 0.09 | 14 | 94.5 | 0.09 | 14 |
| LAB569 | 65260.7 | 5.7 | 0.13 | 7 | 11.7 | 0.1 | 14 | 93.9 | 0.1 | 14 |
| LAB567 | 66071.2 | 5.8 | 0.26 | 8 | 12.2 | 0.1 | 18 | 97.8 | 0.1 | 18 |
| LAB566 | 66142.5 | — | — | — | 11.6 | 0.22 | 13 | 93.2 | 0.22 | 13 |
| LAB541 | 65407.6 | 5.6 | 0.29 | 5 | — | — | — | — | — | — |
| LAB541 | 65412.7 | 6 | 0.02 | 13 | 12.9 | 0.01 | 25 | 103.4 | 0.01 | 25 |
| LAB541 | 65412.8 | 5.9 | 0.3 | 10 | 12.4 | 0.29 | 20 | 99.3 | 0.29 | 20 |

TABLE 112-continued

Genes showing improved plant performance and biomass production at standard growth conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB518 | 66023.1 | 5.8 | 0.07 | 9 | 12.1 | 0.05 | 17 | 96.9 | 0.05 | 17 |
| LAB518 | 66024.5 | 5.6 | 0.29 | 6 | 11.5 | 0.16 | 12 | 92.1 | 0.16 | 12 |
| LAB498 | 66041.1 | — | — | — | 11.2 | 0.28 | 9 | 89.7 | 0.28 | 9 |
| LAB439 | 65950.1 | — | — | — | 11.5 | 0.22 | 11 | 92 | 0.22 | 11 |
| LAB439 | 65950.2 | 5.7 | 0.18 | 6 | 11.4 | 0.17 | 11 | 91.6 | 0.17 | 11 |
| LAB439 | 65952.1 | — | — | — | 11.3 | 0.25 | 9 | 90 | 0.25 | 9 |
| LAB396 | 65925.4 | 6.3 | 0.08 | 18 | 14.4 | 0.07 | 39 | 114.9 | 0.07 | 39 |
| LAB396 | 65926.1 | 5.8 | 0.1 | 8 | 11.7 | 0.12 | 13 | 93.2 | 0.12 | 13 |
| LAB396 | 65927.1 | 6.1 | 0.15 | 15 | 14 | 0.2 | 35 | 111.8 | 0.2 | 35 |
| LAB396 | 65927.4 | — | — | — | 12.2 | 0.12 | 18 | 97.4 | 0.12 | 18 |
| CONT. | — | 5.3 | — | — | 10.3 | — | — | 82.6 | — | — |
| LAB604 | 66495.4 | 5.8 | 0.25 | 9 | — | — | — | — | — | — |
| LAB593 | 66340.4 | 5.9 | 0.17 | 13 | 12.6 | 0.08 | 31 | 100.5 | 0.08 | 31 |
| LAB575 | 66783.2 | 6 | 0.19 | 13 | 12.9 | 0.22 | 34 | 103 | 0.22 | 34 |
| LAB508 | 66730.5 | 5.7 | 0.28 | 9 | — | — | — | — | — | — |
| LAB507 | 66794.8 | 6 | 0.1 | 14 | — | — | — | — | — | — |
| LAB507 | 66798.2 | 5.9 | 0.16 | 11 | 11.3 | 0.22 | 18 | 90.7 | 0.22 | 18 |
| LAB476 | 66306.6 | 6.1 | 0.07 | 16 | 12.7 | 0.07 | 32 | 101.9 | 0.07 | 32 |
| LAB470 | 66630.1 | 6 | 0.11 | 13 | 12.2 | 0.09 | 27 | 97.7 | 0.09 | 27 |
| LAB466 | 66622.2 | 5.7 | 0.27 | 8 | — | — | — | — | — | — |
| LAB466 | 66622.4 | 6.2 | 0.04 | 18 | 12.2 | 0.09 | 27 | 97.7 | 0.09 | 27 |
| LAB462 | 66617.3 | — | — | — | 11.1 | 0.3 | 15 | 88.9 | 0.3 | 15 |
| LAB438 | 66461.5 | 5.8 | 0.23 | 9 | — | — | — | — | — | — |
| LAB424 | 66710.9 | 6.1 | 0.07 | 16 | 12.7 | 0.07 | 32 | 101.8 | 0.07 | 32 |
| LAB424 | 66715.1 | 5.9 | 0.15 | 12 | 11.4 | 0.24 | 18 | 91.1 | 0.24 | 18 |
| LAB424 | 66715.2 | 5.8 | 0.27 | 9 | — | — | — | — | — | — |
| LAB422 | 65939.2 | 6 | 0.09 | 14 | 12 | 0.15 | 25 | 96 | 0.15 | 25 |
| LAB404 | 66778.2 | 6.2 | 0.06 | 18 | 13.7 | 0.02 | 43 | 110 | 0.02 | 43 |
| LAB404 | 66779.1 | 5.9 | 0.16 | 13 | 11.9 | 0.12 | 23 | 94.8 | 0.12 | 23 |
| LAB404 | 66780.5 | 5.9 | 0.16 | 11 | 11.6 | 0.17 | 20 | 92.4 | 0.17 | 20 |
| LAB403 | 66800.3 | 6.2 | 0.05 | 18 | 12.4 | 0.08 | 29 | 99.2 | 0.08 | 29 |
| LAB403 | 66804.5 | 5.8 | 0.21 | 10 | 11 | 0.29 | 15 | 88.4 | 0.29 | 15 |
| LAB402 | 66570.3 | 5.9 | 0.18 | 12 | 11.2 | 0.28 | 16 | 89.3 | 0.28 | 16 |
| CONT. | — | 5.3 | — | — | 9.6 | — | — | 77 | — | — |
| LAB593 | 66340.2 | 6.1 | 0.12 | 6 | 13.8 | 0.05 | 14 | 110.5 | 0.05 | 14 |
| LAB593 | 66341.1 | 6 | 0.27 | 4 | 13.3 | 0.08 | 11 | 106.7 | 0.08 | 11 |
| LAB575 | 66783.4 | — | — | — | 13.6 | 0.13 | 13 | 108.7 | 0.13 | 13 |
| LAB438 | 66461.5 | 6.1 | 0.17 | 6 | 13.5 | 0.05 | 12 | 107.9 | 0.05 | 12 |
| LAB422 | 65936.2 | 6.1 | 0.23 | 6 | — | — | — | — | — | — |
| LAB404 | 66778.1 | — | — | — | 13.4 | 0.23 | 11 | 107.5 | 0.23 | 11 |
| CONT. | — | 5.8 | — | — | 12.1 | — | — | 96.5 | — | — |
| LAB609 | 65708.2 | 5.7 | 0.16 | 9 | 11.4 | 0.17 | 24 | 91.2 | 0.17 | 24 |
| LAB609 | 65709.3 | 5.7 | 0.01 | 9 | 11 | 0.04 | 20 | 88.2 | 0.04 | 20 |
| LAB609 | 65710.2 | 6 | 0.02 | 15 | 11.8 | 0.12 | 29 | 94.3 | 0.12 | 29 |
| LAB540 | 65883.2 | 5.7 | 0.02 | 9 | 10.6 | 0.08 | 15 | 84.6 | 0.08 | 15 |
| LAB540 | 65884.8 | 5.6 | 0.25 | 7 | 10.6 | 0.07 | 16 | 85 | 0.07 | 16 |
| LAB534 | 65878.3 | — | — | — | 9.9 | 0.29 | 8 | 79.1 | 0.29 | 8 |
| LAB534 | 65879.4 | 6 | 0.14 | 15 | 12.4 | 0.15 | 35 | 99.4 | 0.15 | 35 |
| LAB510 | 65991.1 | 5.6 | 0.29 | 7 | — | — | — | — | — | — |
| LAB510 | 65991.2 | 5.6 | 0.21 | 8 | 10.7 | 0.08 | 17 | 85.8 | 0.08 | 17 |
| LAB510 | 65992.4 | 5.6 | 0.15 | 8 | 11 | 0.21 | 20 | 88.1 | 0.21 | 20 |
| LAB504 | 66018.1 | 5.7 | 0.02 | 9 | 10.9 | 0.04 | 19 | 87.4 | 0.04 | 19 |
| LAB460 | 65644.3 | 5.4 | 0.19 | 4 | 10 | 0.24 | 10 | 80.3 | 0.24 | 10 |
| LAB458 | 65805.1 | 5.4 | 0.29 | 3 | 9.8 | 0.25 | 7 | 78.6 | 0.25 | 7 |
| LAB455 | 66009.4 | 5.6 | 0.28 | 8 | 10.8 | 0.08 | 17 | 86 | 0.08 | 17 |
| LAB455 | 66011.1 | 5.8 | 0.17 | 11 | 11.2 | 0.19 | 22 | 89.7 | 0.19 | 22 |
| LAB440 | 65957.4 | 5.6 | 0.02 | 8 | 10.6 | 0.04 | 15 | 84.7 | 0.04 | 15 |
| LAB410 | 65405.4 | — | — | — | 9.9 | 0.21 | 8 | 79.1 | 0.21 | 8 |
| LAB406 | 65515.2 | 5.9 | L | 12 | 11.9 | L | 30 | 95.3 | L | 30 |
| LAB406 | 65517.3 | — | — | — | 10.2 | 0.18 | 11 | 81.4 | 0.18 | 11 |
| CONT. | — | 5.2 | — | — | 9.2 | — | — | 73.4 | — | — |
| LAB595 | 65270.2 | 5.2 | 0.21 | 6 | 10.1 | 0.05 | 19 | 81 | 0.05 | 19 |
| LAB595 | 65273.2 | — | — | — | 9.5 | 0.22 | 12 | 76 | 0.22 | 12 |
| LAB576 | 65329.2 | — | — | — | 11.6 | 0.26 | 37 | 92.8 | 0.26 | 37 |
| LAB546 | 65153.2 | 5.2 | 0.07 | 7 | 10.3 | L | 21 | 82.3 | L | 21 |
| LAB544 | 65694.1 | 5.3 | 0.01 | 9 | 10.6 | L | 25 | 84.6 | L | 25 |
| LAB524 | 65135.1 | 5.3 | 0.23 | 7 | 9.8 | 0.12 | 16 | 78.6 | 0.12 | 16 |
| LAB517 | 65655.4 | — | — | — | 9.4 | 0.24 | 11 | 74.9 | 0.24 | 11 |
| LAB517 | 65657.1 | 5.3 | 0.22 | 7 | 9.9 | 0.23 | 17 | 79.1 | 0.23 | 17 |
| LAB513 | 65124.5 | — | — | — | 9.2 | 0.16 | 8 | 73.5 | 0.16 | 8 |

TABLE 112-continued

Genes showing improved plant performance and biomass production at standard growth conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB509 | 65118.3 | 5.2 | 0.08 | 6 | 9.9 | 0.02 | 17 | 79.6 | 0.02 | 17 |
| LAB509 | 65118.4 | — | — | — | 9.7 | 0.3 | 15 | 77.7 | 0.3 | 15 |
| LAB509 | 65119.5 | 5.5 | 0.04 | 13 | 11.3 | 0.05 | 33 | 90.3 | 0.05 | 33 |
| LAB509 | 65121.2 | 5.8 | 0.13 | 19 | 12.5 | 0.08 | 47 | 99.7 | 0.08 | 47 |
| LAB506 | 65114.2 | 5.2 | 0.09 | 5 | 9.5 | 0.06 | 12 | 76.2 | 0.06 | 12 |
| LAB506 | 65115.3 | 5.1 | 0.22 | 3 | 9 | 0.24 | 7 | 72.3 | 0.24 | 7 |
| LAB457 | 65100.1 | 5.1 | 0.16 | 4 | 9.1 | 0.22 | 8 | 73.1 | 0.22 | 8 |
| LAB449 | 65099.4 | 5.3 | 0.02 | 8 | 10.5 | L | 24 | 83.8 | L | 24 |
| LAB446 | 65090.3 | 5.5 | 0.06 | 11 | 10.8 | L | 27 | 86.1 | L | 27 |
| LAB446 | 65091.2 | 5.4 | 0.07 | 10 | 10.8 | L | 28 | 86.4 | L | 28 |
| LAB446 | 65094.1 | 5.3 | 0.02 | 7 | 10.6 | L | 25 | 84.7 | L | 25 |
| LAB444 | 65086.1 | 5.3 | 0.12 | 7 | 10.2 | 0.2 | 21 | 81.7 | 0.2 | 21 |
| LAB444 | 65087.1 | 5.6 | L | 15 | 11.5 | 0.06 | 36 | 92.3 | 0.06 | 36 |
| LAB442 | 65545.5 | 5.6 | L | 14 | 11.2 | L | 33 | 89.9 | L | 33 |
| LAB442 | 65546.2 | 5.3 | 0.16 | 7 | 9.7 | 0.09 | 15 | 77.7 | 0.09 | 15 |
| LAB442 | 65549.2 | — | — | — | 9.7 | 0.03 | 15 | 77.7 | 0.03 | 15 |
| LAB428 | 65079.1 | 5.6 | L | 14 | 11.8 | L | 39 | 94.4 | L | 39 |
| LAB428 | 65082.2 | 5.1 | 0.27 | 4 | 9.4 | 0.1 | 10 | 74.8 | 0.1 | 10 |
| LAB428 | 65082.3 | — | — | — | 10 | 0.28 | 17 | 79.6 | 0.28 | 17 |
| LAB425 | 65533.1 | 5.3 | 0.24 | 8 | 10 | 0.04 | 18 | 79.9 | 0.04 | 18 |
| LAB425 | 65534.2 | 5.3 | 0.04 | 8 | 10.3 | L | 22 | 82.4 | L | 22 |
| LAB425 | 65535.2 | 5.1 | 0.15 | 4 | 9.3 | 0.24 | 9 | 74.1 | 0.24 | 9 |
| LAB423 | 65527.1 | — | — | — | 9.5 | 0.08 | 13 | 76.3 | 0.08 | 13 |
| LAB423 | 65528.2 | 5.4 | 0.11 | 9 | 10.6 | L | 25 | 84.6 | L | 25 |
| CONT. | — | 4.9 | — | — | 8.5 | — | — | 67.8 | — | — |
| LAB588 | 66336.3 | — | — | — | 9.9 | 0.29 | 12 | 78.9 | 0.23 | 15 |
| LAB584 | 66074.5 | 5.3 | 0.18 | 6 | 9.5 | 0.07 | 8 | 75.8 | 0.05 | 10 |
| LAB564 | 66062.2 | 5.2 | 0.16 | 4 | 9.7 | 0.01 | 10 | 77.5 | 0.02 | 13 |
| LAB564 | 66063.4 | 5.3 | 0.28 | 5 | 9.6 | 0.02 | 9 | 76.9 | 0.02 | 12 |
| LAB553 | 66059.1 | 5.2 | 0.03 | 4 | 9.8 | L | 11 | 78.2 | 0.01 | 14 |
| LAB553 | 66060.1 | 5.2 | 0.1 | 4 | — | — | — | 74.4 | 0.27 | 8 |
| LAB546 | 65156.1 | 5.1 | 0.02 | 3 | 9.7 | 0.01 | 10 | 77.5 | 0.02 | 13 |
| LAB546 | 65156.2 | 5.2 | L | 4 | 9.3 | 0.06 | 6 | 74.5 | 0.07 | 8 |
| LAB546 | 65157.4 | 5.2 | 0.2 | 4 | 9.7 | L | 11 | 77.8 | 0.01 | 13 |
| LAB539 | 66137.4 | 5.4 | L | 7 | 10.4 | 0.08 | 18 | 83 | 0.04 | 21 |
| LAB539 | 66138.2 | 5.6 | L | 12 | 11.4 | L | 30 | 91.2 | L | 32 |
| LAB519 | 66320.7 | 5.1 | 0.28 | 1 | — | — | — | 72.1 | 0.24 | 5 |
| LAB516 | 65870.2 | — | — | — | — | — | — | 75.1 | 0.29 | 9 |
| LAB516 | 65875.2 | — | — | — | 9.3 | 0.08 | 6 | 74.4 | 0.08 | 8 |
| LAB513 | 65124.5 | 5.1 | 0.28 | 1 | — | — | — | — | — | — |
| LAB513 | 65125.1 | — | — | — | — | — | — | 78.9 | 0.26 | 15 |
| LAB513 | 65125.2 | 5.3 | 0.13 | 6 | 9.8 | 0.1 | 11 | 78.3 | 0.06 | 14 |
| LAB511 | 66254.3 | 5.4 | L | 8 | 10.9 | L | 24 | 86.8 | L | 26 |
| LAB511 | 66258.4 | 5.2 | L | 4 | 9.5 | 0.15 | 9 | 76.4 | 0.1 | 11 |
| LAB511 | 66258.8 | — | — | — | 9.3 | 0.2 | 6 | 74.7 | 0.13 | 8 |
| LAB492 | 66053.3 | 5.5 | 0.03 | 9 | 10.5 | 0.06 | 20 | 84.1 | 0.03 | 22 |
| LAB492 | 66053.4 | 5.2 | 0.3 | 3 | — | — | — | — | — | — |
| LAB465 | 66112.2 | 5.3 | 0.09 | 6 | 10.8 | 0.07 | 23 | 86.6 | 0.04 | 26 |
| LAB465 | 66114.1 | 5.3 | 0.09 | 7 | 10.1 | L | 15 | 80.5 | L | 17 |
| LAB465 | 66114.2 | 5.4 | 0.02 | 7 | 9.9 | 0.01 | 13 | 79.4 | 0.01 | 15 |
| LAB444 | 65085.1 | 5.4 | L | 8 | 10.5 | 0.03 | 19 | 83.8 | 0.01 | 22 |
| LAB437 | 66452.2 | 5.4 | 0.27 | 7 | 9.9 | 0.16 | 12 | 79.1 | 0.11 | 15 |
| LAB437 | 66454.2 | — | — | — | 9.5 | 0.11 | 8 | 76 | 0.07 | 10 |
| LAB434 | 66446.1 | 5.9 | L | 18 | 13 | L | 48 | 103.8 | L | 51 |
| LAB434 | 66448.4 | 5.2 | L | 4 | 9.9 | L | 12 | 79 | L | 15 |
| LAB427 | 65543.2 | 5.3 | L | 7 | 10.1 | 0.01 | 15 | 81 | L | 18 |
| CONT. | — | 5 | — | — | 8.8 | — | — | 68.9 | — | — |
| LAB530 | 66264.2 | 6.1 | 0.12 | 8 | 14.5 | 0.01 | 20 | 116.3 | 0.01 | 20 |
| LAB503 | 66216.2 | 6 | 0.02 | 6 | 13.3 | 0.07 | 10 | 106.5 | 0.07 | 10 |
| LAB452 | 66172.4 | 6.2 | L | 10 | 14.7 | L | 22 | 117.5 | L | 22 |
| LAB452 | 66172.7 | — | — | — | 13.9 | 0.19 | 15 | 111.5 | 0.19 | 15 |
| LAB437 | 66454.2 | — | — | — | 14.8 | 0.2 | 22 | 118.1 | 0.2 | 22 |
| LAB430 | 66207.4 | 6 | 0.03 | 6 | 13.6 | 0.04 | 12 | 108.6 | 0.04 | 12 |
| CONT. | — | 5.6 | — | — | 12.1 | — | — | 96.7 | — | — |
| LAB610 | 65342.3 | 6.2 | L | 16 | 14.9 | L | 35 | 119 | L | 35 |
| LAB610 | 65343.5 | 5.6 | 0.1 | 6 | — | — | — | — | — | — |
| LAB596 | 65594.2 | 5.6 | 0.26 | 6 | — | — | — | — | — | — |
| LAB596 | 65595.2 | 5.9 | 0.11 | 12 | 13.8 | 0.1 | 25 | 110.1 | 0.1 | 25 |
| LAB596 | 65597.1 | 5.8 | 0.21 | 9 | — | — | — | — | — | — |
| LAB590 | 65347.1 | 6 | 0.02 | 14 | 13.6 | L | 23 | 109 | L | 23 |

TABLE 112-continued

Genes showing improved plant performance and biomass production at standard growth conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB590 | 65347.2 | 5.9 | 0.11 | 11 | 13.3 | 0.06 | 21 | 106.7 | 0.06 | 21 |
| LAB590 | 65349.4 | 6.3 | 0.11 | 19 | 15.7 | 0.1 | 42 | 125.7 | 0.1 | 42 |
| LAB590 | 65350.2 | 6.3 | L | 19 | 15.6 | 0.01 | 42 | 125.1 | 0.01 | 42 |
| LAB578 | 65581.2 | — | — | — | 12.5 | 0.13 | 13 | 100.3 | 0.13 | 13 |
| LAB565 | 65722.1 | 5.8 | 0.18 | 9 | 13.2 | 0.1 | 19 | 105.4 | 0.1 | 19 |
| LAB565 | 65723.2 | 5.9 | 0.01 | 12 | 13.6 | L | 23 | 109 | L | 23 |
| LAB557 | 65317.6 | 6 | 0.2 | 14 | — | — | — | — | — | — |
| LAB557 | 65320.2 | 5.6 | 0.13 | 6 | 11.8 | 0.27 | 7 | 94.6 | 0.27 | 7 |
| LAB552 | 65311.1 | 5.7 | 0.22 | 9 | — | — | — | — | — | — |
| LAB552 | 65315.2 | 5.6 | 0.14 | 5 | — | — | — | — | — | — |
| LAB535 | 65685.1 | 6.1 | 0.16 | 15 | 14.2 | 0.2 | 28 | 113.3 | 0.2 | 28 |
| LAB531 | 65680.1 | 5.7 | 0.19 | 8 | — | — | — | — | — | — |
| LAB531 | 65681.5 | 6 | 0.03 | 13 | 13.8 | L | 25 | 110.1 | L | 25 |
| LAB527 | 65675.3 | 5.6 | 0.17 | 6 | 11.9 | 0.26 | 7 | 94.9 | 0.26 | 7 |
| LAB523 | 65660.3 | 5.8 | 0.08 | 10 | — | — | — | — | — | — |
| LAB523 | 65663.5 | 5.6 | 0.29 | 6 | — | — | — | — | — | — |
| LAB522 | 65130.1 | 5.8 | 0.08 | 9 | 13.1 | 0.19 | 19 | 104.8 | 0.19 | 19 |
| LAB522 | 65130.6 | 5.6 | 0.1 | 6 | 12.2 | 0.14 | 10 | 97.6 | 0.14 | 10 |
| LAB522 | 65131.2 | 5.5 | 0.22 | 4 | — | — | — | — | — | — |
| LAB522 | 65132.1 | 6.4 | L | 21 | 14.9 | L | 34 | 118.8 | L | 34 |
| LAB494 | 65648.4 | 5.5 | 0.22 | 4 | — | — | — | — | — | — |
| LAB450 | 65307.3 | 5.6 | 0.1 | 7 | — | — | — | — | — | — |
| LAB450 | 65309.2 | 5.8 | 0.03 | 10 | 13.2 | 0.15 | 19 | 105.3 | 0.15 | 19 |
| LAB409 | 65522.1 | 5.7 | 0.05 | 8 | 12.9 | 0.03 | 17 | 103.2 | 0.03 | 17 |
| LAB409 | 65524.5 | — | — | — | 13.6 | 0.26 | 23 | 108.7 | 0.26 | 23 |
| LAB401 | 65728.1 | 6 | 0.29 | 13 | 13.3 | 0.28 | 21 | 106.6 | 0.28 | 21 |
| LAB400 | 65510.2 | 6.2 | 0.17 | 17 | 14.6 | 0.09 | 32 | 116.8 | 0.09 | 32 |
| LAB400 | 65511.2 | 5.8 | 0.19 | 10 | 13.4 | 0.2 | 22 | 107.6 | 0.2 | 22 |
| CONT. | — | 5.3 | — | — | 11 | — | — | 88.4 | — | — |
| LAB596 | 65594.2 | 6.2 | 0.02 | 9 | 13.3 | 0.16 | 20 | 106.2 | 0.16 | 20 |
| LAB596 | 65595.2 | 6.1 | 0.05 | 7 | 13.1 | 0.02 | 19 | 104.8 | 0.02 | 19 |
| LAB590 | 65347.2 | — | — | — | 12.2 | 0.21 | 10 | 97.2 | 0.21 | 10 |
| LAB565 | 65723.3 | 6 | 0.08 | 6 | 12.4 | 0.07 | 13 | 99.5 | 0.07 | 13 |
| LAB516 | 65871.3 | — | — | — | 12.3 | 0.22 | 11 | 98.5 | 0.22 | 11 |
| LAB516 | 65874.2 | 6.2 | 0.03 | 9 | 13.5 | L | 22 | 101.2 | 0.3 | 14 |
| LAB427 | 65544.1 | 6.1 | 0.23 | 7 | 13.8 | 0.06 | 25 | 110.7 | 0.06 | 25 |
| CONT. | — | 5.7 | — | — | 11 | — | — | 88.4 | — | — |
| LAB544 | 65693.2 | 5.8 | L | 15 | 12.3 | L | 38 | 98.6 | L | 38 |
| LAB517 | 65655.4 | 5.5 | 0.03 | 8 | 10.5 | 0.02 | 18 | 84.2 | 0.02 | 18 |
| LAB509 | 65118.3 | 5.5 | 0.13 | 9 | 10.6 | 0.22 | 18 | 84.4 | 0.22 | 18 |
| LAB509 | 65119.5 | 5.8 | 0.23 | 14 | 11.8 | 0.26 | 32 | 94.1 | 0.26 | 32 |
| LAB442 | 65545.5 | 6.1 | 0.12 | 19 | 11.7 | 0.11 | 31 | 93.7 | 0.11 | 31 |
| LAB442 | 65546.2 | 5.5 | 0.05 | 8 | 10.5 | 0.09 | 18 | 84.3 | 0.09 | 18 |
| LAB442 | 65549.1 | 5.5 | 0.04 | 7 | 10.1 | 0.06 | 12 | 80.5 | 0.06 | 12 |
| LAB425 | 65538.2 | 5.3 | 0.16 | 4 | 9.8 | 0.24 | 10 | 78.6 | 0.24 | 10 |
| LAB425 | 65538.4 | 5.3 | 0.19 | 4 | — | — | — | — | — | — |
| CONT. | — | 5.1 | — | — | 8.9 | — | — | 71.6 | — | — |
| LAB588 | 66335.1 | 5.9 | 0.09 | 8 | 12.3 | 0.18 | 15 | 98.5 | 0.18 | 15 |
| LAB588 | 66336.3 | 5.7 | 0.29 | 5 | 12.4 | 0.09 | 16 | 99.5 | 0.09 | 16 |
| LAB584 | 66075.3 | 6.2 | 0.02 | 13 | 14.1 | L | 32 | 113 | L | 32 |
| LAB584 | 66077.2 | — | — | — | 12 | 0.19 | 12 | 95.7 | 0.19 | 12 |
| LAB564 | 66063.2 | 5.9 | 0.11 | 8 | 12.4 | 0.1 | 16 | 99.4 | 0.1 | 16 |
| LAB553 | 66057.1 | 6.1 | 0.07 | 13 | 13.5 | 0.05 | 26 | 108.3 | 0.05 | 26 |
| LAB553 | 66061.2 | 5.8 | 0.2 | 7 | 12.3 | 0.18 | 15 | 98.2 | 0.18 | 15 |
| LAB539 | 66135.2 | 6.1 | 0.03 | 12 | 13.8 | 0.01 | 28 | 110 | 0.01 | 28 |
| LAB539 | 66136.2 | 5.8 | 0.17 | 6 | 12.3 | 0.12 | 14 | 98.1 | 0.12 | 14 |
| LAB519 | 66321.2 | 6.1 | 0.02 | 13 | 13.4 | 0.04 | 25 | 107.2 | 0.04 | 25 |
| LAB511 | 66257.1 | 5.9 | 0.1 | 9 | 12.6 | 0.16 | 18 | 101.2 | 0.16 | 18 |
| LAB492 | 66053.3 | 5.8 | 0.28 | 6 | 13 | 0.16 | 21 | 104 | 0.16 | 21 |
| LAB492 | 66054.4 | 6.1 | 0.03 | 12 | 13.5 | 0.03 | 26 | — | — | — |
| LAB471 | 66188.2 | 5.9 | 0.21 | 9 | 12.5 | 0.17 | 16 | 99.9 | 0.17 | 16 |
| LAB471 | 66190.2 | 5.8 | 0.2 | 6 | 12.2 | 0.13 | 14 | 97.7 | 0.13 | 14 |
| LAB471 | 66191.2 | 6 | 0.07 | 11 | 13.3 | 0.03 | 24 | 106.6 | 0.03 | 24 |
| LAB465 | 66111.2 | 5.9 | 0.09 | 10 | 13.1 | 0.07 | 22 | 105 | 0.07 | 22 |
| LAB393 | 66287.2 | — | — | — | 12.6 | 0.1 | 18 | 100.9 | 0.1 | 18 |

TABLE 112-continued

Genes showing improved plant performance and biomass production at standard growth conditions

| Gene Name | Event # | Rosette Diameter [cm] | | | Rosette Area [cm²] | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB393 | 66288.2 | 5.8 | 0.13 | 7 | 12.9 | 0.08 | 20 | 102.9 | 0.08 | 20 |
| CONT. | — | 5.4 | — | — | 10.7 | — | — | 85.7 | — | — |

Table 112.
"CONT."—Control;
"Ave."—Average;
"% Incr." = % increment;
"p-val."—p-value,
L - p < 0.01.

TABLE 113

Genes showing improved plant performance and photosynthetic capacity at standard growth conditions

| Gene Name | Event # | Leaf Number | | | Leaf Blade Area [cm²] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| LAB588 | 66336.3 | — | — | — | 0.991 | 0.046 | 16 | — | — | — |
| CONT. | — | — | — | — | 0.848 | — | — | — | — | — |
| LAB572 | 66117.3 | 12.1 | 0.05 | 7 | — | — | — | — | — | — |
| LAB572 | 66120.3 | 11.9 | 0.04 | 5 | — | — | — | — | — | — |
| LAB569 | 65260.8 | 12.4 | 0.24 | 10 | — | — | — | — | — | — |
| LAB567 | 66071.2 | 11.6 | 0.16 | 3 | — | — | — | — | — | — |
| LAB567 | 66072.2 | 11.8 | 0.12 | 5 | — | — | — | — | — | — |
| LAB566 | 66142.5 | 11.7 | 0.2 | 4 | — | — | — | — | — | — |
| LAB541 | 65407.6 | 11.9 | 0.01 | 6 | — | — | — | — | — | — |
| LAB541 | 65412.7 | 12.1 | 0.01 | 8 | — | — | — | — | — | — |
| LAB521 | 65599.6 | 11.7 | 0.06 | 4 | — | — | — | — | — | — |
| LAB521 | 65601.3 | 11.8 | 0.02 | 5 | — | — | — | — | — | — |
| LAB521 | 65603.2 | 11.8 | 0.12 | 5 | — | — | — | — | — | — |
| LAB518 | 66023.1 | 11.8 | 0.07 | 4 | — | — | — | — | — | — |
| LAB518 | 66024.5 | 11.8 | 0.07 | 4 | — | — | — | — | — | — |
| LAB467 | 66130.1 | 11.5 | 0.23 | 2 | — | — | — | — | — | — |
| LAB467 | 66130.2 | 11.6 | 0.09 | 3 | — | — | — | — | — | — |
| LAB443 | 65555.2 | 11.9 | 0.23 | 6 | — | — | — | — | — | — |
| LAB439 | 65948.2 | 11.8 | 0.12 | 5 | — | — | — | — | — | — |
| LAB439 | 65950.1 | 11.8 | 0.25 | 4 | — | — | — | — | — | — |
| LAB439 | 65952.1 | 12 | 0.02 | 6 | — | — | — | — | — | — |
| LAB396 | 65925.4 | 12.4 | 0.16 | 10 | — | — | — | — | — | — |
| LAB396 | 65926.1 | 11.9 | 0.01 | 6 | — | — | — | — | — | — |
| CONT. | — | 11.3 | — | — | — | — | — | — | — | — |
| LAB593 | 66340.4 | 11.6 | 0.19 | 7 | — | — | — | — | — | — |
| LAB575 | 66783.2 | 12.2 | 0.26 | 13 | — | — | — | — | — | — |
| LAB508 | 66730.5 | 12.5 | 0.09 | 15 | — | — | — | — | — | — |
| LAB507 | 66798.1 | 11.8 | 0.29 | 9 | — | — | — | — | — | — |
| LAB472 | 66717.5 | 11.8 | 0.11 | 8 | — | — | — | — | — | — |
| LAB472 | 66718.7 | 11.5 | 0.23 | 6 | — | — | — | — | — | — |
| LAB470 | 66627.3 | 11.7 | 0.13 | 8 | — | — | — | — | — | — |
| LAB470 | 66630.1 | 12 | 0.06 | 11 | — | — | — | — | — | — |
| LAB466 | 66621.2 | 12.3 | 0.03 | 13 | — | — | — | — | — | — |
| LAB466 | 66622.2 | 11.4 | 0.29 | 5 | — | — | — | — | — | — |
| LAB466 | 66622.4 | 12.3 | 0.09 | 13 | — | — | — | — | — | — |
| LAB454 | 66813.3 | 11.6 | 0.19 | 7 | — | — | — | — | — | — |
| LAB438 | 66460.1 | 11.6 | 0.26 | 7 | — | — | — | — | — | — |
| LAB438 | 66461.2 | 11.5 | 0.27 | 6 | — | — | — | — | — | — |
| LAB438 | 66461.5 | 12.1 | 0.04 | 12 | — | — | — | — | — | — |
| LAB424 | 66710.9 | 11.7 | 0.19 | 8 | — | — | — | — | — | — |
| LAB424 | 66715.2 | 11.8 | 0.28 | 8 | — | — | — | — | — | — |
| LAB422 | 65936.2 | 11.6 | 0.26 | 7 | — | — | — | — | — | — |
| LAB422 | 65936.5 | 11.9 | 0.07 | 10 | — | — | — | — | — | — |
| LAB422 | 65939.2 | 11.8 | 0.2 | 8 | — | — | — | — | — | — |
| LAB404 | 66778.1 | 11.7 | 0.19 | 8 | — | — | — | — | — | — |
| LAB404 | 66778.2 | 11.9 | 0.07 | 10 | — | — | — | — | — | — |
| LAB404 | 66779.1 | 11.7 | 0.13 | 8 | — | — | — | — | — | — |

TABLE 113-continued

Genes showing improved plant performance and photosynthetic capacity at standard growth conditions

| Gene Name | Event # | Leaf Number | | | Leaf Blade Area [cm²] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| LAB403 | 66800.3 | 12.2 | 0.13 | 13 | — | — | — | — | — | — |
| LAB402 | 66570.3 | 11.6 | 0.26 | 7 | — | — | — | — | — | — |
| LAB402 | 66570.4 | 11.6 | 0.16 | 7 | — | — | — | — | — | — |
| CONT. | — | 10.9 | — | — | — | — | — | — | — | — |
| LAB575 | 66783.2 | 13 | 0.22 | 4 | — | — | — | — | — | — |
| CONT. | — | 12.5 | — | — | — | — | — | — | — | — |
| LAB609 | 65708.2 | 12 | 0.07 | 15 | — | — | — | — | — | — |
| LAB609 | 65709.3 | 10.9 | 0.21 | 5 | — | — | — | — | — | — |
| LAB609 | 65710.2 | 11.1 | 0.13 | 6 | — | — | — | — | — | — |
| LAB609 | 65711.2 | 11.8 | 0.27 | 13 | — | — | — | — | — | — |
| LAB585 | 65399.1 | 11.4 | 0.07 | 9 | — | — | — | — | — | — |
| LAB585 | 65399.2 | 10.9 | 0.2 | 4 | — | — | — | — | — | — |
| LAB573 | 65571.2 | 11.3 | 0.14 | 8 | — | — | — | — | — | — |
| LAB534 | 65879.4 | 11.3 | 0.03 | 8 | — | — | — | — | — | — |
| LAB510 | 65991.1 | 10.8 | 0.27 | 3 | — | — | — | — | — | — |
| LAB510 | 65991.2 | 11.1 | 0.13 | 6 | — | — | — | — | — | — |
| LAB510 | 65992.4 | 11.2 | 0.1 | 8 | — | — | — | — | — | — |
| LAB468 | 65836.2 | 10.9 | 0.2 | 4 | — | — | — | — | — | — |
| LAB468 | 65838.1 | 11.6 | 0.01 | 11 | — | — | — | — | — | — |
| LAB460 | 65644.3 | 11.3 | 0.05 | 8 | — | — | — | — | — | — |
| LAB460 | 65645.1 | 11.6 | 0.11 | 11 | — | — | — | — | — | — |
| LAB458 | 65804.3 | 10.8 | 0.27 | 3 | — | — | — | — | — | — |
| LAB458 | 65805.1 | 11.1 | 0.06 | 6 | — | — | — | — | — | — |
| LAB458 | 65805.4 | 11.2 | 0.22 | 8 | — | — | — | — | — | — |
| LAB455 | 66011.1 | 11.2 | 0.04 | 8 | — | — | — | — | — | — |
| LAB440 | 65957.4 | 11.6 | 0.17 | 11 | — | — | — | — | — | — |
| LAB426 | 65636.2 | 10.9 | 0.22 | 4 | — | — | — | — | — | — |
| LAB406 | 65515.2 | 10.8 | 0.27 | 3 | — | — | — | — | — | — |
| CONT. | — | 10.5 | — | — | — | — | — | — | — | — |
| LAB595 | 65273.3 | 11.5 | 0.28 | 8 | — | — | — | — | — | — |
| LAB544 | 65693.2 | 11.1 | 0.28 | 4 | — | — | — | — | — | — |
| LAB544 | 65694.1 | 11.3 | 0.14 | 6 | — | — | — | — | — | — |
| LAB524 | 65135.1 | 11.7 | 0.03 | 10 | — | — | — | — | — | — |
| LAB524 | 65135.2 | 11.4 | 0.07 | 8 | — | — | — | — | — | — |
| LAB509 | 65118.3 | 11.2 | 0.21 | 6 | — | — | — | — | — | — |
| LAB509 | 65118.4 | 11.8 | 0.03 | 11 | — | — | — | — | — | — |
| LAB509 | 65119.5 | 11.8 | 0.03 | 11 | — | — | — | — | — | — |
| LAB509 | 65121.2 | 12.2 | 0.27 | 15 | — | — | — | — | — | — |
| LAB506 | 65114.2 | 11.1 | 0.28 | 4 | — | — | — | — | — | — |
| LAB506 | 65115.3 | 11.3 | 0.11 | 6 | — | — | — | — | — | — |
| LAB505 | 65105.1 | 11.3 | 0.22 | 6 | — | — | — | — | — | — |
| LAB505 | 65109.2 | 11.1 | 0.22 | 5 | — | — | — | — | — | — |
| LAB449 | 65099.4 | 11.9 | 0.01 | 12 | — | — | — | — | — | — |
| LAB446 | 65093.2 | 11.7 | 0.17 | 10 | — | — | — | — | — | — |
| LAB446 | 65094.1 | 11.6 | 0.21 | 9 | — | — | — | — | — | — |
| LAB444 | 65085.4 | 11.3 | 0.11 | 6 | — | — | — | — | — | — |
| LAB444 | 65086.2 | 11.3 | 0.14 | 6 | — | — | — | — | — | — |
| LAB442 | 65545.5 | 11.4 | 0.09 | 8 | — | — | — | — | — | — |
| LAB442 | 65546.2 | 11.2 | 0.21 | 5 | — | — | — | — | — | — |
| LAB442 | 65549.2 | 11.3 | 0.14 | 6 | — | — | — | — | — | — |
| LAB428 | 65079.1 | 12.1 | 0.01 | 14 | — | — | — | — | — | — |
| LAB428 | 65082.2 | 11.5 | 0.19 | 8 | — | — | — | — | — | — |
| LAB428 | 65082.3 | 11.3 | 0.11 | 6 | — | — | — | — | — | — |
| LAB425 | 65534.2 | 11.3 | 0.14 | 6 | — | — | — | — | — | — |
| LAB425 | 65535.2 | 11.4 | 0.24 | 7 | — | — | — | — | — | — |
| LAB423 | 65527.1 | 11.2 | 0.15 | 6 | — | — | — | — | — | — |
| LAB423 | 65527.3 | 11.3 | 0.22 | 6 | — | — | — | — | — | — |
| CONT. | — | 10.6 | — | — | — | — | — | — | — | — |
| LAB588 | 66332.4 | 11.2 | 0.05 | 5 | — | — | — | — | — | — |
| LAB588 | 66336.3 | 11.3 | 0.11 | 5 | — | — | — | — | — | — |
| LAB584 | 66074.5 | 11.4 | 0.29 | 6 | — | — | — | — | — | — |
| LAB584 | 66075.2 | 11.1 | 0.11 | 4 | — | — | — | — | — | — |
| LAB584 | 66077.2 | 11 | 0.23 | 3 | — | — | — | — | — | — |
| LAB576 | 65331.1 | 11.1 | 0.17 | 3 | — | — | — | — | — | — |
| LAB564 | 66062.2 | 11.4 | 0.15 | 6 | — | — | — | — | — | — |
| LAB564 | 66065.2 | 11.4 | 0.02 | 7 | — | — | — | — | — | — |
| LAB546 | 65155.3 | 11.4 | 0.07 | 7 | — | — | — | — | — | — |
| LAB539 | 66136.2 | 11.1 | 0.11 | 4 | — | — | — | — | — | — |
| LAB539 | 66137.4 | 11.3 | 0.11 | 5 | — | — | — | — | — | — |
| LAB539 | 66138.2 | 11.6 | 0.29 | 8 | — | — | — | — | — | — |
| LAB519 | 66323.1 | 11.1 | 0.11 | 4 | — | — | — | — | — | — |

TABLE 113-continued

Genes showing improved plant performance and photosynthetic capacity at standard growth conditions

| Gene Name | Event # | Leaf Number Ave. | P-Val. | % Incr. | Leaf Blade Area [cm²] Ave | P-Val | % Incr. | Leaf Petiole Length [cm] Ave. | P-Val. | % Incr. |
|---|---|---|---|---|---|---|---|---|---|---|
| LAB519 | 66324.1 | 11.4 | 0.02 | 6 | — | — | — | — | — | — |
| LAB516 | 65870.3 | 11.2 | 0.07 | 4 | — | — | — | — | — | — |
| LAB516 | 65875.2 | 11 | 0.3 | 3 | — | — | — | — | — | — |
| LAB513 | 65124.5 | 11.1 | 0.15 | 4 | — | — | — | — | — | — |
| LAB513 | 65125.2 | 11.2 | 0.05 | 5 | — | — | — | — | — | — |
| LAB511 | 66254.3 | 11.3 | 0.26 | 5 | — | — | — | — | — | — |
| LAB492 | 66051.1 | 11 | 0.3 | 3 | — | — | — | — | — | — |
| LAB474 | 66470.2 | 11 | 0.23 | 3 | — | — | — | — | — | — |
| LAB474 | 66470.4 | 11.1 | 0.15 | 4 | — | — | — | — | — | — |
| LAB474 | 66475.1 | 11.7 | 0.23 | 9 | — | — | — | — | — | — |
| LAB444 | 65085.1 | 11.4 | 0.07 | 7 | — | — | — | — | — | — |
| LAB437 | 66452.2 | 11.1 | 0.3 | 3 | — | — | — | — | — | — |
| LAB437 | 66453.4 | 11.2 | 0.07 | 4 | — | — | — | — | — | — |
| LAB437 | 66454.2 | 11 | 0.23 | 3 | — | — | — | — | — | — |
| LAB437 | 66454.4 | 11.3 | 0.11 | 5 | — | — | — | — | — | — |
| LAB434 | 66446.1 | 11.4 | 0.04 | 6 | — | — | — | — | — | — |
| LAB434 | 66447.2 | 11.4 | 0.15 | 6 | — | — | — | — | — | — |
| LAB427 | 65544.1 | 11 | 0.3 | 3 | — | — | — | — | — | — |
| CONT. | — | 10.7 | — | — | — | — | — | — | — | — |
| LAB550 | 65901.2 | 12.4 | 0.3 | 2 | — | — | — | — | — | — |
| LAB530 | 66264.2 | 13.3 | L | 9 | — | — | — | — | — | — |
| LAB529 | 65393.3 | 12.8 | 0.04 | 5 | — | — | — | — | — | — |
| LAB502 | 65975.1 | 12.7 | 0.15 | 4 | — | — | — | — | — | — |
| CONT. | — | 12.2 | — | — | — | — | — | — | — | — |
| LAB596 | 65594.2 | 12.4 | 0.27 | 3 | — | — | — | — | — | — |
| LAB590 | 65349.4 | 13.2 | 0.21 | 10 | — | — | — | — | — | — |
| LAB590 | 65350.2 | 13.1 | 0.02 | 8 | — | — | — | — | — | — |
| LAB522 | 65130.6 | 12.6 | 0.08 | 4 | — | — | — | — | — | — |
| LAB522 | 65131.2 | 12.6 | 0.08 | 4 | — | — | — | — | — | — |
| LAB522 | 65132.1 | 12.6 | 0.2 | 5 | — | — | — | — | — | — |
| LAB450 | 65306.1 | 12.9 | 0.25 | 7 | — | — | — | — | — | — |
| LAB400 | 65510.2 | 12.9 | 0.22 | 7 | — | — | — | — | — | — |
| LAB400 | 65511.2 | 12.9 | 0.14 | 7 | — | — | — | — | — | — |
| CONT. | — | 12.1 | — | — | — | — | — | — | — | — |
| LAB596 | 65594.2 | 11.4 | 0.28 | 4 | — | — | — | — | — | — |
| LAB596 | 65595.2 | 11.9 | 0.15 | 9 | — | — | — | — | — | — |
| LAB590 | 65347.2 | 11.4 | 0.13 | 5 | — | — | — | — | — | — |
| LAB565 | 65722.3 | 11.3 | 0.29 | 4 | — | — | — | — | — | — |
| LAB565 | 65724.2 | 11.4 | 0.18 | 5 | — | — | — | — | — | — |
| LAB535 | 65684.1 | 11.5 | 0.11 | 6 | — | — | — | — | — | — |
| LAB531 | 65679.3 | 11.4 | 0.17 | 4 | — | — | — | — | — | — |
| LAB409 | 65524.5 | 11.2 | 0.29 | 3 | — | — | — | — | — | — |
| CONT. | — | 10.9 | — | — | — | — | — | — | — | — |
| LAB425 | 65535.2 | 11.6 | 0.09 | 6 | — | — | — | — | — | — |
| LAB425 | 65538.2 | 11.4 | 0.24 | 4 | — | — | — | — | — | — |
| CONT. | — | 11 | — | — | — | — | — | — | — | — |
| LAB597 | 66272.8 | 12.4 | 0.04 | 8 | — | — | — | — | — | — |
| LAB588 | 66332.2 | 12.4 | 0.04 | 8 | — | — | — | — | — | — |
| LAB588 | 66336.3 | 12.4 | 0.09 | 7 | — | — | — | — | — | — |
| LAB584 | 66075.3 | 13.1 | L | 14 | — | — | — | — | — | — |
| LAB564 | 66064.2 | 12.2 | 0.24 | 6 | — | — | — | — | — | — |
| LAB564 | 66065.2 | 12.1 | 0.13 | 5 | — | — | — | — | — | — |
| LAB553 | 66061.2 | 12 | 0.19 | 4 | — | — | — | — | — | — |
| LAB539 | 66135.2 | 12.5 | 0.02 | 8 | — | — | — | — | — | — |
| LAB539 | 66138.2 | 12.1 | 0.18 | 5 | — | — | — | — | — | — |
| LAB519 | 66324.1 | 12.1 | 0.19 | 5 | — | — | — | — | — | — |
| LAB492 | 66053.3 | 12.6 | 0.01 | 10 | — | — | — | — | — | — |
| LAB474 | 66470.2 | 12.4 | 0.19 | 7 | — | — | — | — | — | — |
| LAB474 | 66470.8 | 12.2 | 0.11 | 6 | — | — | — | — | — | — |
| LAB471 | 66188.2 | 12.4 | 0.03 | 8 | — | — | — | — | — | — |
| LAB465 | 66112.2 | 11.9 | 0.29 | 4 | — | — | — | — | — | — |
| LAB465 | 66114.2 | 12.2 | 0.13 | 6 | — | — | — | — | — | — |
| LAB434 | 66448.2 | 11.9 | 0.29 | 3 | — | — | — | — | — | — |
| LAB407 | 66244.1 | 11.9 | 0.29 | 3 | — | — | — | — | — | — |

TABLE 113-continued

Genes showing improved plant performance and photosynthetic capacity at standard growth conditions

| Gene Name | Event # | Leaf Number Ave. | Leaf Number P-Val. | Leaf Number % Incr. | Leaf Blade Area [cm²] Ave | Leaf Blade Area [cm²] P-Val | Leaf Blade Area [cm²] % Incr. | Leaf Petiole Length [cm] Ave. | Leaf Petiole Length [cm] P-Val. | Leaf Petiole Length [cm] % Incr. |
|---|---|---|---|---|---|---|---|---|---|---|
| LAB407 | 66246.4 | 11.9 | 0.29 | 4 | — | — | — | — | — | — |
| CONT. | — | 11.5 | — | — | — | — | — | — | — | — |

Table 113.
"CONT."—Control;
"Ave."—Average;
"% Incr." = % increment;
"p-val."—p-value;
L - p < 0.01.

TABLE 114

Genes showing improved plant performance and at standard growth conditions

| Gene Name | Event # | Petiole Relative Area [%] Ave. | P-Val. | % Incr. |
|---|---|---|---|---|
| LAB572 | 66120.3 | 12.622 | 0.011 | 22 |
| CONT. | — | 10.345 | — | — |

Table 114.
"CONT."—Control;
"Ave."—Average;
"% Incr." = % increment;
"p-val."—p-value;
L—p < 0.01.

The genes listed in Table 115 improved plant performance when grown under standard growth conditions. These genes produced faster developing plants when grown under standard growth conditions, compared to control plants as measured by growth rate of leaf number, rosette diameter and plot coverage.

TABLE 115

Genes showing improved plant and rosette growth performance at standard growth conditions

| Gene Name | Event # | RGR Of Leaf Number Ave. | RGR Of Leaf Number P-Val. | RGR Of Leaf Number % Incr. | RGR Of Rosette Diameter Ave. | RGR Of Rosette Diameter P-Val. | RGR Of Rosette Diameter % Incr. | RGR Of Plot Coverage Ave. | RGR Of Plot Coverage P-Val. | RGR Of Plot Coverage % Incr. |
|---|---|---|---|---|---|---|---|---|---|---|
| LAB572 | 66117.3 | 0.9 | 0.08 | 22 | — | — | — | — | — | — |
| LAB569 | 65257.4 | — | — | — | — | — | — | 12.6 | 0.24 | 22 |
| LAB569 | 65260.6 | 0.9 | 0.14 | 19 | — | — | — | — | — | — |
| LAB569 | 65260.8 | 0.9 | 0.2 | 17 | — | — | — | — | — | — |
| LAB567 | 66072.4 | 0.8 | 0.26 | 14 | — | — | — | — | — | — |
| LAB562 | 65612.3 | 0.9 | 0.16 | 18 | — | — | — | — | — | — |
| LAB545 | 65698.1 | 0.8 | 0.26 | 14 | — | — | — | — | — | — |
| LAB541 | 65410.1 | 0.8 | 0.29 | 13 | — | — | — | — | — | — |
| LAB541 | 65412.7 | — | — | — | — | — | — | 12.7 | 0.2 | 22 |
| LAB541 | 65412.8 | — | — | — | — | — | — | 12.6 | 0.22 | 21 |
| LAB526 | 65668.2 | 0.9 | 0.25 | 15 | — | — | — | — | — | — |
| LAB521 | 65603.2 | 0.8 | 0.29 | 13 | — | — | — | — | — | — |
| LAB518 | 66020.1 | 0.9 | 0.16 | 19 | — | — | — | — | — | — |
| LAB518 | 66023.1 | — | — | — | — | — | — | 12.2 | 0.29 | 18 |
| LAB467 | 66130.1 | — | — | — | 0.6 | 0.16 | 18 | 13.5 | 0.11 | 30 |
| LAB467 | 66130.2 | 0.9 | 0.2 | 16 | — | — | — | — | — | — |
| LAB467 | 66131.4 | 0.9 | 0.14 | 19 | — | — | — | — | — | — |
| LAB443 | 65556.1 | 0.9 | 0.16 | 18 | — | — | — | — | — | — |
| LAB439 | 65952.1 | 0.9 | 0.14 | 18 | — | — | — | — | — | — |
| LAB396 | 65925.4 | — | — | — | — | — | — | 14.3 | 0.04 | 38 |
| LAB396 | 65926.1 | 0.9 | 0.15 | 18 | — | — | — | — | — | — |
| LAB396 | 65927.1 | — | — | — | — | — | — | 13.9 | 0.06 | 34 |
| LAB396 | 65927.4 | — | — | — | — | — | — | 12.4 | 0.24 | 20 |
| CONT. | — | 0.7 | — | — | 0.5 | — | — | 10.4 | — | — |
| LAB593 | 66340.4 | — | — | — | — | — | — | 11.5 | 0.17 | 32 |
| LAB575 | 66783.2 | — | — | — | — | — | — | 11.5 | 0.17 | 32 |
| LAB476 | 66306.6 | — | — | — | 0.5 | 0.3 | 18 | 11.5 | 0.16 | 33 |
| LAB470 | 66630.1 | — | — | — | — | — | — | 11 | 0.25 | 26 |

TABLE 115-continued

Genes showing improved plant and rosette growth performance at standard growth conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB466 | 66621.2 | 0.7 | 0.29 | 16 | — | — | — | — | — | — |
| LAB466 | 66622.4 | — | — | — | — | — | — | 10.9 | 0.26 | 25 |
| LAB424 | 66710.9 | — | — | — | — | — | — | 11.6 | 0.15 | 33 |
| LAB424 | 66715.2 | 0.8 | 0.22 | 18 | — | — | — | — | — | — |
| LAB422 | 65936.5 | 0.8 | 0.18 | 20 | — | — | — | — | — | — |
| LAB422 | 65939.2 | — | — | — | — | — | — | 10.8 | 0.3 | 24 |
| LAB404 | 66778.2 | — | — | — | — | — | — | 12.4 | 0.07 | 42 |
| LAB403 | 66800.3 | — | — | — | — | — | — | 11.1 | 0.22 | 28 |
| CONT. | — | 0.6 | — | — | 0.5 | — | — | 8.7 | — | — |
| LAB593 | 66340.2 | — | — | — | — | — | — | 12.5 | 0.27 | 16 |
| LAB507 | 66798.1 | 0.8 | 0.16 | 26 | — | — | — | — | — | — |
| CONT. | — | 0.6 | — | — | — | — | — | 10.8 | — | — |
| LAB609 | 65708.2 | 0.8 | 0.26 | 16 | — | — | — | 11.5 | 0.1 | 24 |
| LAB609 | 65709.3 | — | — | — | — | — | — | 11.2 | 0.14 | 20 |
| LAB609 | 65710.2 | — | — | — | 0.6 | 0.08 | 16 | 12.1 | 0.04 | 30 |
| LAB609 | 65711.2 | 0.8 | 0.29 | 15 | — | — | — | — | — | — |
| LAB585 | 65399.1 | — | — | — | — | — | — | 10.9 | 0.23 | 17 |
| LAB573 | 65571.2 | 0.8 | 0.2 | 16 | — | — | — | — | — | — |
| LAB540 | 65883.2 | — | — | — | 0.6 | 0.13 | 14 | 10.9 | 0.24 | 17 |
| LAB540 | 65884.8 | — | — | — | — | — | — | 10.9 | 0.24 | 17 |
| LAB534 | 65879.4 | — | — | — | 0.5 | 0.17 | 13 | 12.6 | 0.02 | 35 |
| LAB510 | 65991.1 | — | — | — | — | — | — | 11.1 | 0.2 | 18 |
| LAB510 | 65991.2 | — | — | — | — | — | — | 10.7 | 0.28 | 15 |
| LAB510 | 65992.4 | — | — | — | 0.6 | 0.13 | 14 | 11.4 | 0.14 | 22 |
| LAB504 | 66014.6 | — | — | — | — | — | — | 11.1 | 0.27 | 18 |
| LAB504 | 66015.2 | — | — | — | — | — | — | 11.1 | 0.22 | 19 |
| LAB504 | 66018.1 | — | — | — | — | — | — | 11.2 | 0.17 | 20 |
| LAB460 | 65645.1 | 0.9 | 0.06 | 25 | — | — | — | — | — | — |
| LAB455 | 66009.4 | — | — | — | — | — | — | 10.9 | 0.22 | 17 |
| LAB455 | 66011.1 | — | — | — | 0.5 | 0.23 | 11 | 11.6 | 0.09 | 24 |
| LAB440 | 65957.4 | — | — | — | — | — | — | 10.8 | 0.24 | 16 |
| LAB410 | 65406.2 | — | — | — | — | — | — | 10.8 | 0.29 | 16 |
| LAB406 | 65515.2 | — | — | — | 0.5 | 0.14 | 14 | 12.3 | 0.04 | 31 |
| CONT. | — | 0.7 | — | — | 0.5 | — | — | 9.3 | — | — |
| LAB595 | 65270.2 | — | — | — | 0.4 | 0.28 | 9 | 9.6 | 0.1 | 21 |
| LAB595 | 65273.2 | — | — | — | — | — | — | 9.1 | 0.3 | 14 |
| LAB595 | 65273.3 | — | — | — | — | — | — | 9.4 | 0.24 | 18 |
| LAB576 | 65329.2 | — | — | — | 0.5 | 0.15 | 14 | 10.9 | 0.02 | 37 |
| LAB546 | 65153.2 | — | — | — | 0.4 | 0.2 | 11 | 10 | 0.05 | 25 |
| LAB544 | 65694.1 | — | — | — | 0.4 | 0.24 | 9 | 10 | 0.05 | 25 |
| LAB524 | 65135.1 | — | — | — | 0.4 | 0.25 | 9 | 9.3 | 0.19 | 17 |
| LAB517 | 65657.1 | — | — | — | — | — | — | 9.4 | 0.19 | 18 |
| LAB509 | 65118.3 | — | — | — | — | — | — | 9.2 | 0.21 | 15 |
| LAB509 | 65118.4 | — | — | — | — | — | — | 9.1 | 0.28 | 15 |
| LAB509 | 65119.5 | — | — | — | 0.4 | 0.19 | 11 | 10.7 | 0.01 | 35 |
| LAB509 | 65121.2 | 0.8 | 0.19 | 22 | 0.5 | 0.03 | 19 | 11.8 | L | 48 |
| LAB506 | 65114.2 | — | — | — | 0.4 | 0.26 | 9 | 9.1 | 0.26 | 15 |
| LAB505 | 65105.1 | — | — | — | 0.5 | 0.12 | 14 | 9.5 | 0.17 | 19 |
| LAB457 | 65100.1 | — | — | — | 0.4 | 0.21 | 10 | — | — | — |
| LAB449 | 65099.4 | — | — | — | 0.4 | 0.19 | 11 | 10 | 0.04 | 26 |
| LAB446 | 65090.3 | — | — | — | 0.5 | 0.04 | 17 | 10.4 | 0.02 | 30 |
| LAB446 | 65091.2 | — | — | — | 0.4 | 0.27 | 9 | 10.1 | 0.05 | 26 |
| LAB446 | 65093.2 | — | — | — | — | — | — | 9.3 | 0.23 | 17 |
| LAB446 | 65094.1 | — | — | — | 0.4 | 0.19 | 10 | 10.1 | 0.04 | 27 |
| LAB444 | 65086.1 | — | — | — | 0.5 | 0.12 | 13 | 9.8 | 0.08 | 23 |
| LAB444 | 65086.2 | — | — | — | 0.4 | 0.27 | 9 | 9.3 | 0.22 | 17 |
| LAB444 | 65087.1 | — | — | — | 0.5 | 0.08 | 14 | 10.8 | 0.01 | 36 |
| LAB444 | 65088.5 | — | — | — | 0.4 | 0.26 | 10 | 9.3 | 0.22 | 16 |
| LAB442 | 65545.5 | — | — | — | 0.5 | 0.08 | 14 | 10.6 | 0.02 | 33 |
| LAB442 | 65546.2 | — | — | — | 0.4 | 0.22 | 10 | 9.2 | 0.24 | 15 |
| LAB442 | 65549.2 | — | — | — | 0.4 | 0.18 | 11 | 9.3 | 0.21 | 16 |
| LAB428 | 65079.1 | 0.8 | 0.17 | 21 | 0.4 | 0.26 | 9 | 11 | L | 38 |
| LAB428 | 65082.3 | — | — | — | — | — | — | 9.4 | 0.16 | 19 |
| LAB425 | 65533.1 | — | — | — | 0.4 | 0.26 | 9 | 9.5 | 0.14 | 19 |
| LAB425 | 65534.2 | — | — | — | — | — | — | 9.5 | 0.15 | 19 |
| LAB423 | 65527.1 | — | — | — | — | — | — | 9 | 0.3 | 13 |
| LAB423 | 65527.3 | 0.8 | 0.17 | 21 | — | — | — | 9.2 | 0.29 | 16 |
| LAB423 | 65528.2 | — | — | — | 0.4 | 0.15 | 12 | 10.1 | 0.04 | 27 |
| CONT. | — | 0.7 | — | — | 0.4 | — | — | 8 | — | — |
| LAB588 | 66332.4 | 0.8 | 0.21 | 12 | — | — | — | — | — | — |
| LAB588 | 66334.1 | 0.8 | 0.2 | 13 | — | — | — | — | — | — |

TABLE 115-continued

Genes showing improved plant and rosette growth performance at standard growth conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB588 | 66336.3 | 0.7 | 0.21 | 11 | — | — | — | — | — | — |
| LAB584 | 66074.5 | 0.8 | 0.17 | 13 | — | — | — | — | — | — |
| LAB584 | 66077.2 | — | — | — | — | — | — | 9.3 | 0.23 | 18 |
| LAB576 | 65332.2 | — | — | — | — | — | — | 8.9 | 0.3 | 14 |
| LAB564 | 66062.2 | 0.7 | 0.28 | 10 | — | — | — | — | — | — |
| LAB564 | 66062.3 | 0.8 | 0.13 | 15 | — | — | — | — | — | — |
| LAB539 | 66137.4 | — | — | — | — | — | — | 9.3 | 0.16 | 19 |
| LAB539 | 66138.2 | — | — | — | 0.5 | 0.18 | 9 | 10.3 | 0.03 | 31 |
| LAB519 | 66323.1 | 0.8 | 0.16 | 13 | — | — | — | — | — | — |
| LAB516 | 65870.2 | 0.7 | 0.28 | 11 | — | — | — | — | — | — |
| LAB513 | 65124.5 | 0.8 | 0.15 | 14 | — | — | — | — | — | — |
| LAB513 | 65125.1 | — | — | — | — | — | — | 9 | 0.26 | 15 |
| LAB513 | 65125.2 | 0.8 | 0.2 | 12 | — | — | — | — | — | — |
| LAB511 | 66254.3 | 0.8 | 0.18 | 12 | 0.5 | 0.22 | 7 | 10 | 0.05 | 27 |
| LAB492 | 66053.3 | — | — | — | 0.5 | 0.16 | 9 | 9.7 | 0.09 | 23 |
| LAB492 | 66053.4 | 0.8 | 0.15 | 14 | — | — | — | — | — | — |
| LAB474 | 66470.4 | 0.7 | 0.29 | 9 | — | — | — | — | — | — |
| LAB465 | 66112.2 | — | — | — | — | — | — | 9.8 | 0.08 | 25 |
| LAB465 | 66114.1 | — | — | — | — | — | — | 8.9 | 0.28 | 14 |
| LAB465 | 66114.2 | — | — | — | — | — | — | 9 | 0.28 | 14 |
| LAB444 | 65085.1 | — | — | — | — | — | — | 9.5 | 0.12 | 21 |
| LAB444 | 65088.5 | 0.8 | 0.21 | 12 | — | — | — | — | — | — |
| LAB437 | 66452.2 | — | — | — | — | — | — | 9 | 0.27 | 15 |
| LAB434 | 66446.1 | — | — | — | 0.5 | 0.06 | 12 | 11.8 | L | 50 |
| LAB434 | 66447.2 | 0.8 | 0.12 | 15 | — | — | — | — | — | — |
| LAB434 | 66448.4 | — | — | — | — | — | — | 9 | 0.28 | 15 |
| LAB427 | 65539.12 | — | — | — | 0.5 | 0.25 | 8 | — | — | — |
| LAB427 | 65543.2 | — | — | — | 0.5 | 0.28 | 6 | 9.2 | 0.18 | 18 |
| CONT. | — | 0.7 | — | — | 0.4 | — | — | 7.8 | — | — |
| LAB530 | 66264.2 | 0.8 | 0.17 | 11 | 0.5 | 0.2 | 9 | 11.7 | 0.14 | 20 |
| LAB529 | 65393.3 | 0.8 | 0.24 | 9 | — | — | — | — | — | — |
| LAB503 | 66216.2 | 0.8 | 0.17 | 9 | 0.5 | 0.16 | 10 | — | — | — |
| LAB452 | 66172.4 | 0.9 | 0.01 | 19 | 0.5 | 0.06 | 13 | 12 | 0.08 | 24 |
| LAB452 | 66172.7 | 0.8 | 0.13 | 11 | 0.5 | 0.22 | 9 | 11.3 | 0.24 | 16 |
| LAB437 | 66454.2 | 0.8 | 0.08 | 13 | 0.5 | 0.26 | 8 | 12 | 0.09 | 23 |
| LAB430 | 66207.4 | — | — | — | 0.5 | 0.13 | 10 | 11.1 | 0.27 | 14 |
| CONT. | — | 0.7 | — | — | 0.4 | — | — | 9.7 | — | — |
| LAB610 | 65342.3 | — | — | — | 0.5 | 0.11 | 16 | 14.2 | 0.04 | 35 |
| LAB610 | 65342.5 | 0.9 | 0.15 | 21 | — | — | — | — | — | — |
| LAB596 | 65595.2 | — | — | — | 0.5 | 0.28 | 11 | 13.2 | 0.13 | 25 |
| LAB596 | 65597.1 | — | — | — | 0.5 | 0.22 | 13 | — | — | — |
| LAB590 | 65347.1 | — | — | — | 0.5 | 0.11 | 17 | 13.1 | 0.14 | 24 |
| LAB590 | 65347.2 | 0.8 | 0.29 | 12 | — | — | — | 12.7 | 0.2 | 21 |
| LAB590 | 65348.1 | — | — | — | 0.5 | 0.11 | 21 | 13.2 | 0.18 | 25 |
| LAB590 | 65349.4 | — | — | — | 0.5 | 0.22 | 13 | 14.8 | 0.02 | 41 |
| LAB590 | 65350.2 | — | — | — | 0.5 | 0.13 | 15 | 14.9 | 0.02 | 41 |
| LAB578 | 65581.3 | 0.8 | 0.29 | 12 | — | — | — | — | — | — |
| LAB577 | 65579.2 | 0.8 | 0.26 | 11 | — | — | — | — | — | — |
| LAB565 | 65722.1 | — | — | — | — | — | — | 12.6 | 0.23 | 20 |
| LAB565 | 65723.2 | — | — | — | — | — | — | 13.1 | 0.14 | 24 |
| LAB565 | 65723.3 | — | — | — | — | — | — | 12.7 | 0.3 | 20 |
| LAB557 | 65317.6 | — | — | — | — | — | — | 12.8 | 0.2 | 22 |
| LAB535 | 65685.1 | — | — | — | 0.5 | 0.18 | 16 | 13.7 | 0.09 | 30 |
| LAB531 | 65681.5 | — | — | — | 0.5 | 0.26 | 11 | 13.1 | 0.12 | 25 |
| LAB527 | 65672.2 | 0.8 | 0.23 | 12 | — | — | — | — | — | — |
| LAB523 | 65660.3 | 0.9 | 0.16 | 17 | — | — | — | — | — | — |
| LAB522 | 65130.1 | — | — | — | — | — | — | 12.5 | 0.25 | 19 |
| LAB522 | 65132.1 | — | — | — | 0.5 | 0.02 | 25 | 14.4 | 0.03 | 36 |
| LAB494 | 65649.3 | 0.9 | 0.15 | 14 | — | — | — | — | — | — |
| LAB494 | 65651.4 | 0.9 | 0.18 | 14 | — | — | — | — | — | — |
| LAB450 | 65306.1 | 0.9 | 0.02 | 24 | — | — | — | — | — | — |
| LAB450 | 65309.2 | 0.9 | 0.15 | 14 | — | — | — | 12.6 | 0.24 | 19 |
| LAB409 | 65522.1 | — | — | — | — | — | — | 12.4 | 0.27 | 17 |
| LAB409 | 65524.2 | 0.8 | 0.19 | 13 | — | — | — | — | — | — |
| LAB409 | 65524.5 | — | — | — | 0.5 | 0.21 | 15 | 12.9 | 0.17 | 23 |
| LAB401 | 65728.1 | — | — | — | 0.5 | 0.16 | 16 | 13 | 0.18 | 23 |
| LAB401 | 65728.4 | 0.8 | 0.27 | 11 | — | — | — | — | — | — |
| LAB401 | 65729.2 | — | — | — | 0.5 | 0.26 | 13 | — | — | — |
| LAB400 | 65510.2 | — | — | — | 0.5 | 0.21 | 14 | 13.8 | 0.07 | 31 |
| LAB400 | 65511.2 | — | — | — | — | — | — | 12.8 | 0.2 | 22 |
| CONT. | — | 0.8 | — | — | 0.4 | — | — | 10.5 | — | — |

TABLE 115-continued

Genes showing improved plant and rosette growth performance at standard growth conditions

| Gene Name | Event # | RGR Of Leaf Number | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val. | % Incr. |
| LAB596 | 65593.5 | 0.7 | 0.23 | 24 | — | — | — | — | — | — |
| LAB596 | 65594.2 | — | — | — | 0.6 | 0.13 | 13 | 13.4 | 0.14 | 21 |
| LAB596 | 65595.2 | — | — | — | — | — | — | 13.2 | 0.15 | 19 |
| LAB590 | 65347.2 | 0.7 | 0.19 | 26 | — | — | — | — | — | — |
| LAB590 | 65348.1 | — | — | — | 0.6 | 0.28 | 9 | — | — | — |
| LAB590 | 65349.4 | — | — | — | 0.6 | 0.25 | 10 | 13.2 | 0.2 | 20 |
| LAB565 | 65723.3 | — | — | — | 0.6 | 0.28 | 9 | — | — | — |
| LAB535 | 65684.1 | 0.7 | 0.22 | 24 | — | — | — | — | — | — |
| LAB535 | 65685.1 | 0.7 | 0.19 | 26 | — | — | — | — | — | — |
| LAB531 | 65678.1 | 0.7 | 0.25 | 22 | — | — | — | — | — | — |
| LAB531 | 65679.3 | 0.7 | 0.18 | 27 | — | — | — | — | — | — |
| LAB531 | 65681.4 | 0.7 | 0.17 | 26 | — | — | — | — | — | — |
| LAB527 | 65672.1 | 0.7 | 0.25 | 25 | — | — | — | — | — | — |
| LAB522 | 65131.2 | — | — | — | — | — | — | 13.2 | 0.24 | 19 |
| LAB516 | 65874.2 | — | — | — | 0.6 | 0.14 | 12 | 12.8 | 0.23 | 16 |
| LAB494 | 65651.4 | 0.7 | 0.25 | 22 | — | — | — | — | — | — |
| LAB427 | 65544.1 | — | — | — | 0.6 | 0.27 | 9 | 14 | 0.06 | 27 |
| LAB400 | 65509.1 | 0.8 | 0.15 | 28 | — | — | — | — | — | — |
| CONT. | — | 0.6 | — | — | 0.5 | — | — | 11.1 | — | — |
| LAB544 | 65693.2 | 0.8 | 0.07 | 32 | 0.5 | 0.11 | 15 | 12.2 | L | 41 |
| LAB544 | 65694.1 | — | — | — | — | — | — | 10.6 | 0.16 | 22 |
| LAB517 | 65654.1 | — | — | — | — | — | — | 10 | 0.29 | 15 |
| LAB517 | 65655.4 | — | — | — | — | — | — | 10.5 | 0.11 | 21 |
| LAB509 | 65118.3 | — | — | — | — | — | — | 10.4 | 0.14 | 20 |
| LAB509 | 65119.5 | — | — | — | 0.5 | 0.04 | 24 | 11.9 | 0.02 | 37 |
| LAB442 | 65545.5 | — | — | — | 0.5 | 0.03 | 23 | 11.6 | 0.02 | 33 |
| LAB442 | 65546.2 | — | — | — | — | — | — | 10.4 | 0.15 | 19 |
| LAB442 | 65549.1 | — | — | — | 0.5 | 0.27 | 11 | 9.9 | 0.28 | 14 |
| CONT. | — | 0.6 | — | — | 0.4 | — | — | 8.7 | — | — |
| LAB597 | 66272.8 | 0.8 | 0.2 | 13 | — | — | — | — | — | — |
| LAB597 | 66273.2 | 0.8 | 0.28 | 11 | — | — | — | — | — | — |
| LAB588 | 66332.2 | 0.8 | 0.08 | 18 | — | — | — | — | — | — |
| LAB588 | 66335.1 | — | — | — | 0.5 | 0.26 | 10 | 10.2 | 0.29 | 17 |
| LAB588 | 66336.3 | 0.8 | 0.15 | 14 | — | — | — | 10.1 | 0.3 | 17 |
| LAB584 | 66075.3 | 0.8 | 0.08 | 17 | 0.5 | 0.13 | 14 | 11.6 | 0.04 | 33 |
| LAB564 | 66063.2 | — | — | — | 0.5 | 0.25 | 11 | 10.2 | 0.29 | 17 |
| LAB553 | 66057.1 | — | — | — | 0.5 | 0.11 | 15 | 11.2 | 0.09 | 28 |
| LAB539 | 66135.2 | — | — | — | 0.5 | 0.08 | 16 | 11.3 | 0.07 | 30 |
| LAB519 | 66321.1 | 0.8 | 0.29 | 10 | — | — | — | — | — | — |
| LAB519 | 66321.2 | — | — | — | 0.5 | 0.09 | 16 | 11.1 | 0.1 | 27 |
| LAB519 | 66324.1 | 0.8 | 0.29 | 11 | — | — | — | — | — | — |
| LAB511 | 66257.1 | — | — | — | 0.5 | 0.28 | 10 | 10.4 | 0.23 | 19 |
| LAB492 | 66053.3 | 0.8 | 0.19 | 13 | — | — | — | 10.6 | 0.19 | 22 |
| LAB492 | 66054.4 | — | — | — | 0.5 | 0.08 | 17 | 10.5 | 0.2 | 21 |
| LAB471 | 66188.2 | 0.8 | 0.23 | 11 | — | — | — | 10.3 | 0.25 | 19 |
| LAB471 | 66190.2 | 0.8 | 0.3 | 10 | — | — | — | — | — | — |
| LAB471 | 66191.2 | — | — | — | 0.5 | 0.3 | 10 | 11 | 0.11 | 26 |
| LAB465 | 66111.2 | — | — | — | 0.5 | 0.27 | 10 | 10.7 | 0.16 | 23 |
| LAB465 | 66114.2 | 0.8 | 0.08 | 18 | — | — | — | — | — | — |
| LAB407 | 66244.1 | 0.8 | 0.09 | 16 | — | — | — | — | — | — |
| LAB393 | 66287.2 | — | — | — | — | — | — | 10.2 | 0.28 | 18 |
| LAB393 | 66288.2 | — | — | — | — | — | — | 10.5 | 0.2 | 21 |
| LAB393 | 66288.3 | 0.8 | 0.25 | 11 | — | — | — | — | — | — |
| CONT. | — | 0.7 | — | — | 0.4 | — | — | 8.7 | — | — |

Table 115.
"CONT."—Control;
"Ave."—Average;
"% Incr." = % increment;
"p-val."—p-value,
L - p < 0.01.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification to are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (7729 sequences)

SEQ ID NO: 1 - DNA, 1618 bp, Hordeum vulgare
gaagtcaggccgagtcaagaagatatccatcgacaattccagtatcgttccctacataagcttctatactccagatcaagctgggacaataatgcatccatcaaccctggcctcctcctcagagaatgttgaggtggcccaagatgagtaccgcgatctgctgctcctgcgctcaagcgggcaggtgggcgacgtgggggagcgcggcggatgggaggaagtgcgcgacaaggagaatgagggtgatgaggagaaaggggaacagatggagaaagatgtgcaggagctttgcacgtttgggttcaaggccattgagaataaggacttctccggcgctgtagactgccaacgcaggatcctcaagaccagggtggcacatcatggtaaactttctccaaagtgttgcagtgcatattacaactatggatgtgctttgctacggaaaactcaatcaattcaagatccagaggatggtatgtccttttaccccatgtagtctagtgcactggagaacattgttattctatacaataaggttactgattgtgatttacgactatggatgtgctttgctacggaaaactcaatcaaatcaagatccagagaatggtatgtccttttaccccatgtagtcaagtgcactggaaaaccttgttattctatacagtaaggttactgattgtgatttacgaccttgccactttgtctgttcatacctgctgacgatgtgcatttcttcctgtcacgctaaatgctaatgtaaccattggaaacatgattctgattttttgttttgtttttgccaatataagaattttggccagatttgtatctggcctggaaaatgttgcatgttgcaagggcaatatctgagaagagtcctggcagcaatatggagaagtataaaatctttgctgctcttgctaaagtctctgtggaaatagacgacaccgattactcgctcattgcgtgcttcaaagctttggccatgttggagcatttgctggagtgtgatcatcatcatattatcaatctaaacttacaggtacgttttgccttcgagttggaatccatgattggagatgcaaaggctatttcattgttcaagtcacgtatagagaacttgaaaagggcgagtgaagatttgttggctgataatggtgatgatgcatcatttactgaagttggctcagaaaaatcctttccagccaaggaaatacggttccttactgacacattattgggtgcattggagcacaagcttgaagacctggagcaagcaaatatcaaccccagtttcagaggcaaatgctggagccgaccttgagggcggctgcaggctgaagcgtcggacgagctaagctcaagcaaatctctgtagaagatgatagcaacgacagcttagatgttgacagagaaagctctgtatcagagtagagtacggttccgttacccctatttgttagcagcttattcctggagccttttagcttgcgatgtggtcccgttttagttagacgtaaacagccgcatgcccccttttgttctgcttaatgccgactaagctcttcagtttcggcatgtatgactggtttcagtagtcaaatttggtttagct

SEQ ID NO: 2 - DNA, 3857 bp, Hordeum vulgare
  misc_feature (725)..(725): n is a, c, g, or t
atttgatatgcagttctatatcaagtgaaggaaacaaggtttttatgatggattacaagtactctgatatgatagattctgctgaggtgcctattgctgataatagaacattgccagattgggcagaaccactagagcctgtgagaaaattaccgacaaatgtgggaacaagaattagaaagtgtgtttatgaagctttggatcgaaaaccaccagaatgggcaaggaaaattttggaacattcgataagtaaagaggtctacaagggtaatgcatctggaccaaccgagaaagctgttttatctgtgttgtcagaggcatgccgtgtaatagtgccacaaaaacctgaaaacccaagaaatgaaaggaaaactatttccatctcagaggttgtcttgaaaaagtgtcgcattgctctgcgccatgccatttcctcagatgaatctaagctttttgggaatttgcttggaactactctagtgaactctaatgagaatgaggatgagggcatccttggattttctggtatggtgccacgccctttggacttccgcacaattgatacaaggttggctatgggagcttactatggatcttgggagactttttttgaggatgtgcaagaggtaatccgtaatctgtacactgcatttgctgatcgagctgacgtagtggaaatggttgcagaattgtctcagagtcttgaatccttatataagacagangtgctcgaccttgttcagaaatttgattgtcacctttctaatgagaatactgattcagaaatccaggaggagctacaagatattctgactgcagcaaccaaattacctaaagctccatgggaggacggtgtttgcaaagtatgtggcattgatagagacgatgaaagtgttctcttatgtgatgagtgtgactcagaatatcatacttactgcttgaatccaccactagctcgtataccacaaggagactggttctgcccatcacgcatgttaaagccaaagaaaaaatcacgtcttgatcagggtgctcaggattcgaaacgacagcgaaaaggtgcagagtctaatgcctttcatgacaaaccatcgtgcatgtcaggtcaaaagaaatcacatcttgaccagggtgttcaggatttgaaacgacaacgaaaaggagccttccatgacatacttattaagttagctgcagcaatggaacaaaaggagtactgggagcttagcacacaagagagagtaaatatgccgaaatttctgtgtgatgaaatgcttaacacagtcctggtaagagaacatatagaaaaatgtccagataaattgaatgatctccagcagaagtttcgtgctttgaattccgaattgaaagatttgaaatataaggaggaaatgaggacttcatatgctagacaaagcagatggggcaagactgaacagcacattagcaattgttctggacttgcggaaaatcaacagaatgaagtggccatagcatcagaccatgttgaagagtctgaacagggtaatactggagttagcctcaaccacccagctgaagggagtcctcctgggcaactaaatgttggcaaaccttgcaaaagtgacaatggcatgcctatggttgaagaaaataagtctttgggactttctgaacaaccatcagggacaggtagtgacctgattgaagggaacattatgaatgaagggtcgcgtgataacttcaatttggtggacactcctatttctgaaagagaaccagtagctacacctctcaatacaccgggtggggagttgcctgatgaaaatgctagcacgtcccaagataatctgaaaatgtcaacaactagatcacttgagcaaggtgctgataatggtgaaatggatactttatcggacgagatttcaaaagtgcaggagtcaattggcacagtagagtcacagcttaatatgtcatcccccagaagagattgtttgggaaaggattccttgggtcgattgtactgggttttaggacgatctggtaaacgtcctttgctggtcgctgacggaagcacactgatatgcaaggagagggacattaacatggttaatagctaccccccctctacttctgattgtaaaggatggaattctgcatctattgtcatttatgaatcggattaagaaatccgtattcttgttgactggctaagggaatacgatccaagggagaaggagctgaaagatgctatccagcagtggcagcggcatctttatcacctgggcaattttgttctcagtgatcctccagtatccaagggggcgaacagcgagcagcagcttatggaccttcccagtaccaaggctggagcaattttggagaaaacatgccgctgcgactgcttagagcctatatggcccgctcgacaccactgcatagcatgccacgagacttgctccacatcaacggagtatgaagagcatgctggaaagtgcaatggagatgtgaaggagaaggattccgttgatcctagctccactgctgagtccagaaaactgaagtcatgcccatatgactttgaagagatttgcagaaaatttaccacgaatgattcaaacaaggagatagtgaaggatattggacttattggatcaaacggagttccgtcttttgtcccgtcacctgcatcttttcttgagcctccagttattctgcataaaaacaaaaaagatgacatcccaaatgattgggtttcctccttagaggaatgccagacaatgcctgcacaaaagttagggcaggaggggtccaattctggtcaaaattgtcctggtagtacgggtgatgaaaatgtgtcaaaatctaagaaggccgcctctgatagtacttcctgtgaggaagcatcttctgcaacagacaagccaacaagattgctagctgttaatggtggcttggttccggagtcatcattgaggcctgttataggaagaaactctcatatcctaaagcagcaaaagataaatttgcttgatatagatgcagcgttgcctgaggaagcttggagagcctcaaagtctcaacaaataagaaggcattcatggcgtgcttttgtgaaacatgcagaatcaatatccgagatggtactggcgaccagtgtgttggagagtatgataaaatctgagttcctgaagaatgattggtggtactggtcctccttcacagtagctatgaagacctcaactgtatcctcgctcgctctcaggatctacacccttgacgactgtatcatgtacaccaaggagcctaacaccatgccggctgacagtacaaaggttgtaaacaaggggaagaggagaaaagagccagaaccatcagggtcgtaaccaaacttagaagttccgcagacggtgcaacaatgtgacgctgtggtgatagagatggtatagacagagtctttggttatgtggtcccttgagcttttagggctattctggtgttcctgcaagggtgcaaccttgaccgtccattctaataagccatatttaccagactatagttgtgcaccttagatatgttagggccagagaagaagcaaaatgcgttgtttcgaggatggcagcggcaagagctggcatttaattttaaagccaggagcagcttgcatgcgagcgtagtttttcctttgggacaaacctgttttggctttcagggttacatatcatatatgtcaggtgccatttgtacccaccttcacatgattgatagcatgtggcgggtagtggtcgttaccctttctgttaaacgatacatgttttaggttttcacagcatacaaatttgaaccgagaatttcactagaacaagctggcaatttaa

SEQ ID NO: 3 - DNA, 2232 bp, Hordeum vulgare
ctcgggtgtccggcggccggagcgcctcactgctcggtcgccatggcgtccctcgtgccccggctcctctcccgccgccggatcctgcaacccgccgtcgctctatgctctccatgcgatccttggatgcgattccgcggcgcaagttccccacgcccctgcccgctgttccgaccttccctggggggtgatggacgcggggaacctgcggggatatgctggtttctctcgccggtgaggcacgggagcacggcggtgacgctggacacgggcggcggctttgcccgcttctcgttcggagatccaggcacgacgaagcagaatggggggcaggatcagccgccagcggagaagaggaagaagatgtccaagaagtccaaggtcaaccagctcaagtggttccgcctcaaggccaaaaagaagatgaagtcgcccaaccccgaagtcaggataagatacaagctcgaaaaggccaagaggaaagaagagtggctgattgagaaactcaggaagtacgaggccccgagggctccggagcctgttcacgaccctgagattctgatcaaggaggagaagttttatctgaaacggactggggagaagaaaaagaactatgttcctgttgggaggagaggggtgtttggtggtgtggttctcaacatgcacctccactggaagaagcatgagactatgaaagtggtctgcaagccctgtcggcctgggcaagtgtacgagtacgcggaggagctggcgaggctcagcaaagggacagtcattgatattaaacccaataataccattatcttttatcgtgggaagaactatgtgcagccaaaggttatgtcacctcctgatactctttctaagcagaaggccttggagaaatataagtatgaacagtctcttgaacataccagtaaatttattgagcagttggaacaggagcttgaagattaccagaagcatgttgctttatttaagaagcgcgagggagctaattctgagcaaatcagtaatgaagactctgctgttgatgacctcacaactagctcagatactgattgaatcaccttcttacatcaattgacatctcatattctctccgcaatgaaggtttgagaagatctcaccacccgaaaaacttatgtcatgtttgttttttcactcttccaaatgtttggcaggtgcaagagacgtttggttgcggccacagttgctgtgtatcacacttctctaacattgtatttataccccacctatcaatatcatagatctttatttacccaagttttgtcataagtgtggcgaccaatttgatcaccacaaactgccacttggcataactgttacacaaaagtgaggtaatttgcgggtggcagccaaacatgcccttagatgcagcgctttatattcatactcaattgagaagcctgccctcagatagggtgcaatggaaattagacagcttgcttcaatgcttggaatcagcccttgtgtaggcgcttcctcataaaatggaaaaagggccaactagtagttcaagagctattatactgctggagtaccctatgaggaatcaagtaccatgaacatatttatgggatggtcacattgaaagttggtaaagtttactgtttgaagatttaaggtagcagtggatgctgatggtggaggacatgagttgaactttgtgtgacagatgggcttgcttgttgcttcaatattgaaaaatcaactttggttatctgttgcaaaggaagcctctcaaatggaaactgtgaagacctggagacgtaatggatgcccattggggatttcttgaccactgaagagatgatttacagaccgttgaaatgagagcatactggttattctatatgtaaagcagcatttctggatcacacaaagatgaatgtgctgcttcacaaacttttggttataaatggacgaagtccttatctgcacgtaaatgtaaactagctgtactttttcgtataattggtgttaatttttttcttatatggactttatcaagaagattgcaattctattagaagaagagaataacccggcctagttatcagtatctttgttttgctgtcactatcgatgtatgcatgtcgtggcactcttgccatccattttgtgcagctccctccacattgagaagtacttgtcatccatccaaaaagaaaaaaaaaaaaaaaaacactgtcatgccgttacgtagcg

SEQ ID NO: 4 - DNA, 599 bp, Sorghum bicolor
aagcaactccagtccaaccaccaagaacaaccggaacagaagaggagaggagaagagaagagaagagaagagaggaggctccccagttggtaccaattctcgcagagataaggagaagcaatcagacatgagaacccaagcgctgttcttcctgacattcgcccttctcgccgtgctcgcgcaatccagcaacaggcaccaccaccaccaccaccactcccaggttcaaagcagagggcagggaggaggaggaggaggggagcttgcgagccggggcaaggcggcggcgcgagcgtggccgtgctgcgacagctgcggcgggtgcaccaagtcggagccgcggcggtgccagtgcctggacgcggtgccccgcgggtgccacccggcgtgcagggactgcgtcaagtccagtctcagcgccgacccgccggtgtaccagtgcatggaccgcgtccccaacttctgccagcgccgctgcaccgcgcccgccgccgcgcactgaccgcccgcccggccgtgctgacgactgatttctgctttgctctttgacccaccaaccgctcccaccgcccacccgccgccggatcctgtgtctcaag

SEQ ID NO: 5 - DNA, 525 bp, Helianthus annuus
cggggatcttattttgtctttcaagtgaaaatggcttctaagacatttcttcttcttgcccttgtttttgctgtcgttcttctaattacctcagaagtagccgctagagacttagcctccaagcatgacggtgaggttgatggccgtagtggatacaaccgcggtagcggcggacatggaggatacaacaacggaggcggacgatacaacgttgatggacgtggaggatacaacaaaggcggcggacatggaggatacaatggtggtggacatggagggcatggcaaaggtagtggtggccgtggagggcatggcaaaggtggtggtggtgaagaggcaactgcttacaaagaaactcaaaactgatgataagcatattcgagctggatgaaacatatataatttcatgagtcgagtattataagaatgttttatcttgcatcatcagtacatactccttatatatgtaatacttggcatgactccttgtgtgtatagaataagttaataagagtgtacttttga

SEQ ID NO: 6 - DNA, 1332 bp, Solanum lycopersicum
gacgcaccttttcttttcttttttttagaagagaagagaaaagaaaaagaaagttggtcacgaggagaaagtgagttgtgttgacaaggaattaaattaaaaatggagaaaaatgaattgatgaagttgaaaagtagtgagagtcaggtgatggacggttcagatataatgaagttagttggaaatgaggctgtgtttagtaactttgtagatcataagtttgaagaacttgacatagacaaagacggtaaactttcagtgaaggagttacaacctgctgttgctgatattggtgttgcccttggtttacctcctcaaggttcttcccctgaatctgatcatatctactctgaggttcttcaagaattcacacatggaaagcaagagaaagtaagcaagactgagtttaaagaagttctttcagatattttactaggaatggctgctggtctaaagcgagatcctattgtactccttcgtatggatggtgaagatcttcttgagttcgttaaaagtcctgcattcgaaccagagatgatttccctgtactctgagttagaattgcctgatggatccctcaaagattacatcatcaaggcttttgagaagctcacggttgatcaagggatgcctcctgcatcagactcatgggtaatgagtaatgttgtggagccagtagttgaatcctgcattggagcaactaacgagcaacctgttacacaagaaacatttttggctgaatttaagaaagttgcagagagtgctgctcaacgtctcaaggagcagccagtcattgttgctcacagcgagaatacatttgatggaagtggaattaaaagactattgtctaacaagtttgaattggataagacgctggactctgccttaaagactatacccagagatcgcaatgggaaaatgtcaaaggaatacctacgagttgcacttgatgttcttgcaccatcagctggtttacctcccattggtgctgttgatcagatggataaggtcatacaagaagtctgtaagatgttggatgccgatgatgggaagatggttaaagaggaagagttcaagaagttgttgactgaaatactgggcagcatgatgctgcaattagaagggaagccagtttcggtgtccacaaactctgttgtgcacgagcctcttgcttcttcctctacgctcttgcagcctccatctatttctgagatgtaactgatcttattaaattagacaaaaaaaaagaataacaggggatgtatgatgtaaatttctgttaaaatttaaaggctgagagacactgccttactaatacagtatccatttcag

SEQ ID NO: 7 - DNA, 1394 bp, Solanum lycopersicum
ttgtgagaagaatctacaagcttccgtcattctttctataactgaaattcccaacctctttcttctttcacttccattaacctagctctcaattctatacctaacaatactcttgttggtgctctgatcgatcgtttgagaagtaggtaggtttgtgcaaagtgatctctgatagctttttagggttttcttttggacgcaagaggaatatgaagccatactatacattgaagatgaagaggaaggatttggaagatgttaatgatgaattctctgatttttcactttcctctcccgccagaaaaattcgtcgactggatgcggtgttgcctcccataatagaagaggttgaagaaccagagattcctatagcttttgagcaagcaacaacttatcccagcttcggaagcaatgcagtaaagaggggtctagtaattgaggaactgccaagtgtgcccgcgaatgaagagagggcaattgtgctattcaagcctatgaacacacagcctatgcattccccttctaatttctccgttaaagtggatccccagtttcttaatggtttcaaaagtcaagtcttctgggataacacagcaaatgcatttagactagttgatgctaatgaagcagcgcaacaggacgactctagttctgcgaaagaatgtctggcagttgttccttgggttccatctcaatttccttctgcagcagaagctgaaatccttagtcaacctgatgtttcagatatgatggatgctgaagatatggaaggagtagctatggatattgaagataacagtgtggatgttgaaccaagaattgcagtcgatgctggtgcagttagtgtaaatgatggtttgcatcattggcagcaacagcattgtatgactacgactcaaccgcctcagaacacatcaacaccgattccctggtacagtaactggcataaggattaggatgttataattactgttagaactcttgatgggtctcctcttgcaattaagcatcggctaggtaaaagagggtgaagtaagtactagataaaagtagtagattgcgggttgaaaaggtttgggaggccgttgttttaaaagtcactgtcatggcatctaatatgtcgatggatgagctgcttatagttttctaatgtctcagctcaacataaaaatgcaaatcattaccatgtcttggatatgattttttctttattatgcctaattttggttacactgggagattctggaatggaaaatagtcactttgggaatgaaattgttcaagacaagtcatatgaaagaacgtatgctgtttgttgacaagttcgttataaaattattttgagagtttgtagtcacaaaaagaaatatggaaatatgtgatttgctattgtt

SEQ ID NO: 8 - DNA, 451 bp, Solanum lycopersicum
aattcacacacaaaaatctcactgaaaaaaaataaagtcactatgaaaaacacatcaaaaagttccaaaattacccccaaatcaagccaagatgcgagaaaagaccggcgatcggccaccggaataagtggatctccgaagaaaggcggccatggtggaaagtttacttgggccggcgacggaagttattcttctaagaaagaagaagctgatgctgctgttgttgtcgacgcaaatgaccctaattttgatgaaccggaggagaattcgattgatgaatcgtagatttgcatttcgaatgatttgaattgttgatgtaaatattgaagaatttggtgattttatgcagaatttagaggggaaaattgggaatgaatggaagggaagatctgttatctgtgttgtattaactttttgttttgataaataaaaatttatttttttccctcta

SEQ ID NO: 9 - DNA, 1752 bp, Solanum lycopersicum
caagaagaaatatttgtctcgtgttctctttctccttttctatataatgaaattctccgccctgcctttcactttctctctgcaaatctaacttctctctccgccattgctgtttttggaatcgaagctcattttacatggtgatgttggagccaacttgagtgcaccacggctaatcccacaggttacctgctgcctcccgtcaagagaggtaaaggtaaccttgcttgccaagaattacgcagattaaaggaattcaccccgattctgcgggaatctgtgcaatcgaggttcttacgctagctcttggatcacttgctgtctaggatccttgacttatttgaaagctgctatcttaaatcagtttggattagcaatgcctccaaatcctagggtcgatcgtgcttttcgttctatgaaagctcttggtatttctggagagaaggtgaagccagtgttgaagaatcttttaagattgtataacaaaaactgggaccttatagaagctgagaactatagggtccttgccgatgcaatatttgatgatgatgaagcaaaggatgcagaaattaaaaagtcaactgaggataccgaacaagaggctctggtgcaagatgagcctgaaccacctctgaaaaggcagcgcttcaaaagtcaatcaagtcaaccaaatgagtctcttgaatctcaattgcaaaaccagtcacctggtgattttgattcccctcagtccatgggcaatgaatcacaacctggatcacacccatcacttgatagaaacaaaggaaagcagcccatgtttgccgattcattagtaccacaggaagagctgccttcatctcagccttctgacgtggacaagagccttccagttcccaggagagctggatctacttctggttctggcatcccagtgtcacctacgaagaatgccattgctaatcacactcttatcaaacctaaggatgagccaatcactgatgacctgccaagtcttgaagttcctgttgccatcatccgcccaggttcatcaagtaaagggaagtcttcagttgcaagtggttcagaaggtagacatggtgatagtaacgcatcagccactgtagttgaagcagatacaaatgatggaaatccacccagtccagttgtagctaatggcaagcctgaaacaagtacagttaagtcttcttccgccctggagatggcttcctcacaatctggagaggtgaaaatgatcttgacctatggctcggtccttggaagatcagatttccagatgcctactcttgatgcagtggtgaagttaatggacgataaatgtcagaaagagtacaaagagctcgatcctaatttttccgtgatgaaggtcatgacagacatttgtcagtgcttcttggagatgagcggtgaatcaactaataaatcatctgacgagtgaacgaaatatgtcctatgaaagcatgaagagggaaggaacgagacgagttaactttgcaaaacttacattgagctaacaacattctgtgttaagctcaaaattgagcttaataacatctttcctagaattctgctgtttctctttctgtgttcttttatgtatacatttggtattagatttcgctgttttcgacgttaagaagttcccttttcagggaggaggaaaatgtgtgaatgtgttggtgaagaacctgtgttcttgaaaatgaagacatatttccttcctttacaaaatggttcaactatgtttttttt

SEQ ID NO: 10 - DNA, 1108 bp, Solanum lycopersicum
gctcagcgatgacgcactttctcacactttactaaatttgctcggttctcaccaaatgtcccaaacctctccatcaccctataaatatatgcaatttttatcttcacatttgatcatcaaaaactcaaaaattatatcttcccagcaacattaatggctactccaagtgtacaagaaattcgtcctgcatctcttgattctacttccgaatcgccagccctgtttgatggaactacaaggttgtatatcagttatgtatgcccttttgcacagcgtccatggattgccagaaatttcaagggtttgcaagataagatcgaattagttccaattgatcttcagaacaggcctgtttggtacaaggaaaaagtttaccctcaaaataaggtgccctctctggaacacaacaacaaagtgattggagaaagtctcgatctggttaaatatatcgacagcaactttgagggtccgtttcttctacctgatgaccctgaaaaacagaagtttgctgaagagttgatagcttacagtgatacgttcctgaaagaaatatatgccaacttcaaaggagatattgaaaagcatgctggacctcaatttgactacttagaaaaagctctcgacaaatttgatgacggacctttcttcctaggtcaattcagtcaggtcgatatcgtgtatgctcccttcgttgaaaggttccaaatcttcttgaaagaggggttaaattatgatatcacatctgggaggccaaaactagcaaaatggacagaggaactgaacaagcttgatagctacattcaaacaaaagctgatcctaaggaagtggtggacttatataagaaaaaatatttggcgtaaaactgaataaaacgctcgatccatcaacgttgttaaattgggaataaggggtgcttcgtgctcggttcatgtcaagaacttgaaggattatgcattagtatttttacataaataaagtggttctatgtttgtttgttatctgagagacttatatcagcatagtaatagctgtttgcatcttatgtattagtattctgttttgtgtgtatgaatctaagtactaaatgaagtattcttgtttataatt

SEQ ID NO: 11 - DNA, 1074 bp, Solanum lycopersicum
ggtatttatccctttatttaagtctatccacattctcgtcggaaagtaagtatgagtgacaatcggagtcaaagacggcgagttggagagtcgtccgaatcggaagattctggaatttacaatgagaggattcttatcttggtgtttgcctcaatgaattgggatattcctacactatgtcgaacagcctcggtaaataggaaactacgtgcagttgcgagaaggattctatggaaagagctttgcgtgtatcgagctccgcaaatgataacggccttaacggacggcggtagaattggcggcggatggcaggcgatggcaaaattgatgttcttctgcaatggatgtcaatcgacccggcatttccaagtgtgccgaccggaagcgggtcacttcgtgaaaacatcccggttttcgaagacatccggtcggagttttttggtgaagaaatgtacaagtgatttgctgtacgtgagtgatccgtgtgaacattcaactgggagcgatgatttggggcttttcagaggggtattttgggggtttatgaaatctaggacaagggcgagtttgatcagaagacgagtggagcttgaagaaggagccaagtgtccattctgtcgtgctcgggtttggagtatgacggcggctcggctcatacccaaaagtgcggcgcggcggcttggttcgatggagagtggattggagtactttgtatgtgttaatgggcacttatatggtgcttgttggctggttcctttatcgtctgatgatgaaggtgagagtgaggaagctgaccggagatttgacgacggcggcggcggctattttcatcgcgagaatcagatagtaataaatgggtctctgaattacgggcttacttcttgatgttcatcatccccgaagttagcaagcaggatcatttttgtagttcagcttgttgttaacttgagaatatgaaattttctgtgtggatgatttgatttcaattaaagtgtatgatttgtttgaagtttctaattcttaagaaattccagtggaaaaacttgtcactagccaatcaattataatcttttt

SEQ ID NO: 12 - DNA, 2120 bp, Hordeum vulgare
ctagacactctactgtatactgtagatagatagagttggggacggagacggagacgaacagctccccgccgccgccgctcctcttccttctacctcaccgccgcccgcaatcaaggcatggatgcttctcttctttcccaaagcccatgattcccttgctgcttgctcttgattcatactgaatctgcagcaacaagacaagacaagagattgattgatggaggagttcatcagtctcggcgacgactccaccgcatctgagcctcctcaaccacaggaccacgggcccacggacaaggacatcatagatctcgaccaagcccaagccgatgcagtagaccgagccgccgtcaatttgaatttcaatgctactctgccagtgccatcccagcaacaaccacaagacactgtcaccaccaccaaggctagtaccgtcatcgagatcatcgacctcgaggaaggacagattgccttccaagaatcatctggtgcccaagatgcagcagcagcagataacctccagcccaaggaccaagcacaagccctgactgcaaatggaccggagcctcctccgccatcccagcaacaaccacagcaagacgacatcatcgatctcgaagaaggccaggttgaggacatggacctctccgatgacgcccttgtcacaaagcacggtgtctcagctgaaacacccaagggcagtgatccccttgttcatgcttcaaaaacaggcagcgccttcatcgaccaaagccccacaagaggagtgaaaagagcccggacggaatcagctgagccttctgtccgtgtagtttacaacaacttgacaagagaaaacaaaaggaagctcatggaactaatgcaacaatggtccgagtggcaagctagaaagcagcacgccttgacggaaactgtggaagaagtcttggactgtggtgaagagacttattatccagcattacatgttggttcagagaaatcctgtgctgtgtcattctgggtggatagccaagcacgagaaaatgctgctgctgatgatggcgcggtgccgccgtacgatcgagaatttacattgggttcaactcctatgggtgattcatcaaatgctgaaggcaaaaaagacaaggacgattctcgctgtttcaactgtggttcgtatagtcatgccctgaaggattgcccaaagcctcgtgaccatgttgcaattagcaatgcccgcaagcagcacaacttgaaaaggaacctatctaatgctagtaatcgtggacaaaatcggtactaccagaagacgccaggcaaatttgacgatctgaaggcaggagtcctaggatctgagactagagaatgcttgggcctcagggaaaatgacccgccgccgtggctgcacaggatgcgtgaattgggttatcctccaggttacctagatgaggtggaagatgaagacaaaccatctggcatcaccatatttggcggggaaggggaggcgaatgcagagcagcagcagcagcagcacgaggagggagagcttccggagaaggacgaaccgtctccgcctcgcaagaggatgacggtggagttccctggaataaacgcgcccgtcccagagaacggcgacccttggctatggggcagcgctccgcctcctcctcttcagtcctcctcctcgggccgtcaccagcatccatcgtcggattctcagagggatagaggccctcctccccctccgggcgtcgagcaatactcgtcatcgaggtaccactcgtatgactatggaccggcgacccccggcaccggaagaagaagctcctctggttatgatgacggcggtgcctttacccctcactccgcgtattcaagcaggcagcactcggggtcgggctcgagggagagggaaagggaaagggaaagggaaagagagagggagagggagagggagaggcatgacaggcactactacagcagcaacaggaggtgaatgttacatatgtgtctgtagctgaagaaagacgtgaattttgtgatgatatcaaatttgctcagaatatcatataagtcagcacttgcaatatcagtcgctgttgaaacttgtgtaagtagatgttattttgaaacacttattt

SEQ ID NO: 13 - DNA, 1809 bp, Hordeum vulgare
ctctcctccgccacacaaactccgctccgctccaccgccggcaatggcttgagccgagcgccgcatcctctcccttcccctcctcgcgccgaccggggacaggcaatggcggcgcgtccgccgcccagcccggcctccaccccgcgccgccaccaccacctcagcccggccgccaggcccggccgccgcgaccgccagctcgcccgctgcttcccggagccgttccccaagcccccgaaccccccgaacccgctcctctccctcctcaccgccgtgcccgactgggcggacgccgtgtcggagcggcgcatccgggagccgcggccgctctacacgcacgagcagtggcgggagcaccgcagctcgctgcgccacctgcggcacctcctctcctcgctctcctaccgcgtcatcctctccctcgtgccgcccgtctccgccttcaccgccttcgccgccgccgtcgccacctacaacacgctcgtcccggactacgcgctcaccgcctcctccctgccctaccagctcacgacccccgccctcgcgctcctcctcgtcttccgcaccgaggcctcctacgcgcgcttcgacgagggccgcaaggcctggatgcgcgtcctcgccggcgccaccgagctcgccggcatggtcatgcattcctgcgccggcgccggcgagcgcggggacaacgacaccggcacgggcgcgctcgtcaactacatcctcgccttccccgtcgcgctcaagtgtcatatcaccagcaactccgacatcagaaaggaccttgagggcttgcttgcagaagacgacctgaatgttatcatgagctcaaaacaccggcctcgttgcatcatcgagttcatttcgcagagtctccagattttggattttgacgaacataagcggagcatcatggagtctaaactgtcttgttttcttgaaggaatttgtgtgtgcgagcagatcatcgggatccctgttcctctgtcttacactaggcttacctcaaggtttcttgtcctatggcatcttacacttccaatcatactatgggctgaatgtaaatggatagtcgttccagccacttttgtcagtgctgcctccttattctgcattgaggaagttggtgttctcatcgaggagccgttcccgatgctagcgctcgatgcacagtgcaagcagctccacgacagcatgcgtgacatgatgtcggtgcaaggcctggtccgaaagcaactcgtcgccaaggccaagggccgcggcagaggcagtaggctcccgcagaacggctggcccgtctccagccccaggagcgagcaggtgaaggtcgactgatggagctggctgatggcgaatcattcaagaacggcggcagttggaagcaaccgaagtgtctgcggtttgtgatgtgcagtcccacttccaggtattgatgctgctgctactgcaacgaacagcagcttgccaggtccactctccactgtgtgagagttaacacaagctggtccactgatttgttgtggctgagcagggtccctggattgagtagtgaagtagtagaataaagtggtgaggatgcagtgtagtgtagctccgacctcacttgagtaggtaagtaaagtgtaccactagcagcagcagcatctagagcatgtagtaggaatgaaactggatcatgtgccagccgatgtggcagcttttgttctccagtaatatctaccccagctttgtatatagtcctggtgagctatttatttgtctgtaagagtgcaattagagtactggtcatatgaatgcatggcagtttct

SEQ ID NO: 14 - DNA, 672 bp, Hordeum vulgare
cgaacactgcaagccaatcgagagtcacatcggctatcagcaagtaggagaaggaagaaccagctgcttgatcgaagaagaagatgcaggcggcgaaggagaaggtgaaggacggcgtgagcgcggtgaaggccaagaccaagatcacgcaggccaaggcgtcggagaaggcggaggcggccacggcgaggtcgcacgcggagcgggagctggcgcacgagcgcggcaaggccaaggtggccgcggcaaagatggagctgcaccaggataaggcgctccatcgggaggaggccatggagcaccgcatccacaagcacggtggcggccatggccaccaccaccacaagcacggcgtcggcatcgtggccgcgcccccgccggctactggggccggggggtactaccctcctcctgccgccggtggccactactactaatcagctaagcagctcgatcgctagctagatggatacatgcgctgcgtgtgtgatgtgattccgatagctaataagtctctactttgtactgtttgtctttgacttacacatgcgtgctttttaatttcgcacttggctggagatgaggtctgtatgtatgtatgttgtattcctatgtatggatgcatgcgaccttgttggttgcttttgattaatcaatcaatcaatacctata

SEQ ID NO: 15 - DNA, 810 bp, Gossypium hirsutum
aacgaagtgatggctagaatttacaacggaaaaatgcaaataccaaagagcagcatggcgttgagaggtgctgccatggctggtggtgcttgcattggaagacaaagagccaccccatttgtcctttcatcttctccattatttttcagggtacgatcccttcattcccattcacatcctctcctaagattcacatcttttcctaaccccaaaactggatttaagtatcagattcgggcaatacaagaggtaactgcagatactgtaaaatcccagaaaggaaaagaagatgatgaacagagttccccacaaaattggaagattaaaatgctttatgatggagattgtccgctttgcatgcgtgaggttgatatgctaagggagagaaataagcaatatggcactatcaagtttgttgacataagttctgatgattattctcctgaagaaaatcaaggattggactacaaaactgttatgggaagaattcatgccattctctctgatggaactgttgtcacagatgttgaggcatttagaaaattgtatgagcaagttggtcttggatgggtttatgccattaccaaatatgaaccaattgcgacaattgccgattccatctatggtgtttgggcgaaatatcgtcttcaaataactggccggccaccattagaagaggtcttggagacaagaagaaagaaaaaggctgacatatgcaatgacaacaattgcaagatatgaagtttcctattaattgcagatgacaggatacttttgtgaaaccttatccttatgatacgaccttacact

SEQ ID NO: 16 - DNA, 864 bp, Helianthus annuus
ggggatcctcatcgtatttgatcatcatttcttaatcactcttcacaacaattcctgtttaatttttcaaaaccaaattctcattaatccccacaattaattctttcaaatcctattcttgttgtcgtttaactcgctttcattcttcagttttaccattggttttgtttttcgatcgcatttttggtcgaaaaaaatgaaagaaaccgtgggaaatcctcttcatctcaagtcgttgaatcatatatcgcttgtgtgtcgatcggttgaagaatctatcgatttttatacaaatgttcttggatttttcccgatcagacggcctggatcgttcgatttcgacggtgcatggttgtttaattatgcaattggaattcatttgttgcaatcagaaaaccctgataatatgcagaagaaaagtgaaataaaccccaaggataatcatatttcatttcagtgtgagagtatgggagcggtggagaagaagctgaaggaaatggaaatagtttacaagagacagagggtagaagaaggtggaatctatgtggatcagttgttctttcatgatccagatgggtttatgattgagatatgcaactgtgataaccttccggtggtcccgatagccggagaaatggtccgatcatgctcgcggttaaacttagatatcatttctcagaaacagatacaaacagttgttcagttgtaagcaaatggatctctgtttttatgttattatatgatgttaatttgtgatgtttaagttgggctgagaggtttaatttctatttatatttggttctgtgatatatcatctatgtgctgttttagggtttcaaataaatcaaaacttgccatttttta

SEQ ID NO: 17 - DNA, 1193 bp, Helianthus annuus
ctaccaacctacacccatcatctctcatataccagaaactgttaactaatggctgagttaaacggaggaggccagtacaccgacttcccggccgtaccgacacacggaggccagttcgttcggtacaacatattcggtaacgagtttgagatcacatcaaaatatcatcctcctatcatgcctgttggtcgtggtgcttatgggattgtttgctcgatgctgaattcggagacgaatgagatggttgccatgaagaagatcatgaatgcttttgataattacatggatgctaagcgaacgcttcgcgagattaagcttatacgacatttggatcatgagaatgtaatagctataagagatgtagtccctccgcctgcacgtagagaattctcggacgtttacatagccaccgagctaatggacactgatcttcaccaaatcatcagatcaaaccaaaacttatcagaagaacattgtcagtacttcttatatcaacttttaagaggcttgaaatacattcactcagctaaagtcattcatagagaccttaagcctagtaacttgttgctaaatgcaaattgtgacttgaagatttgcgattttggacttgcgcgaccaaatgcagataacgactttatgactgaatatgttgtcacaagatggtatagggcacccgaactgttgcttaactcttcggactattcggctgctattgatgtctggtccgttggctgcatttatatggaacttatgaacagaaagcctttgtttcctggtaaagatcatgtgcatcaaatgagactattaactgagcttttaggtactccttctgaatctgatcttgggtttatcaagaacgaggatgcgataagatttatcggtcagcttccccgacaccctaggaaatcattacaagatacgtttccacatgttcatccgttagcgattgatctagttgagaaaatgttaacattcgatccagccaaacgtatcacagtcgaagaggcgttggcgcacccttatcttgaacgattgcacgacgttgaagatgaaccaatatgtccaaacccgttttcatttgatttcgagcaacaagttttaggagaagaacaaatcaaagacttgatctaccaggaggcattagcacacaatccagagtatgcttaaaaaaacacaaccataaatcttaactt

SEQ ID NO: 18 - DNA, 584 bp, Solanum lycopersicum
tccacctttactattactcaaatttctccaaaatctttgaatatgaagaagggaagtagttttattgcaatattgttagtcctttttcttagtgaattgcttgtcacggaggccgtgacatgcagtgttacagagctagttccatgtgccgcggcgatcatgtcatcacaaccaccctctaaggaatgttgcaataagttgaaagagcaaaagccttgtctttgtggatatcttaagaatccaagccttaagcaatatgtcaactctcctaatgccaaaaaagttgctaaaacttgtggagtatccactccaagttgttaggattctaacaaataaaaattcacaaatgatgatcattcatggatgaccagaaaacgcctttcgttttccacacttcctcaaagtgtctaaacactatcatctatatatgtatggcattatattgtaacttgtactcattttatgtattcgtaagccatgttagctttttagtgacacttttgtactgaaataaaatggttgtacttctatcgtaataattgtctatttccctacttgttgaatcttgtgttgatgccaactag

SEQ ID NO: 19 - DNA, 868 bp, Hordeum vulgare
cggcacgaggttcctcttcttctacctcctttcaccggcccgccgccggatccccaacccatcgcgccgccggattccaactccgccgccgtcgccgccgccgccgagccttgggccctgcgcgcatcccggttccccctcacggtggcccctgcatccatccatccatccatccatcccgacgacgaagccgccgccgacccctccccaccccaggtaacattctactgtaccgagcacattgaaagatggttaacgcaatcaaggggctgttcatctcctgtgatataccaatggctcagttcattgttaatatgaacgcctcaatgcccgcatcggacaagttcatcgtgcacatccttgaccccacgcacatgtttatccagcctaatatgggagattacatcaaaagcaagatggcggagttcagagaccagaacagctacgagaagccaacgtgaagggccaccatccattaccgcggtgctagcctcaacaaactccatccagggaacctatgttgatcatggctatgtagaatggttatatatatgctgagaccgaacattatgtttcacgcgtgatgttctggaatgactgttctgtagcatcgcagagttttgcgtcttatgtatcttgggagtgagcctttagctgataatatatttctggtgatgttgatcgtgataccgtgcgctgaataaagtaccacttcttatgtattactcttgtcaagatgttgggtaagctaataattactggagctctggatagagccaggtggaagctttgctaaaaaagatcgcttaccaaaattatcagccctgtaatgaaaaaccaagtaaatgaactaagaaagatttatttg

SEQ ID NO: 20 - DNA, 1580 bp, Hordeum vulgare
agcgagcgacctttccccatgccgctcccttcgtcctcctcctcctccgccgccgccgccgtcgcggccgggcccgcggcgtccccgctcgccgcccgaagccggggccgcctcctccgcgcgcgctccggccacgccgccgccgtgaggtgccagagggtcgatcctgtgaggctgagggcggtgaatggatcgcccccctgcgttcccctgtccgacaggtcgccgtggacccctgtgacgacgccgattttcggggacgcaagcatcaggaaggacgacacgaggctgcgcatcctctcaggaaccgccaacccctcgctcgcccaggaaatagcaagctacatgggtctagaacttgggaagatcaacataaaaaggtttgctgatggagaaatatatgttcagttacaagaaagtgtaaggggctgcgatgtgttccttgtgcaaccatcatgtcctccagcaaacgagaatctcatggagctactcatcatgattgatgcgtgtagaagagcatctgctaagaatattactgcagtcatcccttatttcggttatgccagggctgacaggaagtctcaaggtcgcgaatctatagctgcaaaacttgtagctaatatgattactgaagctggtgcaaaccgtgtccttgtttgtgatcttcattcaagtcaggccatgggatattttgacatcccagtagatcatgtttatggccagccggtgattcttgattacctcgccagcaagacaatttgttcaaatgacttggtggtggtgtcgcccgatgttggaggtgttgccagggcacgcgcttttgccaaaaaactatcagatgcacctctagcaattgtagataaaagaaggcatggacacaacgttgccgaggtaatgaatcttattggagatgttagaggaaaagtggctgttatgacggatgatatgattgatacggcaggaactattgccaaaggagctgagctgctgcatcaagaaggagcaagagaagtatatgcatgctgtacacatgctgtttttagcccaccagccatcgaaagattatcaagtggtttgtttcaagaagtgatcatcacgaacactatccctttgaaggaggagaagaacttcccgcagctgaccatcctttcagtcgcgaaccttctaggcgagacaatctggcgtgtccatgacgattgctctgttggccatgcgccatactccaccttggatatcgattgagaacgggtgccatagagggtcgacctgccgtggtgtcgacaacaacaaatacagttgatagatgagatgtctaggtgataatgagcagaatgtactctttcttaatgcaggaatagttgtacaagtgccccttttttttggatgttgtccactttgttttgtggaataagctatgttagcagaaaaaaacgttgactatgcgtccgagtgtgataagtacattagatggaagtttgaactgtgtatataggcccgcttaatcccagccgttccttttttttgaccattttagatgaaagttggcccaccttttaagtgtatgatggggctgttctcac

SEQ ID NO: 21 - DNA, 2500 bp, Hordeum vulgare
acgtggagcactctccgcgggagagcgagttccacctcggtcctggtgccgcagtggaggtgtactgtgacggcgcttggtcaccaggggtggtgcaaagggctgttggcgagggtgagtacgaggttagcatcaatgggaaggagggagagctgttactgaagaaggtgccagagttgctcaagcctcaatacaagtggaatggcaagcattggaggattgtaagccctaagagacaaggtaataggcggcagtctgtatctggaaaacgtccaagctcagctgttgaggtggcatccaatgatgatgaaaatggacatcatactcaatctccagccacaaaaaggtcaaggaaagaactgccacgaaaaaaaacatgaagaattaactgaaggttctgaacatgtgttggagtctgagatggacactagtttatctgcactacgcaagtcactagcaagcaatttttccccaaaatcctgttctccacgatctagaaaaaataactttcaagcgatttcacgaaggatagtggattcttgtacagtgccgatgaaggggcttggggttcatcatgcttcctcagaaaatccaacacctcagaacgaatcaagagcagatggtattgtggaagttgttgttcatgcttcctcagaaaatccaacacctcagaacgaatcaagagcagatggtattgtagaagttgttgttcaagaagccccgcttgacatgatgctttcaaatggtcagcttaattcacctgtatgtggaacagttggtgatgaagcccatgatatgcttttgactgcagtattaagaaaacagaaaatggatccgtcctgcataaataatgctgtccagaaaccacaggaaagcccgcttgatgtccagccactccaggtaaagaaatttagtgtcagacaaaaaggtggggaaacacaccctattcaagcacttgagggaaatagtgacacatttgataatattcagttgaaaggtaaaagcaatagctcttgtaaggaaattatttgtgctttgactgcttcgacgtgcaatgccccttcaccgctggataagcaggcaagagcaactgatgcggtgtcaagaggggctgatagtagctcaaacacaaaggtttttgcctctaagaaatcagctgaaaagaaaggcgtcaaaggtttgtctggcccacatagctcagtgcatggaactaggactgtccagaagagaagtgcaaagaaagtggcagggcgacagaaagaatgcttcatggaaagacaagtggacagcagaggacctcatactcagcagcagctcaacatggaggaaaaagttggcgtaaatgacggaacaaatcacgaactgtttcctttaatacccccaggcttcaaattaatatgtaacgggcaaggtttacttcatggggaaaaagtggatgagagaccaattcaactacatattcaggatgctgggagctcacagtgcaccatggagaacactgcattaaggagctgctcagctgttgggacttctctgcacccaccttttctttcatgtcagatctctggtgagcgttttccgttcatcaagacctcatccatatggcatcacattgaaccaatggaagtgtttcggaaggtaccacaggaaccccatttccttccacttcagcaatttatgccagaactgcgtgaaggaatggctataggtctaatggtgacatatgacagcttagttgaaagtgtgaagagatcatgcatagaagatagtattgagttatttgaaagaaagatcaatgcacttgctcatttagaggaacatggatttgatgttaagttgctgcagcacagtctaatgaaattactcgaggccaaatgggagcacaccaagcatcttggacatctggacgagttgaaagaattagtaccgcggaaggagtctgccatgtcccaaaagcatgcattacttgttgaaaaagaaggagctatatttcagcttgagcagaaacttgagtaccttcgcggtgaagcagagcagattgcaagggagacaaaagatgaagatgcagagctcttgaggttgaaagtgggagttaacatggctcaggaagcatgtgttaatgttgaagtgcggtttcacgacattctagccgatatgagttcgagactgcagctttccgagtgatacaatattcagaaatcatttcaatctcccaactttatttgttcctgtagcttatgctcccatgtgttgcacctttatgttatctaggatcatcaccgaacttggattaaggttccaattgtcattcgacaccttttgtgcatgtagcagatgtatgaatcttcaattctgtcaagtttagacccatgtttctatgctagttggatggtatttatcgttgtgtaaactggttgtcttgtgttgtcagtttgtcactcaattcccctaatcatgtgatgactgttatgcagtggttaatctcaaaacttgctgtcgg

SEQ ID NO: 22 - DNA, 3189 bp, Hordeum vulgare
ctcgtctccggcgaagtcgtcgtcggcggcggcgccgccatgaatgtgttcgcgggggtcggcggcagcgcgggggagcgcggcggggcgggcgcggggtccggggcggcggcgagggacgcggggtcggcggacttcggggcgctgctggagctgacgccgcacaagatggcggtgtgccacctcgtgcaggtcttcgcgccgccggcgcagcagcaggccccgccgttccccttcgagtcggccgcccaccacaaccgcctcgggctcttcctcttcgccctcacccgctcatgtgaggatttcctggaaccgccgctggaagagcttttgaggcagttgaaggcggtagatgacttagttaatggttggctttgtgagcagctgacaaccacactggctgggcttaactcaccagacgatttgttcaacttttttgataagctaagaggtgtgctcacttcaccggagggtggaaatgtgggtgatgaatttctggatccaaatagtcagcttggagtttttcttcgttgctgtatactggccttcaattcaatgacttttgagggtgtctgccatctgttggcaaatcttgtggcgtactgtaactctgctgacgcttcatatgatttggcagaagacgaggactttaatagtgaaatagaaatgagcgacccgatggatgcagatataggtgttagatctggggtatttgacagatatactcaaggctatgccactgggagccatatgggggagagctcttcgtctctaatccaagcaccaacctcactccataattttgatgaagccgatattttcaaagcagaggatagtccaacttgtctgagatcaaggtggcaattagaggcatatctgaaccagcaagctgacgttcttgaaaaggatcccagctcggtgcctttgaattcatttaacaacactatgacacagcttcagacattagctccggagcttcatcgtgtccaattcttgcaatacttgaatgctctttgccatgatgactatgttgcttcgttggaccatcttcaccgctattttgattacagtgctgggatgcaaggccttttcagtcgttctttatctcctcaccaagataatattgtcggaaagtatgagagcgctctgctctgcttaggcaacctgcattgttattttggacatccaaagaaagccctagaggcattcacagaagcagtgcgtgtttctcaaatgaacaatgatgactcgtgccttgcatatatattaggagccatttccaatctattatcaaagataggtatatcaagcacagttggattaattggttctcgatattcacttggaaacaatattggactgggcacaccattgtccattcagcagcagttgcttgttcttttgaagcgctcccttaagagagctgatatgctgagacttacaagcttactatcctttgatcacatctctcttgcaaaatttgatttgaagcatgtccaaaggccgttggtgtcctttggccctaatggttctacaaagcttagaacctgtcctgcagatgtctgcaagaatttaagattaagttcccatgtgctgtccgacttcggcacagatagcttatcaatttcgaatgataatggtagtttcagtacctcatggcttaggaatctgtctgatgcttccagatcttggtctaatagctcagcaaagactagaaaacttattgcaaatgactttgacaatttccactttcatgcacaaccaagtccaatacctacatcagtattgcaattagccggctcagcacatttgatgagggccactgcctgggagcactatggaagtgctcagatggttcgaatgaatacgctggtctatgcaacctgctttgctgatgctgcaagttcatcggagctgtcactggcatatgtcaagctaattgaacagttagcagtcttcaaaggatattcagcggcattctgtgcgctcaagcttgccgaagagaagttcccatcctcgatgaattcacagatccaccttctcaaaatgcaattgctacatgagcgtgccttgcatcgaggacacctgagaattgcgcaacaaatctgtgatgaatttggggtgctctcatcttctgtcagtggagtagacattgagctaaagactgaagctagtctacggcgagcccgcacgttactcgctgcaaaagagtttagccaggcagcagctgtggcgaattcccttttcactacatgccacaagtacaacatgcaagtagagaatgcaagtgtccttttgttacttgccgaaatacatagaaagtccgacaacgcggtccttggtctcccttacgcattagccagccaatcgttttgcaaatcgtttaatttggatctgcttgaagcttcggccacacttactctcgctgaactgtggctagctcttggatcaaaccacgcgaagagggccctaagtcttgtttatcaaagccttcctatgattctcggccatggcggtcttgagctgcgtgctcggtctcagttagtcttagcaaaatgccatttaactgatccagaattttcagtttctgaagatccctgtgctgttctggaccctctaaatcaagcagctgaagatctgcatgttttggagtaccacgagatggcgacagaggtgtactatctgaaggccatggcgtataaccacctgggcaagttagacgagagggaggaagccgcggctcgtttcaaggagcacgttaccacccttgagaacccgcgcgacgaggaggattcacttgcttactgacattgcacagttaatcaaccgctctggtaggacggggccatgtattgcagcgaggtagcagcaggagcacaaacagaagtgcctgctttgtccacctgatctcaagactccttccatgacttcctctgcaaagtcgcctcatcggttgggcgtgcgaggaccttggcatgcacactggctgaatttcagcactgttcgagggagctttgtacgaggaagaacaactgggtggtctcaccagctactcatggcctgatgcattctattgctgaatgaatgtatatcagtccatctcaactttcggcacagttcgagagagctttgtatgagttgtaaaatcaattgaattttgttcctgcgccgtctcagctttctatcccc

SEQ ID NO: 23 - DNA, 2083 bp, Hordeum vulgare
tggacactgacaatggactgaaggagtagaaaaagtgagagtgagagcagcataatggggcggtggtgttcgccggcgtcggcggggccgcggtcggtgcagctgctcccgttgggcgtcgccctcgtcgccgcctccttctacgccggcaccctcttccagtcctccgcctcccccgcgctcatattgcccccttccgcctcccggtcgtccggttcctccgaaccccaaggtgcgtcagagttaacaaacaaagttgctcttacttaccgaacagcattaatctcagttccagctcatggacttgatgtgtgtcctttggaacacagcgagtatgttccctgtcacgatgctgcctatgtgagcaagttaagggagctggatagatctagacacgagaatcttgaagctaaatgccctccacgagaggagagcttgttctgtttggtgcctccaccaaacgactacaagatacctataagatggccaacaagtcgggactatgtatggcgtagtaatgtgaaccattcacacctttctgaggtaaaaggaggacagaattgggtgcatgagaatggtaagctttggtggttccctggaggtggcactcacttcaagcatggtgcaacagaatacatagagaggctaggaaatatgacaaccaatagtactggtgatctccgttcagcaggagttgttcaagttttggatgttggatgcggtgttgccagcttctctgcttatcttcttcccctagatattcatactatgtcattcgcgccaaaagatggtcatgagaatcaaatccagtttgctttagagcgtgggattggtgcgatgatctctgtgttggccacaaagcaattaccatatcctggaaattcatttgaaatggttcattgctcccgatgtcgtgttgactggcatgaaaatgatggaatattggtcaaagaggttgatcgtcttttgcgacctaatggatattttgtatattccgctccaccagcttatagaaaagataaagatttccctattatctgggagaagctaattaatatcacaacatcaatgtgttggaagcttattgctaagcatgttcagactgctatatggatcaaacctgaagatgaatcttgccgacagaaaaatgctgatatggggatcctgaatatctgtgaccccagtgacacttcttcatggcaagctccgttaatgaactgtgttcgcttgaacacggaccaactgaagattcagaaactgccttccagacctgaacgcctcttattttattcgaggagtttggaactaataggagttactccagagaagtttgagaataataaccagttctggcgggaccaggttcgcaagtactggtcatttcttggtgttgaaaagactagcatacggaatatcatggacatgaatgctaattatggtggatttgctatggcactaagcactgatcctgtctggattatgaatatagtacccaatacaacgatcaacacactacctgttatctatgaccgggggttaattggttcttaccatgactggtgtcagccattctcaacatatcctaggtcatatgatttgctacatgctttccacctcttttcacactatcaaggtcatgcaggaggttgcttattggaagatatcatgctagaaatagatcgcatcattcgtccacagggatttatcattatcagagatgagaataccactctctcaagaatcagtgatctcgcaccaaagttcctatgggatgtcacgactcgcacgttggaaaacgaagagaacaggccggagcaggtcttgatttgtaggaagaaattctgggccattgtttaagtagtacttgtgcctgaagattttatcttacgtcctatcccaccatccggtatcttgctgacacaacataaggaagattttcgggtgtacaaaaaagtttcaagatgttcctgcagtgtgcacaagacatttggtcgcggattctttccagctgaggacaccgcattacagaaaaaaagcagaggacatgactgggatttccttatcttcagcctgcttttccagt

SEQ ID NO: 24 - DNA, 2419 bp, Hordeum vulgare
accgccctcctccgatccaaaatcatcaagcggcgcgggcgcggggggcaggatggcggcggcgccgcccgacgggcaggagaaggtgatcgcggcggcgccgcagatcgtcaagtcgctcgccaactccaagaacgccgcggacgacatgatccgcatcctctccggcttcgacaaccgcttctccctcatgtccgacctcttcccggccgccggcacccccgacgccgcggccggctccgagctccccgagggggacgaggaggaggtggagtacgggcgggagcggggccccggctacggcggcgacgacgacgacctggaggacgagagggacgcggcggtggaggacgcgctgcggctcatcgagcagtgggactcccccgcgaccggggaccgactggtgctcgagtcgcccgaggacgccgaggagtacctcgccgcggccgcctgcctcatgggcgaggccggcccgcgcgtcgaggccgcgctgcaggtcgccatggcgcgcctcgaggaggagttccgccagctgctcatccgcgggaccgcgtcgctcgccgccgacgacctgcacgcgtccctcctccgccgcctctcgctcacggtgcccaccttccactccgcctcctccgtcgacctggagtgcccctccttcgccagccagcccgacgagggggacgaggccgcttccgccgcgggcaggtggagctccgtctccgacggcgagatctcgccctacctcatttcccccgacaccgtcagcaccctcaaggacatcgcggacgtcatgctgcgcgccggctatgggccggagctctgtcaggtttacagcgaggtgcgccgggacacgctcatggagtgcctcgccgtgcttggggtcgacaagatgagcctggaggaggtgcagcgtgtggagtggggcgtcctagatggcaagatgaagaagtggatccaggctctcagggtcgtcgtccagggccttctcgccgaggagcgccgcatttgtggccagatcctcgcggccgacgcagatactgaggaggagtgcttcactgaggcagccaaggggtgtgtcttgcagctgctcaacttcggtgatgccattgccattgggaagagatcgtccgagaagctgttccgcattcttggaatgtatgaggcactagctgagttactgccagagctcgaggccttgttctcaggtgacgcaagggattccatcaaggaagagggagaggggatactcgtgaggctaggtgatgcggtgcgtggcacggttgctgagtttgccaatgcgatacggggggagacttcccgcagatcacttccaggcggcgagatccacccgcttacgcgttatgtcatgaattatgtgcgactgcttgcagattacagccgctggctgaatcatcttcttgatggttgcgagactgagctggaaaatgggggtgacaatgcggatatgactccactcggacactgtctgctgatactgatcacacatctattggacaagattgaggataaagcgaagctgtatgatgatgaggcactgcagaacatatttctgatgaacaatctgtggtatgttgtccagaagatcaaagattcagagcttaagactttgcttggggataactggatccgtaagcgccgcggtcagataaggaggtactctacagggtacctccgatcctcgtggaccagggtattagcttgcctgagggatgatgggttgccacatgcaacaggttcatcgagtgcactcaaggctgcactgaaggaaaggttcaagagcttcaacttggcttacgaggagttatacaggacacagacagcatggagggttgtggatcctcagttaagagaggagttgaagatttccatctcagagaaggtccttccagcataccgttcgtttgttggaaggttccgagggcagctggaggggggaaggaattttgcaaagtatataaaatacaaccctgaagatgtggagaaccaggtctcagatttctttgaagggaaaaaattgaatgcttgatcaatctgtctatctttgaaggaatgttcatatcaatggttgtggttataaatccctggcaaaattcattcgggcaatgtgcttgaaacttgccctaccatcatgcttgtgaggttcgaagatggagaaatcaattttgactggtggatcagaaatattgtgaatgcaaggcaccctgggtcgaatactctgcgtttcatgtttgactctttttaaggggagtattgacattagccacatgggattcagggcactgcggtgagctgtgtaactgttactattacagtttacccttcttttgttgattattgactattgttggatggtcggtggttgacatcttatgtacaatttatacagcagttatgatgt

SEQ ID NO: 25 - DNA, 2149 bp, Hordeum vulgare
ctcgccaaggccgtagccaccgtcactcttcgccgccgtgatccgcctgggtcccgccgtgccggggctgctggagagagcgagcgggagggtcgccggcctcgccgcctccgtcccgtatttccctctgatcctgccctctccgtggtttgggtctcaggggaccaaacctttccgccgcggcttgctggcgagtgaagtgcttttcttagtttccaatcggcgtatttttgcacacataattggttttccttcattggagtttaccaatgtcggccggagccactataaactggatcagaaccccatttcacacccagagatttcatgacttctcaagtctaagttttagatgccgaaacacttttgggtcaattcagccttgctggttggcaactgatcaggattcatccctctctaaagtccgtgtggctgcagactactcagattcattgccagattccaagtacatgagagatcggggataccatcctcttgaagaaattaaagaacgcccaaagaagaaggacatttcactgacagatgtagaaacagctagaacagtagtagaggcaaatagcaagggattgctcatatttcctgccagggtgcataatgaacctcatggacatgtttcatggtcagagtttcagtatgttgttgatgactatggagacattttctttcaagtacctgatgatgggaacatcttggaagatgatgatgcaaacaaccctgtgacagttttgatcggaacagatggtgcaattattggagaaactagtgtggtaactagtgatttcaacgaccacgtggtcattgaggattctatggacatgcatgatgatgacagcaaggttgacacagaaataacgaatattctcatagagtggggaatgccagtaacaatgcgttcaatacatcctatatactttgccaagtgtttgacaaaggctgttcatgataatcacggggagaagattgataatccatcaaacggggtctctattgtaggacacctgagacctgcttttatagaagaagaatcttatttgaggagtttatttcattctgaatgcaatgccgatggttattcatctgagtggagagaggaatacaacagagaaccccggccagcttctggaaccaatggcctaattgatggtgataaattgagattggacatcaatgatgcgggaagtagcattgattcaaccatctataagctggaaatgatgacaattgagctgttttccgtctatgggaagcagtttatgattgatccacaagactttcaagatgcagaaccagatcttctttcaaatcatgcttcggacattataaaacgcatggaagaaaacagtgatcagtgtaccatggctctacggtccctctgtagcagaaaaaaaggcctcacggtagaggaggcacgcttgataggcgttgatagtcttggtatcgacgtgagagccttttctggcttggaagctcggaccgttcgattttcattcaatgcccaggcgttatctgaacgttcagccgaaaagaagatcaagcgaatgctttttcctcgttatcgcaagaccgtgaaagcttccgctgaagatgaatgttagccaacttatttaattttagcttcgaacgcctaacagtaagctggtgaggacaaagggtgtgcagggaactcaaccaaagatgtgcacccagtcagctcccagtttgttaggagaagctaacacccgtcgacatgaaatgacctcaagtgctagagtgctcggtggaggtttcggcttggtcggctatagaaggccaaccacccatggcttctgacaaataaggtggtggccatgtatagaggagcatccttggacgggacgtgaggcgattcggtgtcggtgcaatctgcagctgatcaatcatagcccataagtttccccctaaacaaaataaggtgcaggagacgcaggatacaaagcgacagctctttggcctgaataaacaacgtcttcttagtttactacaaacatgtaactaactccatctgatccgtttccttcccatcctgaataaattgcaattatgttatttcgcaaacaaaaaatgcaattatatttagtgccaacatgtcgctgtcgaaaccttgatggtg

SEQ ID NO: 26 - DNA, 4513 bp, Hordeum vulgare
gcggccccgtctctcatccgacgcccgcggtgattgttgcccatccatgggttcgctcacgaaggcggcggtggagggggcgttcgcggcggcggactggtccgacgaggcggtcatctacgtcaacggcgtccgccgcgtgcttcccgacggcctcgcccacctcaccctcctccagtacctcagagactccgtttcattgttgtggctggcgcgaaggcctttttgtaatcgtagaatcagtggcgtgaggtcgttgtcactataccaaattgaaaacttgccggacatcggtcttcgaggaacaaagcttggatgtggtgaaggcggttgtggtgcctgcactgtcatggtctcatgctatgatcaaactacaaagaaatcagagcattatgcaataaacgcctgcctggctccactttattccttggaaggaatgcacataatcacagtagagggaattggagatcgccagcgaggtttgcacccagtccaggaacgtttagccgaggcacatggttcacaatgtggattttgcacccctggtttcgtgatgtccatgtatgcactgctgagatcgagtaaacatcctcctaccgaagagcggattgaagatagccttgcaggaaatttgtgtcgctgtactggctacagaccaataatagatgccttccgtgtgtttgcaaaaacggatgattccttgtacacagcttcaccttcagaaaatgctaatggccaagctatctgcccttcaactgggaagccatgttcatgcagaaatgagacagatgtcaatgctaatgaatcttcaacatcctcttccgtgaaaatctacttaccttgttcatacaacgaaatcgatggaaattcatacagcgagaaggagcccatttttcccccagaactgcagttaagaaaaattatgccacttaaattgaatgggtttaatgggatcagatggtatagacctcttaaattagagcagctattgcatttgagatcttgctacccagatgcgaaacttatcattggtaactccgaagtgggagttgaaacaaagttcaagaatgctcaatataaggtcatgatctcagttacccatgttccagaacttcataccctcaaagtggaagaacatggcttacacatcggttctgcagttagacttgcacagctccagaagttcctcaaaaatgttattgcggagcgtagttctcatgaaacttcgtcctgccacgcaatactacggcagttaaaatggtttgcaggaacacaaatcaggaacgttgcttctgttggtggtaatatttgtactgctagtccaatatcagatctaaacccactttggatggccactggtgcaaatttccagataattgatgtcaacaataatgttaggactattgccgcaaaagagttctttcttggctatcgcaaagttgatttaaaggctgatgaaatattgctctctgttatactaccatggacaagaccatatgagtatataaaagaatttaaacaggcacatagaagggaggatgacattgctttggtgaatgctggaatgcgtatgcatataacagaagctgaaggaaactggatagtatctgatgtctctattgtctacggaggggtagctgctgttccacttactgctgcaaaaactgaaaaattccttgttggaaagaagttggatgatggattgctggatgagacctttaatttcttaaaagaggacatcccactagcagagaatgcaccaggtggaatggttgaatttcgcagttcgctcacgttgagtttcttcttcaaatttttccttcatgttatgcatgagatgaacattaaagggttatggaaggttgggctggatgcagctaatatgtcagctatacagtcttacactagacctgtttctattggaacacaaggttatgaatcagtggggcaaggaactgacgtgggacaatcaatggttcatatgtcagctatgcttcaggtcactggtgaggcagaatatgttgatgacacaccaacacccccgaataacttgcatgctgctctggtgctgagtaagaaggctcatgctcgcattttgtctatcgacgattcagttgccaaatgttcccctgggtttgctggtctgttcctttcaaaagatgtgcctggttctaaccatattgggccaattatccatgatgaggaggtttttgcatctgatattgttacttgtgttggccagattattggaattgttgtggcagatacccatgataacgcaaaagctgctgcaaataaagtaaatattgaatattctgagctgccagcaatcctctcaatagcggaagctgtcaaagccggtagctttcatcccaataccacgagatgcatttcgaatggggatgttgaacaatgtttttcatccaatacatgcgataaaattatagaaggagaaattcgagtcgggggtcaagagcacttctacatggaacctcaatgcacttttgtctggccagttgattctggaaatgaaattcatatgatctcatctactcaagctccccagaagcatcaggagtatgtcgcaaatgctcttggtcttccactatcaaaagttgtttgcaagactaagcgtattggtggcggatttggtggaaaagaaactagatcagcaatatttgctgctgcggcatctgtagcttcctattgtctaagaaggccagtaaagattgttttggacagggacgttgacatgatgacgactggacagaggcacagtttcctagggaaatataaggttggatttaccaatgacgggaagatactggccttagatctcgaaatttacaacaacggtggtaactcactagatctgtcccttgcagtcttggagcgtgctgttttccattcggaaaatgtgtacgctataccaaatatcagagtcagtgggaaagtatgctttacaaatctcccaagcaatactgcttttagaggttttggtggtccacagggtatgttgattgcagagaattggattcatcacatggctacagaactcaagcggagtccagaggagataaaagaacttaatttccaaagtgagggaactgaggtttattatggccagttgctccgtaattgtacaatgcattcggtttgggatgaactgaaggcatcttgtaatcttttggaggctcgcaaagctgtaaatgttttcaacaatgaaaatcgttggaggaagcgaggcattgctatggttcccacaaaatttggcatatccttcactgcaaaatttatgaatcaggctggtgctcttgtccaagtttacactgatggtactgtcctggtaacacatggcggggttgagatgggacagggtttacacacaaaggtagcccaagttgctgcctcatcactagatatccctctaagctgtgtatttatctcagagacaagtaccgataaggttccgaatgcttcaccgacagcagcctctgccagttcagatttgtatggtgctgcagttttggatgcttgtcagcaaataaaggctcggatggaacccattgctagtagggggaatcatatgtccttcgcagagttagctcaagcatgctacatggaacgagtagatctttctgctcatgggttttatatcacccccgatatcgggtttgactggattgctggcaaggggagtccatttaattatttcacgtatggagccgcatttgcagaagttgagattgacaccctaactggggatttccacacaaggacagctgatattgtcatggatctcggctattcgattaatccagcaattgatattggccagattgaaggagctttcattcaaggtctgggttgggctgccatggaagagctaaaatggggggatgacaaccacaagtggattcgacctggacaccttttcacttgtggtcctggctcttacaaaataccctctataaatgatatacctctcaatttcaaggtttcactattgaagggtgttccaaatccaagggccatacactcatccaaggctgtcggagagccaccgttcttcctcgcttccgccgtcttgtttgcgataaaagacgcgatcgcggcggctagggcggaggagggccatctcgactggttccccctcgacaacccggcaacgcctgaaaggataaggatggcgtgtgttgactccattacgaagaaatttgcgagtgtgtattaccgtcccaagcttagcgtatagtggttgctgccagagtagccgatacatgcaacgtaaatgtgtatacctgttatgtggtgcactatactgtacagtccggacacgctgtgtgcatgataaaagtacagatgaagtgttgatataggattacgaataccactgtacttcaaataacctggaatacgagcaaaaacaattagttcaaaatttgggttcatttctgcgagggggaatttgaaaggtcactgtatttaaaatgtgattttcaaataacaactg

SEQ ID NO: 27 - DNA, 1766 bp, Hordeum vulgare
gaaaacagctgaggaggttgctgccttagttcgatcgcttcctgtagaagagcagccaaagcaaattattgtgacaaggaagggtatgttggatccgttggaagtccatctgcttgacttccctaacattgttattaagggtagtgagttgcagctgccattccaagcttgcttgaagattgagaagttcggtgatcttattctcaaggctacagaacctcagatggttctatataacatatacgatgattggttgaaaagtatctcatcctacactgcattctctcgtcttgtgcttatacttagagcactacatgtcaataatgagaaggctaagatgctgctgaagcctgacaagacaattgttacggagccacatcatatctggccaagtttgactgatgagcagtggctcaaggtcgaatgtgcgctcagggatctcatcctttctgattatgcaaagaaaaacaacgttaatacttctgcacttacacaatctgagattcgtgatataatacttggtgctgaaatagccccaccatcacagcagaggcaacaaatagctgagattgagaaacagtccaaagagacaactcagttaaatgcagttacaacaaggacaactaatgtgcatggtgatgaactcattatcacgacaaccagtccatacgagcaagcagcatttgcgtcgaaaacagattggcgtgtcagggccatctctgctacaaacttatatctccgtgtcaaccacatttatgttaactcagatgatataaaggagactggctatacttacatcatgcccaagaatatattgaagaagttcatatgcatagcagatctacggacacaggttgcaggtttcctgtatggactgagtccacaggataatccccaagtcaaggagatcaggtgcatatccattcccccacagcatggaactcaccagatggtgactctgccagcgaatctaccagagcatgagttcctcgcggacttggagccattgggatggatgcatacccagccgaatgaagctcctcagctatcacctcaggacttgacatcacattccaagattttggagaacaacaagcagtgggatggtgagaagtgcatcatattgacatgcagcttcaccccaggatcgtgctcacttaccgcatacaaattgacaccaagcggttacgagtggggccgtagcaacaaggacaatggcagcaacccacatggctatctaccaactcactacgagaaggtccagatgcttctcagtgaccgcttccttgggttctacatggtcccggacaacgctccctggaattacaacttcatgggagtcaagcacgacccattgatgaagtacagcatgaagctagggacgccccgagacttctaccacgaggaccacaggccgacacacttcctggagttcagcaacattgaggagggtgaggtcgctgagggggacagagaggacaccttctcgtaggcaccgtagcatgccctgccccaaattttgttagcacatcgaaactagctatgaactctcagcagttttgaaatagagacatttgtaacctgcaaactttgacttgatacgtggtatgatgtttgtctgccccttgagatgttatgacttcttttgtaagcccgctcttcaagctgggtaatgtacagtgtcatgcatcataacagtgaatattttgcttagtggcttatgtagtctcttatgtactccctctgttcctaaatataagatgttt

SEQ ID NO: 28 - DNA, 1172 bp, Hordeum vulgare
taaaagcagcgacttcatccctccaccctcgccgtaacagcacagacaagccctagggttttagcactgctcgagcgagcggccggcgacgcagaggcgcagacacactttccggccatgtcggcggcggcagtagctgcggacacgtactccccagccgcggaggctgggagcaagcggcgggagaggcgggaggagctgcggcgccacctcgccgaggacgccgattggccccgcgccgacggccgctccttgcacgactgccgccccgcatttatgcaaacagggccaactactgctgcgtcagggtctgcttatgcagaatttgggaagacaaaggtcattgtgtcagtgtttggcccaagggagagcaagaaagcgatgctgtacagtgacactggtaggctcaattgcagtgtgagctatacaacatttgccactggtatacgtggacaggggttggaaaacaaagagtactctggaatgcttcacaaagccctggaaggcgcagtaatgctacatacttttccgaagactactgttgatgtttttgcgttggttcttgagtctggtggcagcgatcttcccattataatatcttgcgctagtcttgcactggcagatgctgggatcatgatgtatgaccttgttacatcagtatctgtgtcctgtttagggaagaatgttatcatcgatccaacctcagacgaggaggcatggcaagacggaggccttatggtgtcttatatgccggcccgcaaggagatcacacaacttacgctgactggggagtggactgatggcaaaatcaccaatgcagtagagctctgtatggatgcttgcagcaagctttgcgagatattgcgggagcgcttgaaagaccccgcgagcctggcgagcgaatgacatttgagcagacacatgtttgcagaatcgcaacagatatccttagctgtagaagttttgtagggaagggaggacaggactgctgtttgcaggagcacaatttgcatggctgtggtgattgtttcttttggcaaaagagtttagccgagagaaaatcttgtaggtgtgcaagccatgtcttgtactgtgagttcggaacctgggatttttcggaactttgtactatcattctatggattgtttatgatgtcaaagctattgccctg

SEQ ID NO: 29 - DNA, 969 bp, Hordeum vulgare
gacgcagctgccagcgaggtagggagaacaatggcggccgccgcaggcgacggcggcagcgtcccgccgaagagcccaacagcggaggcgcctcccgcctctcagccgcgcctgacccccaataccatgccgtgggaaaggtgcgtcgccggcgtccagtcggctctcaaagatccgttggcgcggttcctgagggagcagatcgagaaagccgggtgcaccgtatggccgacgctgatccgggcggccatctgcacggctagcgggggctacacaagcggcaaggggatagaagtttgctgtaatcacatgcgaaagcaagatgaaataactcaggtcataattcatgagttagtacatgcttatgatgactgtgttgtcaagaacatcaactggaacaactgcgctcaccacgcttgctctgagattcgagctaatcaccttagtggcaattgccattacaaacgtgaactgatgaaaggcttcctgaagataaaggggcatgagccagaatgtgtcaaaagacgagcgctgctttctgtccagaacaacccttcctgtcgagggaaagcggcaaaagaagcagttgagaacgtgtgggatacgtgctacaatgacccacgcccgtttgataaggctccatgaagtgcaagttgttgggacagttttgttaactttcagacgggttttatcaagtgtaatcctgtgggatagtttagttttccttcagatgggctccatgaagtacttcagcaaagcattgcaacaaaatctggaaatttggtgctggggcaaaactttgaatgccatgatagatgtacgagtccaaacaatctagcagattatcccatgtaaatcaattgttttacatggcacatcgtgagagagttcactaagctccaaataagactgggtgtatctgattaattccttacaccagttaaatattgcttaagatattcccttttt

SEQ ID NO: 30 - DNA, 1445 bp, Hordeum vulgare
gcattaatagagctcagcgaccgccatccgcttctcgcctcccccctccagctccaatccaatctcaccttctttcttcttcctacccatttccagccgtcgccgccgccgccgaggtcgatggagagatggaggcgggtcagcgtgctggccatggcgctcctgctgctctccgcttgtcatggagcagagttctctgtcaagaatcacgatcagagtcttatttatgaccatactcttgctaagaccattgtggaatatgcttcagctgtgtatatgacagatctaacagctttgtatacatggacatgttcaagatgcaatgacttgactcaagacttcgagatgaggtctctaattgttgatgtggagaactgtttgcaggcatttgtcggtgtagctcacaatctaaattccataatagttgcaatcagagggactcaagagaacagtgtgcagaattggatcaaggacttgatatggaagcagctcgatctaagctatccaaacatgccaaacgcaaagggatttttctcctcctataataatacaattttacgtctagctatcacaagtgctgttcacaaggcaagaaagacatatggggatatcggcgtcatagtcacagggcactcaatgggaggagccatggctgccttctgtgcacttgatcttgctatcaagcttggaagcgacaatgttcaactcatgactttcggacagcctcgtgttggcaatgctgttttcgcctcctactttgccaaatatgtaccaaacactattcgactggtacatggacatgatattgtgccacatttgccaccttatttctcctttctttccaaactgacgtaccaccacttcccaagagaggtatggatcgatgattctgacggcaacacaaccgaacagatttgtgatgccagcggcgaagatccaaactgctgcaggtgcctctccatattgagcctgagtattcaggaccacttcacatacctgggagtagatatggaatcagatgactggagcacctgcagaatcatcacagcccaaagcgtcgagcgattacggaaggatcttgccagcaacatcatcatgacaaagcatgatgccgacgtctccattgtcgagaatagtgtgcagacagactggagcagttccagatagcatactgcattactgttaacactatatttgtaacagaagacgacgccttttctttctcttgaagatggggggtttcagttggggaatttcattcagattgggttgtacattgttctttcatagcctgtgaatatgtagaaatgtagacacgaattataggttctagaccgtaaactcttgccggatgcacgaaagatactctgtgttcacatcttgtaaaatacagtacccatgcagatatctatgcagatgtctccagtccgggaaataaagcagaa

SEQ ID NO: 31 - DNA, 1048 bp, Hordeum vulgare
cctcgagagccatcatcccacggacccgccgccgccgccgccgccgtcgagcactcgagcggagcagaggaagcggtgccagggcttcggatcgagggaggatggggaagtcgaagagcaagggcgccaagttcgccgccgtcaagaagatcatcagcaagaagaccatcaagaagcacaaggagaagctgctggaggaggtgctggacccccggaagaaggccgccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttagatttggagaaaggaatgatggattgcctttatgcaaaatgtaccccttgcatcactgattgtgttatggctgagcttgaaaagctaggacaaaaataccgtgttgcgttgagaattgcgaaggaccctaggttccagagattagcgtgcacacacaagggaacttatgctgatgactgtattgttgagagaattactcagcacaaatgctacattgttgccacttgcgatagagatttaaagaggagaataagaaaggttcctggtgttccaatcatgtatatcacccaacacaggtactcgatagaacgactccctgaagctacaatcggtggagcaccaagaatctgattagctgaaatacaccgtcacagttgcccaagttccttgatttaggatggacatgagtactgccgtgctgaatcgagctgattgtaaccacttcaaaattgtgtaccaacctctttagggcatcattttcataaattttgtaaggaactttagaagaatgtctatctttgtcctttgttttgagctgaactgtagccaacttcccagattgcttggtgttgttaatgttgcagactcaagaatatattttatgtaatatgcaagtgccgtcatatggttcagtgctttgacatgcttctggttcactgcactcgattgccaagccaacatatgtt

SEQ ID NO: 32 - DNA, 1256 bp, Hordeum vulgare
tcgttgccaactgatccaaggtttcaagcttttcaagatatcgccgcattgacggatagagatagagcacatccatgtccaggttgatggccgccatgcttctcggaggcgcgcgggtcgccagcgccacggcgctcaccggcaacactgctgtgaaggccattcccaggccctgcttccttgctccccggccgcatgccgcgagctggagccccatctgcatgcagaccgccccgaggtcgtcgcaggcgtataacaacgctccggacgaccggagggacatcaaggacaagtacaggggcgcggcggagcaggccaaggacgccaccggcgatgccaaggagagcgcaaagggccaggcgtcgcgcatggccgacgagaccaaggacaaggcgggggacgccgcccagagggcctcccaaatgacggacaaggcgaagcacgagaccaaggagacggcaagccaggccgcggacaaggcgggcgagatgaaagaccgggccaaggagacggcggaggaagccgccgagaaggcctcccgcatgacggagaaggccaagcacgagacgaaggagacggcaagccaggccgcggacaaggcgggcgagatgaaggagagggccaaggagacgacggggcaggcgatggacaaggccaaggagacggcgggtgcggccaaggagaagacggcggaggtggcggagggcgccatggacagggccggcgaagccaaggacagggccgcggagggcaccaggagcgccggggagaaggtggcggagttgaccaaggagggcgcaagcaaggtggcggagaccgcgcaggccatcggcgagaaggcgaagcaggcggcgcagggcgcctgggacgccaccaagggagccgcgcaaggggtgaaggagaaggtcgtctcggagagcacgacagaggagcactcgacgtgggacgacgtcgaggcggcgacgaaggagagggacaggatcgcgcaggaggagcggaagaggcaggccagggagaagggcgccggcttgccgtagacgaagatggctgtctggaaatctgtacgcgtctagtggcctctgtttcgagttgaatcttagttttcagcctcttcagtttacatgttgaataatgctttggtaaacagatgcgccgatgcctcctctgagataagaacattggagcaaacatgtagtagaaaagacaggaaatttcttttgagctcttgcaatgtgtgctgtctccgatggaggatg

SEQ ID NO: 33 - DNA, 1910 bp, Hordeum vulgare
ggtcctctcccccacaaaatcaaacgccctgctcactccgaggcgcggccatggagctcgccaccgcggccgtcgtctccacagcctccatccaccacggccgcagccattcctcagccccacgaacagcctcctggtctagctcctcgtcgccgtcctcatcttggtccctgtccatccccgcctccacctcgcggtcccagaggcgacggctccccgtcacctcggccgccgtagagctccgcgaggccgccgcgggtggtggggactccgtccgcgtcatcgagacgccgcagcccaactcctgtgttaagttcagcgtggaggtgcctccctcgatatgccaggagtgctaccaaacaactcttctcgagtactcaaagcgtttcaaggttcctggatttcggcctggaaagatagttccagaaaatgtacttttaaactacgttggaccgcaacatgttcgggccgcaacagttgaagctatcttaagacatacgcttcctcaagcattgtcctcggtagaagagagggcattagaagattctgtgcgcattctcactaagtttgatgacatgaacgaggctttctcccttgaccatgtctttagatatgatgttgctgtggatgttgttcctgaagtccgttggttatctgaagacaaatataagaacctcaaagtggttattgaaatagatgaaattgttgatgcagaaaaggcagccgagttagagcttaagcgtcgccgtaaatctctagggctgcttcgaatagtaactgacagaggcctacaggtaggtgatcttgttgtactggatatattggctgaaactatcacgaccgacggctctaaaggtgaaaaaattccatcagctgagagtacagggttccacttggacactgaggaaaatactaatcttgttcctggatttctgggttcgctgattgggattcgtcctggtgagactagaacttttcctattcagttccctgagtcatttgagcaggaaactctacaaggtgtccgtgcccagtttactgttgtctgtaaagaacttttctacagagagttgccagaattggatgattcgcttgccgcaaagctccttccaggatgcaataccatcgatgaggttaaagagcgaattttggaaagatgcaaagaagtggagaagacggctatagaacaagcaacagataacgcaatcctcgaccaactgggaaagttggtagatgttgatgttccacgttccttgtttcaagaacaaggccagcagttgtatggagccaaacttctacaacttcaggcagaaaggaagctagacaaagaccagctagcatccctttcaagcgagaagtcggtccaggagtacctaaaatccgagagggagaacatcactaggatcattaaacaaatgttggttgttggtgaaatattcaaggccgaaaatttgcagtattcgacagaccagctcgtcaaggaagttgagaactccattgaagagttcaaacgctataatcaagactacgacgaggggaacatcaagcagcaggttcaggatgttctggaggctgcaaaggtgcttgagtggctcaaggagaactgcacgatcgagtacataaaaaaatgagcgcggcgctcgatgctctgtcagttttcaaggatggcaggcgtgcaaactctctctggcctaccttggttttgcagacgggaagggtttgctctgtttatagcacacacaagagagaggtctcgtttacatgtagatgtcaagtttgctctataagtaccgaaagtgttactctaatcccgagctcaaatatcataaacaagttttctctttttttttgaaaaagaggcgtagccccggcctctgcatcgagcgatgcatccaaccttttatttattc

SEQ ID NO: 34 - DNA, 2596 bp, Hordeum vulgare
gctcctctttccccctccccacccccgtccgccgccggacgcccgcccgccgactccaccgaggcgaagctccgtccctccgcctcctccgccgcctggcgacgaataagtagcaaatctttacgccggcaagatggtgcagtataatttcaagaaaatcactgttgtccctcctgggaaggacttcattgacataatcttgtcccgcactcagaggcaaacaccaactgttgtccacaagggctatgctatcaaccgcattcgccagttctatatgcgcaaggttcgctatactcagcagaacttctatgagaagctttccaccatcatcgatgagttccccagactggatgacatccatcctttctatggcgatctcctccatgtgctctacaacaaggatcactacaaacttgccttgggtcagatcaatacggctaggaatatcattgcaaagatctccaaggactatctgaggctgctcaagtatggagacaccctgtaccggtgcaagtgcctgaaggttgctgcactaggtcgcatgtgtactgttctaaagcgtatcagtcctagtttggcatacctggagcagatcaggcagcacatggccaggcttccatcaattgacccaaacacccgtactatcttgatttgtgggtatccaaatgttgggaagagctctttcatgaacaaggttacaagggctgatgtggacgtgcagccttatgctttcacaacaaaatccctttttgttggccatgcagattacaagtatctgcgttaccaagtgattgacactccagggatccttgatcggccttttgaggataggaacatcatagaaatgtgcagtatcaccgctcttgcccacttgagggctgctgtgctgttcttcttggacatctctggttcttgtgggtacactattgctcagcaagctgcactcttccacagtataaaatccctgttcatgaataagcctctggtcattgtgtgcaacaagactgatttgcagccgcttgatgggctttctgaagaggacatgaagctcgtaatggagatgaagtcagaggctatgaagactatacctcaaggtggagatcccagtgaagagggtgttttgttgactatgagtgctttaacagatgagggtgtgatggctgttaaaaatgctgcatgtgagaggcttcttgagcagagggtggagatcaagatgaagtcaaagaagatcaatgactgcttaaataggtttcatgttgctatgcccaagcctcgtgacaacagagataggcctacttgcattcctcaggctgttgttgaagctcaagcaattgctgctgcaaaggaaaagaagaaacttgagagggaccttgagaatgagaatggaggtgctggtgtctattctgccagtctcaaaaagcattacttgttggctgatgatgaatggaaggaagatattctccctgagatattggatgggcataatgttgccgatttcctggatccggatatcttggaaaggtgtgaggaactggaaagggaggagggtcttcgtcttgaagaagaagctgctcaggatgctttcatgattgatggccatgacgaattaactgaagaacagcgtgagatactgggtaagattaggaagaagaaggcaatgctcatccaagagcataggatgaagaagagtactgcagagagccgtcctatcgttccaaggaagcatgacaaggataggaaattcacaaccaagagaatgggcagacaactcacatccatgggcgttgatcctactgcagctgtgaaccggcttcgcagccagtcaagaggccgtaagcgtgagaggtcactgagcagagctgatggtgacaatgctatggacgttgatggccagcactcagacaagaagctgcgtacaaggtcgaggtctaggtccaaatcacgaccaattgaagaggtcgtaccaggtgacgggatccgggatgttgctcaaaagaagaaggccatcaagaaatcaagggactctgtcaagaacaggaacaaggaggctcgccgtggagaggcggatcgcgtcatccccacgttgaaaccgaagcatctcttctctggaaaacgaggaattgggaagaccagcaggcggtaaacaagtcaatgtggacgttgctgcttgcgatcactcgatcaggaactgcagaatcactgccatttttcgtgctgggcatcgggggaggcttgagcgccaatctggcaggagatactaccatctactgcatttttatctttgtctggcttttgctctctgttactcgtttgttagactacatcgttgtcgaactatatgcttgtaccatcggtctactccgcactagtgcggagcggagtcagattttgtttgatggtgttgttaatgtatttgaacaggcgcttgttttcctttccatgaaatgttttgatactgtgagattgcacctcggtctggaacctgtgaggttcagcaatttcaacggcagccaccgcagttggcttcaggcgccagtgcttgcagttggtgtttcattcaagttaattacgaagaaatcctactctcgttaccttc

SEQ ID NO: 35 - DNA, 1123 bp, Hordeum vulgare
cggcacgaggctcgagtgagcagcaatgggttcccttcacaagggtggggtttggtggttgctcctgctcgccgcggtgctgctggctaccgcggcggcaggcgcggagcaggacgatggggcggcagccactgccgtcccggaggtggaggtggaggtggaggaggtcggccggcccgtcgatgatcagggcaacgactcgtgcgacatcaagtgccaacatcataaagttccggcgaggaagaaacagtgcgtcgacgagtgccacagccgggagcatcatcacccaagcagggcgtcttgcgagaggaagtgtagccattggagagacccggcaaggaaggaacagtgcgtgcagcagtgcatgcgctacggcctcaacctcgacgtgggcggcggtgacgatgtcatcgagcgcccccacgccgaggaggtggaggtcgatgatcagagcaacgactcgtgcgaccacaagtgccaacatcataaagttccggcgaggaagaagcagtgcgtggacgagtgccacagacgggagcatcatcacccgagcagggcggcttgcgagaggaagtgtagccattggagagacccgacaaggaaggaacggtgcgtgcaaacgtgcatgcgctacggcctcaacctcgatgtgggcggcggcgacggcgacggcgacggcgagcagctccgccgctgggaagcggtggccggagccatcatcgaggtggtgtgacgtccgcggcgtcgcgcacctaataataataagaataatgtaatggcgcttctgcgtgtgtacacgcttctatatatacgcccgcgtatacgtcttgctagctatgacggcaaaggcgtgagaataaaagaccaatagcttgcagtagcagcatgattggcgatgcctctcctagaagagagctccatggaactctgttccttttccttcttttagcaggttggtctgctatgtatgtttaccgcaagaagaagcaagagctgcatgtgtatgtgtacgtgtatgtatacatgcatgtgtaatgtaatgtgtatgtgtatgtgttgcacccagaaatgaaaaggtacgtatatttgcggttacaccgctttgtctaaaaaaaaaaaaaaa

SEQ ID NO: 36 - DNA, 1170 bp, Hordeum vulgare
atccaattcaatccgtcttcctcttctcctctccttgctgcactagtagatgagcatggcggcgacggcaccggcggccgccacggccacggcctggccttccacctcctcctctatccaccaccacgccacccccaacccccgcgccctccgctccggcttcctcggccgcgccctcacgctctgcccgcacccggtggacgcccgcgccgccgccgccgtgtccgtgcgcgcggcctgggacggtccgctctcctccgcgcgcctcatcatgcagggccgcaacgtcaagctgacggagaagctcaaggagcacatcgaggacaaggtggggcgcgcggtgtccaaccacgcgcacctggtgcgggaggtggacgtgcgcctctccgcccgcggcggcgacctcagcaagggccccaagctctcccgctgcgaggtcacgctcttcacgcgccgccacggcgtcgtgcgcgccgaggaggaggaggaatcctcctacgcgtccatcgacgccgccgccgccgtcgtcaagcgcaagctgcgcaagatcaaggagaaggagacggacgtgcgccacctcaagggcaccaaggagtggcaggccgccgacgctgatgcgactggcttctccgacgtcgaggaggaatcggagctagagctcgaggaggacgacctggtcgaggtcatcggcgccgaggacgaggagaccgtgctcaccaaggttgtgcgcaccaaggtgttcgagatggcgccgctgacggtggacgaggcgctggagcagctcgagaacgtcgaccatgacttctacgccttcaggaacgagcagacaggcgaggtgaacatcctgtacaagaggaaggagggagggttcgggctcatcatccctaagcaggacggccacgtcgacaaggccaccgtcaacgccaaggagcaccccgtcgccggctgaccacgccctccgtcaatcactagctgtagctgcattagttggtctgttttttcccctcatgatggtgggtgtctgtcaagcaagtgttggtgtttcatcagatcagacagccccttctttgtgcaaattaacagacgctctctgggctgtgttaactcatgatgatcccacataccagttggtaagttgtttctctggctcgaaacggcagtcatattaac

SEQ ID NO: 37 - DNA, 1378 bp, Hordeum vulgare
cacgaggcagcaatcgatccatctaaactaggtggaacagtacgtacacggcaaagcaaatggcctcaggagtgtttggtacccccatttcggagaagacggtgatagccactggtgagtataaggaacccattactcaaaaggatgttgcagactataccatgaagatgatcaacgccggtggtaaggatattaacgcacaaaccttcgtcgacaatctcaaagagcggtacggtaacggaatagctgtaaaatgcctcatctacaatgccactggtgccactttgagcttggctaagtacaacgattggcacggccatatctatgatacaccctacccatcagatattcagaatgggcaatggggtgcattcctccacgtccacccaagtggtgctgcggttggttcagctggtgccgttgtgtatcgtaccaagatcccctccagcaccaggtcctgcgattggttgttctcctggaccgtcccctacattggtgccaacggggtgtacaccgaaatccgtgaggaaggacactacccaaatgtgggaagctggggttatatctatggtgtgaagcttgcaaattcagatctcaactctactgataaaaactatggatatgtttccaagactaatatcggtgaaggctctaccatgaacgcccgtggagttttccagtatccctactagatctcgttatcaacatcaaaggcttgtgtggcgaagacgttgcggtgtatttcctaagagccggtgtacaaactatggatatgtttcgtctactatctttgtggtgcatttcctaagatcgggtgcttatgaataatcaaggaagaagacaataaatgagatatcatgtgtgattttatattatttacaagtcgtttgtgtcaagctatccctcttttgtacccactactgttatcctaaataaatatcaaatttatgatactcccccgtctcggtttataagtcatcttagaaaaaccaaataatccccaaaaaaaattaggcacagtacattaactttcacctcatttctgtttttttacatgaataaaggaattaaccaaaaagagacgtggggcgtttatgtttttaatgacttgagactaactgacatgacatgcagtggtcaatttatagtatgggcattatattagcaaattaactttaatttctctcgttttcctctttgtcttggtcgcattgcacaacctaagattacctatacaccgagacggagggagtactcttccgagtgtcttttcttaaaatggaaattaaataaaaactaaagttaggaaccaaccattttctaatggagtacatatagacgggagatgaatttacccccacaagtttataccacgttg

SEQ ID NO: 38 - DNA, 689 bp, Hordeum vulgare
cacgagggtacctgtagcatcgtggcacgcaacagcaacttattagctagaccgcgtgtcctcctcttgtacgctaccaaagcttgtgtgcgccatttgcctataaatggtggcgccggctagaggctatccattcaattcaattgctcatcaccatctccgataccaaagctcatcttcttctccttgaaatcttttcgggttcaccagatctgaaggatgtcttgcaactgtggatccggctgcagctgcggctcagactgcaagtgcgggaagatgtaccctgatctgaccgagcagggcagcgccaccgcccaggtcgccgccgtggtcgtcctcggcatggcgcctgagaacaaggccgggcagttcgaggtggccgccggccagtccggcgagggctgcagctgcggcgacaactgcaagtgcaacccctgcaactgttaaagctgctacgtaagtgtgatggtgtgagagtatacgtgaataacgagcgtctgatgatctgatggagtcgggcaagggtgcgtgtgcgtgcgcgtgtgcgtgtggtgtggtttacttgctcgctctccgcctatgctctgccctcggtgtcgtgtgtatgtatgtgcttgtgtctcggtaattgctccattgtctccactacgatggagtcatgaatatataagattgaaaggtttacctaa

SEQ ID NO: 39 - DNA, 1197 bp, Hordeum vulgare
ttcggcacgaggcctagaatgggttcgtggtccactctctcgccctctcccaattccccccatccacgcgccaaaaccgcagccccatctcctccttatctctccgtgccactgaaattccctgggaacaaacactcacttcccaaggataaattgtcaagattgatttacacgctagtggctgtgccgcgacgtgcggcggagggagagagacatgtctctgcagtgcactgcaaactcactccgggctcttgctgcgctcccggcgccatcctcctcccgccgcctggcgagaaatgctttccttatgccatgccatacgagtcgcatcggtgcgctggtccgagctgcggattcttcccctcccgccgcacccgcgtcatcgtccggagcagccgacaacaaggccgtcatccccgacgatgagttcaccctcgccaaggtgtcttttggcgtgattggactagggataggtggctccctcttgtcgtatggatttggggcgtatttcaatcttctccctggttcggagtggtctgctctgatgctaacctacggatttcctctcacaatcataggcatggccttaaagtatgctgaactgaaaccagtgccctgcataacctactctgatgcttttgctctaagagaaaagtgtgctacccctatcctcaagcaggtcaggagtgatgttacacgctatagatatggtgatgagcagcacctcgatgaagcgctaaagcggatctttcaatatggtttgggtggcggcattccaagacgtagtgcacctatattacaaaagattcaagaagtaactgatgatgggaaatactgtttagtactggaatttgaagccaaatcgttggggctatcagattttgagaagaggcaggcaaaattcacctcctttttcggtcctgggattgaggctaaaatcggaaaaggtggtgacgatctatatgaagttcgccttatctcggagaccaccgaggaagagtgacagcgtttgcgacccgattctctgctactaatattcaacaaatgatctttatttccttttctctctaatttgcatataatctcttgttattgtaaaaatatatatttaattttgcttctgagctttgtatgaagttctaaatctagcatcgtatgcttcattcacataaaaaagactattgtaataaagattta

SEQ ID NO: 40 - DNA, 3431 bp, Hordeum vulgare
aaaaaacaaaaagagagaggggcaagcgaactgttccacagtcgtcgtcccctgtcccctccccgtcctccgccccgcccgcaatccaatcccggaccggcggctggcgggcgagcgagcgagatggcgacgctgacctcggagctgctgcggccggtgcacgaggcgcaggcgctggacgaggcggcgctgctgcggtacgcggccgcgcacgtcccgggcttccccgcgccggcgccggcgctcgccctcacgcagttcggccacggccagtccaaccccacctactgcctcgaggcctccgctcccggcggggagccccggcgctacgtgctgcggaagaagcccgccggcgccatcctccagtccgcccacgccgtcgagcgcgagttccaggttctcaaggctctgggtgcttacacggatgttcctgtccctaaggcgttttgcctttgcactgatgctagtgtgatcggaacccctttctacataatggagtatctggaaggagcattatatcttgataacaagttgacgggaataaccccagataaacggaggaatatatacctggctgctgcaaaaactttggctactgtacacaaaattgatgcgactgcagttggattgcataagtatggaagaagagacaattattgcaaaagacaagtagaaagatggggaaaacaatatcttcattcaaccggtgaagggaagcctgcgcgttatcagaagatgcttgatctaattggttggctgaaagaaaatataccagaagaagattcatcaacaggattgggaactggccttgttcatggtgattatcgtattgataaccttgtttttcacccaactgaggatcgagtgataggtgtacttgattgggaattatctactttggggaatcagatgtgtgatgttgcttacagctgtatgccatatattattgatggagcactcagtgaaaatagttcatatggaggatttgaacattctggcattccagatggcattcctcaactggaagagtacctagccgtgtactgctctatgtctgcacgaccttggcctgcagcaaattggaagttctacattgccttttcactgtttcgaggggcatctatctatgcaggagtataccacagatggactatgggtaatgcttcaggcggtgagcgtgctagatttgccggcaaggctggcaatgttatggttgactgtgcctgggattacattaatagagaaaatgtcctgagagcacaccctgctacaggtatgcatgtctcgaaggctccccaacaaggtttccatgtagagcaggaagattcaactttgacaagtggtcaaggcaaatttgttcctagcgaaaaggttatgaagctacggcataaaataatgaagttcatgaaagatcatatataccccaaggaagatgagttatacaaacatgcacaatcaacctcacggtggacaatccatcctgaagaagaaaatttgaaagcattagcaaaagaggagggattgtggaacttatttattccgcttgacagtgcagctagagcaagaaagctactccttgaggaccgatcttatgtttctgctggaagttcaaatgatcttttgctaggtgctggtctcacaaatcttgagtatggatatttatgtgagattatgggccgttcagtttgggctccacaaatatttaactgtggtgcacccgatacgggtaatatggaggtcctgttgagatatggaactaaggagcaacagaagcagtggcttgttcctttactggaagggaaaattcgttcgggatttgcaatgacagaaccacaagttgcatcttcagatgcaacaaacatagaatgttcaatatccaggcagggagatttctatgtgataaatggcaggaaatggtggaccagtggggctatggacccgaggcgcaaaatcctgatattaatgggaaaaaccgatttctctgcacctaagcataagcagcagtcaatgatcttagtggatatcaacactcccggagtgcaaataaagagaccattgttagtctttgggttcgatgatgcaccgcatggacatgcagagattatttttgataacgtccgtgttccggtcacaaatatcctcctcggagaagggcgtggtttcgagattgctcaaggaagactaggtcctggaagattgcatcattgcatgagactaataggagcagctgaacgtggcatgaatatgatggttgagagggccttaagtaggaccgcctttggaaagaagattgcgcagcatggttcctttcagtcagacctggcaaaatgccggatagaactggagcaaactaggcttctggtgcttgaagcagccgatcagctcgaccggcatgggaacaagaaggcccgcgggattctcgcaatggccaaggtggcggctccaaatatggccctgaaagtgcttgacatggcaatacaagtccacggcgctgccggggtctcatccgacacggtcctatcccatctatgggcaaccgctaggacactgcggctcgccgacggccctgatgaagtccatctcggcacgatcgcgaagctggagctgcaaagggcaaggctgtaagatcaggacgaggtccagattcaataagggggacggcaaacctttggagaaggtcagttaaggatatcatcacagtcacgggtagatagaatggtgaataagtggcgttagattcctccatgtacactccctgtttgccttgtcgattccattgtcatttgtccatcagaaccatgacacatctttaatgttcgtcctcttgttgtaaagagtccaaccctaccagcaacagttacatgagtaccagtgatgactattacagatctggacaatagtctcagtagtaccaatgcgtatttcagatttgaacgtcggcgccaacagtttttcttcagtgtactgtggaaatgagagcctaatgtaatctcttattcaactttttttacctatgagccaaaatgaatggacccccgtacccatacatttcggtcatcctattcctacccgaggccgagcgtgtaggggaaggaggtggagttgagccagaggtcgccctggatgaacgcctgcgcggtgaagttgccggcgtcggcggcggcggtgatcacccggtaccccggccacgccaccctcgccgacgtgtcggcgccggggccccggttcatgtactcggcgtaataaagcgtgtcgagcgcgaaggtgccgttccactcgagccaaccccgggggtgcaccagggcctccatcttggactgcatgaacaccgtccgggagtaggccttccagggccgtccgaggtaggaggagaagttggcgagcacggggacgaggtcggcggcggcggcgacttgcatccctgcacggcg

SEQ ID NO: 41 - DNA, 1437 bp, Hordeum vulgare
ccattggatcatcatcgatcgcagggagagtgcgcacatgctgtccagtgacgttccgggaaggaaccaccgtgccgtgccgtccgagaagttccccacacgcgaccaccctataaaaccatctccagcaagacggttcttgccatcgctcagtttaccagatcaacaccaacagagatcgctccccacccaccaagacctcccattagcttttcgaccagtttattacttcttcaacagctaagaaccatgagctctcggatggccggagccacgcttctgcgccacctgggcccccgcctcttcgccgccgccgagccggcctccgggcccgccgcgagcgcaaggggcgtcatgcccgccgccacgaggatcttcccggcgcggatggccagcacggccgccgccccgcacgccaaacaagaagaagccactgagaagccccagggcgcgacgacgccggagcaggcggtgagctactggggcatcgagccgcggaagctcgtcaaggacgacggcacggagtggccgtggttctgcttcaggccgtgggacacgtaccggccggacacgtccatcgacgtggccaagcaccacgagcccagggcgctgccggacaaggtggcgtacctcatcgtgcggacgctgcgcgcgggcagtgacctcttcttccagcgccggcacgccagccacgcgctgctgctggagacggtggcggccgtgccgcccacggtcggcggcgtgctgctgcacctgcgctcgctccgccgcttcgagcacagcggcggctggatccgcgcgctcatggaggaggccgagaacgagcgcatgcacctcatgaccttcatggaggtgacgcagcccctgtggtgggagcgcgccctcgtgctcgccacccagggcgtcttcttcaacgcctacttcgtcggctacctcgtctcccccaagttcgcgcaccgattcgtcggctacctcgaggaggaggccgtccactcctacacagagtacctcaaggacctcgaggccggcttgatcgagaacacgccggccccggccatcgccatcgactactggcgcctccccgccgacgccaggctcaaggacgtggtcaccgccgtgcgcgccgacgaggcgcatcaccgcgacgccaaccactacgcatccgacatccattaccagggaatgacgctgaatcagacgcctgcgccgctcgggtaccactaatcagttcaatgaaccatagatcgatatggcttctcagtccacgctgttacgtgctaccgctgccgccgatgttcgtcccgttaatttggatggattgttgcgtgcgcagtatgtttatgtaaacggtttatgtctgatgagttctgtttgtcactttgtacccaaagatatgtttttgtaagcccgtaattcttgtaaggacaacgctaccca

SEQ ID NO: 42 - DNA, 2188 bp, Hordeum vulgare
  misc_feature (645)..(645): n is a, c, g, or t
  misc_feature (697)..(699): n is a, c, g, or t
tggacaaggtggtcgcgacggtgagcggctaccacggcgacgagcggcacaggctggcgaagctcatctcggaggccggcgccagctacgtcggcgccatgagcagatccataacccacctggtttgctggaggctcgaggggaagaagtacgacatcgcgaggcggctccgggtccgcatcgtcagccaccgctggttcctccactgcctccagcaggggacgcgcctccccgaggccccctacgccatggaaagtggtgaagaagccgggccggtcccacagctgtctgatttgccaggcaggcggtccaagagaaatgcatccagggaggatccatgcgtgaaagagttaccttcggatttatgcaatacttcatatgccagcgatgtggtcaagattgatgattcagattctgattctgagcatcggggatggttggagtcatccctattaaaagagaatttagccgttgccgggaattcgaagaatatttgttcaggcgatgttaaaggaggaaaaaaacatttgaagcgtgagcggaagtcaactgataaagatttcctacgtctgcgagacaatgcttcaaggttcagggaggatccttgcttgaaagagttaccttctaatttatgtagtacttcanatgccagggatgtgctcaagattgatgattcagattctgattttgagtatcnnnctggttggattcatacctattaaaagaaaattagtcgttgccgggagttcgaagaagattcattcaggagatgttaaaggaggaaaaaagcgtttaaaacgtgaacaaaagtcaactgataaagatatcctacatctgcgagacaatgcttcaagtttgatgataagagaaggccttcacaagtcaagttctacttcatcccggagcacatcgaagcagaagggaaacttgtcaggtctcctgcgtaacgaggttgttggtcagatgggcgaaagaaatgatcctatgagaaagggatcacgaagcaagcatgcacgctctcttttggaattatccgatgatggtttgtcagatagttttgaggaactgcaaatgtttgatactctgactacagaagctcggagagaaaaaaggagcacaaatgcaccatcatttcggcaatctacattggaaagtgcatacgattattgtgaaactagtatgcatgattacgaattggagaagtgggaagagcatgaaaatattgaatttggtgaaaggtcaagaagcttgcaaccatgtgatttgttggggcatgaaccatctttctgtactcaagagaaaatagatcaaagtgatcttcgcatcacagctggtgatgacaagggagatgatgataagcccgccatggaagaaccatccagcatgcaaagacaagcagaactttcatgtgtcatttgctggactgacttttcttcctcaaggggcatcttaccatgtggacataggttctgtttttcatgcattcaaggatgggcggattgtctgtcttctaggggaaaggtctcgacgtgcccgctttgcaaagccagtttctcctggatcagcaaggtggatgaggccggcacttcagatcagaagatatactcgcagacccccgttccttgtggagcttcaaccgacatcttcatgttcacggatgaaggccacgaccttcctggaccatcgtccgcccaaggggcctgctacatgtgccacagccgtgagcccgaggagcttattctgagctgccacgtctgccgatcgcagtgggtgcactcgtactgcctcgatcctccactgaccccatggacgtgcatacactgccgagatctgcgaaggatgtatcagcgctaccgctagtccgaattccggaagttcattggcgtcttggactcttgattcttggcgtcttggagattctcagggcagatacaatgcaaggcatgttgacagctgatgattagttaattcctcaagattgaaggacagagcaagaagcagagagacaggaaaaggggcggcgtcaggctgcgacgctctttgagtttgccgcatcttacgtttatcttttttgcgtatatatgggttctcgagggtcaacatcttgttgatctgggcatggtgcaggtgcatatggcgctttcttttctaattcaggcaatgaacagaagaagttttgtactggtag

SEQ ID NO: 43 - DNA, 1824 bp, Hordeum vulgare
acgcgtccggctcgctccactccccaccggcccatccatccatccatccatccatcgccgccgtccgccggagatgctcggtcggctggccgcgcggcggccccgcccaggcagcgcccgcgccgcagcagcctaccgctcctcggcctcggtcctgcccgacgcgctcgaccggagctccgacgcctacgcgcgcaacgccgccgccgtcggcggcctcctctccgacctgcggtcccgcgtctcccaggtgctgggcggcggaggcgcgggggcggtgaagcggaacgaagggcggggcaagctgctccccagggaccgcatcgaccgcctgctcgaccccggggcctccttcctcgagctctctcagcttgcaggatctgatgtttatgaggaagcattaccatcagctggaataattactggcataggacctgttcatggacgactatgtatgttcgtggccaatgacccaactacaaaggggggtacatactatcctatcactgtcaaaaagcatctgcgggcgcaggaaatagcttctgaatgtaaattgccgtgcatatatcttgttgacagtggaggtgctaatctcccaaagcaggcagaagtttttcctgaccgtgataattttggtcgaatattctacaatcaggctaagatgtctgcagatggtattcctcagattgcagtagttttaggttcttgtactgctggcggggcttatattcctgcaatggctgatgaaagtataatagtcaagggaaatggaacaatatttctagctggtccaccccttgtaaaggctgctacaggggaagagatatctgctgaggaccttggtggagcatcagtgcattgtaaaatatcaggagtctctgatcattttgcacaagatgaacgccatggtcttgcgctgggaaggaacattgtgaagaacctccatttggccgctaaagaaacaagtatacacaattctgcttgtgattaccaagaaccattgtatgatgtacaggaacttcgctcaattgcaccagctgatacgaagcaatcttttgatattcgctcaataatagctcgtatagtcgatggaagtgaatttgatgaattcaaaaaattgtacggaacaacactagtgactggttttgcaaggatatgcgggcagccagttggaattattggaaacaatggcattttatttaccgagtcggcactaaagggtacccacttcattgagttgtgtgctcaacgcaatattcctttgatattccttcaaaatatttctggattcatggttgggtcgaaatctgaagcaagtggaattgcgaaagctggagcaaaaatggttatggcagtttcctgttcaaaggttcctaaaattaccataattgttggtgggagttttggtgctgggaattatggaatgtgtggacgtgcatacagcccaaattttttgttcatgtggccaactgctaggatatctgttatgggtggcattcaggcagctggcgttcttgcccaaatagagaagaacaacaggaaaaggcaaggagtggagtggaccaaggatgacgaagaagccttcaaagccaaagtcgtcgaggcttatgacaaggaaggaagcccgtattactcgaccgctaggctttgggacgacgggatcatagaccctgcagatactagacgggttctgagcctttgcctctctgcttcggccaagacggttccagaagacacgaaatacggcgtgttcagaatgtaaaatcatgcatgtatagtgcacatccctgtaaaataaaactcgcttcgatgcttccaatatat

SEQ ID NO: 44 - DNA, 2128 bp, Hordeum vulgare
cgcacaccccacaaatgaagcgggtttcttaaactcgacggaagagaaggcacgcgccgccgcggggtggagacgatggcccccgccgccgcggcgccggcgccggccgccaccgcctgctcctcgtcggcgagctccgcgcgcccgccctccaccgcctcctcctcccagtcgccgcccaggcgcacggtcccggcgctcctcctcttcatctccctcgccgctctcctcatcctctcctccggcgaggcccacgaccccgacgccgactccgggcgccccctcaaagacgttagcttggaatatccggaggtgacttttgctccctcatccatgggtggaattttctgtgagcgaatccgcatatctaaaataccaaggtggcagtttcaaagctatgcaaatcaaatacatataagaatgaatgtctcgcattcattgccagaaaagttccattggaaaatacagatttgctttcatgggaatgtttctaccggtctgtgccaatgtgagatgggtgaatggcaagctctgcacggtggcacgtggaatgctgtcaagtctccctacaacagcagatatgttgatgtgaaacttactgataagaaatctgctgtcttcagcctttccattcaggaagagcttcagaagtggcgtttagcttgccttggtattggatttgttctgctattcctgtcacccatcgttagtaaatgggcaccattttactatagcagctctatggctcttggaatcctacttgtggtgctgattgtccttttccaggggatgaaactgctaccaatgggcaagaaaggtttattttaccttacaatttacggatctgttttgggtgttggctcctacgctgcacactacttctcctcagtggttgcttctattctggaaaactttggcttgagtgaggagatgcacaatcctgtgtcaatcttcctgctggtagcagttgtcttgactggagctggttttggctattggatggtgaggagatatatcatttcaaaagatggctgtgttgatgccgggatagcacagtttgtcaagtgggctatgcgtgttgttggaatgttctttgttatgcagagcacactcgaccctattctagcattcgctgctctagctgctacctcgtgggtttgctctgtattgacaacaaagaaagttcacaagccaacggcaccgaagcgaaaacaatcaaatgtttcttctcatccaaggtttactcaagtatcaccgaacactcgccaggtccagttcttaagtccatcatcaagggcgggtactggaagagccacaacaacacagtatggttggaactatttagccaatggaggtctggcctcctcagcactggtaaagaggctagcacccaatcaagacgaagactactactccaccttccacaacatcgaaccacggaagtactcaaagagagaatgggaggagttcaccgaggaatcgaccagaaacgcactgatggagcacacagccaccccagagtttgcccaatgggctgctgacaacgctcaccggctgcgggtggagcgggacgactcgtccgaggacgagtcgatcgagacctcctcaggctcttccgaagaggccgagaaaggcggaaaagcttctagtctgttgggcaggttcatgtgatatcgtcacccgactaaagctgcttttgcggacgatgtgtataaggtaggattgggaacttggtagcagtagtagctagtaggaggtggaagttcatcgattgtggcagaatgcttggtgactgtaggctgttagctggttggttaaccaccgtcatccatctcaattcgacaactgatgttaggtttagccggcagtctgccatccatggatctttaagttttagccgatgcatcaggggacatgggccggtgccattcgatggattagggaccttcgatcctgtcgggatcttgccattgtcttgttgaacatctcatgtttcattctcaggtgtgagggtagcatttcaaggatctttatctgttgttagccaggcatgtaaaccagattgtttgggcatgtagatcaactggagttggttgctgtaaaccgttcgctggacccacacacacac

SEQ ID NO: 45 - DNA, 1287 bp, Hordeum vulgare
ggaacaaacaagtctctgcacggctgcaccggagcaggaaccgagagagagagagaagctctgcccctgagctcctccgccggcatggagatccttcaacaaggcactatgtcgatgttccctgggatggatcttacgaaaatggatcctccaactcttaccctccttggagcagcttgttgtgtaatgttgtctatgcatttcacaatacagctggtatcacagcatcttttttattggaaaaatcccaaagagcagaaggctatactcattatagtgctgatgcctccattgtatgctatgacttcctttgctggtcttctggatattaagggaagcaaaacgttttttacatgcttggagtctgttaaagaatgttatgaagcactggttattgctaagtttctggcattgatgtacagctacttaaatatatctatcagtaaaaacatcgtacctgatgaaatcaaagggagggtgcttcatcattctttccctgtttctcttttcctgccccgtaatgttcggttggagcacaagacacttaagcttctgaagtactggacctggcaatttgttgttgttaggcctgtatgctccattctgattattgtacttcagcttcttgggttgtaccccagctgggtcagctggacgttcacaattatattgaacttttcagtctccatggcattatatgccttggtcatattctatcacttgtttgctaaggagctggcacctcacaagcctcttgcaaagttcttgtgcatcaaagggattgtcttcttctctttctggcagggctgtgccttggatgttttggctgctgtagggtttattcaatctcaccatttctggctggacgtggagcacatccaggaggcaatccagaatgtcttgattatcctggaaatggtcatcttctcagttctccagcaatacgcatatcacgttgctccgtacagtggcgctgacaaggcaaaattcgagaagaagaatgaatgatccgccaagcaacataagcagcttgttcttgtatggttttgtgtgtttgtgctgggaacacggattcaacatgctataggacatgcatttccttttgggcatgtgtagagtgagtcgttatacgttgaacaatagaataccgagatgtccaggattcaggaacatgcaggaatggcactgttatttgcgctgtgaaactatgtaatgcaccaataaggagaattttggggttttcccgctccaagatggagtcctgaataaatgtggtttcctgctgaa

SEQ ID NO: 46 - DNA, 2018 bp, Hordeum vulgare
ggggcattcaccccggcacaacaaaaccctcgtctctgattctccaaagcggcggcgcggtgggcatggacggcgccggcatggcgacgccgccggaggccaacacgtcgcccgctcccaacggcggcggctgcggctggatcagggttgagaattgctacgtcttcaagagcaggctgcaggagtacgtgcagaaagccggcctcatgacgccagagtaccaaaccctcaaggaggggccttcccatgcgccaatcttcagctccaccgtggtgattaacgacgtcaagtacgactcgctgcccgggttcttcagccggaaggctgcagagcagtcggctgccgaagtagcgctcatggaaatcggcaagtctatggcgttaccaaccaatgcaaccatccctgcagtccaagaaactggtctgtgcaagaatcttcttcaggagtatgctcagaagatgaattatgctattccatcttatatttgcaacaaacaaagtccatacatatgcaccgtagagattggtggaatacaatacattggtgctacagcacggacaaagaaagaggcagagataaaagctgcccgaactgctcttcttgcaatccaagttgcaggccaatcagagggttgcgcgaatggtaccacaaaatatattgttgtgcctggaaaaaggcaaggtaaggacaccgagaaaaagcccgttgaaactccaaaatcacttaagaccaagaaaggtggtttcaagaagcaacggaacaagaataaattcatcaagaagaatggccaagaagttaacgagggaaaggatgagactggagtgcctggagatgctcatcattcagatgtccctatgaagccagctgtaacaacagaagatccatcggccaacactgtaatgatgcaacctgatgaagaagcttggtcattcgaacatgaaccagccagtgacactgcaatgctgcaacctgatgaagacgctttgccattcgaacatgaaccgtccggtaacactgcaatgctgcaacctgatggcgaagctacaaaagtaggacaggagcacctcagtgacacagcaatgctgcaacctgatgaagacgcttggccattcgaacatgaaccggccggtaacactgcaatgctgcaacctgatggcgaagctacaaaagtgggacaggagcacctcagtgacacagcaatgctgcaacctgatgatgaaggtagaagaggaaagcaggaaccactcatcggcactgcaatgccccaacctcacatggaagatagaagagtgggagcagagccacctagagatgctgcaatggtgcaacctaatgatgaagctagatgtgtaaagcaggagctactaattgacactgcaatgcctctccccaatgaggaagccggagcaggtgcaaatcctgtgccaccgagtgactccacaacagcgcaacctaatgcagagactacgaatataaatggggagtcactgaggaatgcagcatcagcgcaacataatgaagaagctaggaccctaaaccaggagccacccagcagtgcttcactgctgcagccaaaggaacccagagtcgagaatggtgaatttgtttctgaaaacaaggaccaaactctgggagatgcatctcgtgaggcaaataggtccatcgaagatatgccagaaaagagctcaaataattcatctgcttttacaagcgcggaataatatgtgctgtttgaatcaaaatgcaatggccttccagttttacatcttgatttgcaaactggtaaaactcgaatagctggcttcgcattttagaaatataattgcataacagatggaagcacatggaccgaggtcggttggtggtcttggccattagttattaggaaatttgcatgcctgatggtatgatcttggttccatggatgatgtatctcaagttgcttatctgatcaatgaactattagtgaactattatgaattaatagtcggtatttgttattaacacatgttatgcct

SEQ ID NO: 47 - DNA, 951 bp, Hordeum vulgare
ggggaggagaaggagatggagctggtgtcctcctcccgctccgtcctatcctcttgcaaccgactggttgctccctccacatccaggacggcatcagcagctgctaggcgccacgggaagagtctagtatgtgtcttgggtggagacacgaatggtgagttcaagatcgggaagcgggcagctcttgctctgttctttgctacacccacgctctcactcgccttctcggcccactccaagaccaaaaccataaatccttatgaggaaagacgcttgcttcagcagaacaagaagattcaggaagccaaccgtgcacctgatgatttcccaaacttcatcagagaaggttttcaggtcaaagtagtgacacccgacaactacataacacgggattccggattaatatatgaggatgtcaaagttggtacaggcgattgcccgaaggatggtcagcaggttatatttcactatgtgggctacaacgaatcaggacgaaggatagatagcacctacatccagggttcgcctgccaaaattcggctaggcaacaaatcattagttccaggttttgaagaggggattcgggacatgaaaccaggggggaagagaagactaattatacctcctgagcttggtcctcctgttgggccatcgacgttcttcagcgcgaaacagtttgaagtattcgacgtcgagctactctcagtgcaggactgccagcggaggacaatagctttttactctgatgttgtttgcacttgatcatctggtctgttagtgctgaccggtgcagcattctcctcctacaaccctgtagggaaaaaatgttagctattgttgtacatgccaacataagaaaacgtgcgcgaggaaaagagagggagttgttgtatgtgtatagccaaatgcttgcattataccgttgccatgaatcccatgatgtgggggcac

SEQ ID NO: 48 - DNA, 783 bp, Hordeum vulgare
cgggtttatatgcgcgcccccgtccacctgctctcgacctgagctcaagcggaaccctcgctctctcctccttcttccttctcccgagcaagaacgtggctgcacatccacgcagagcactgcctcatggcctgcgccttcttcttcgacgcggagccgctgggcgagcccggggtgcgcatgcacgggccggagctggagctgcacgcctgcgcgctctgcaccaagccgctgcagagcaacagcgacatcttcatgtacaagggggacacccccttctgcagcgaggactgccgctacgagcagatgcacttcgacgccgccatggccaggcagcaggccagcgccaggcggaagcagcagcagcagcagcaggcacaggcgccgctcggcgtgcccggagcgccggcgcccgtgtccgccaaggccgacgtgtccgtggcgagctaatcgggccgcgccgcgccgcgtcggggttagctagtaggaactatgttaccctttttgccttgggttgaaggaggaggaggaggatgcggggattcttggatcgacggccagtgtttttgccctggcatccggtgcaggtcgagctgttgttgatctgcacatggcgggcaatcggacaaggatcaccgagggattttgattggcccccttttggggcttgggtttgggtgcgaggggtgagagcggggtgtgcaagagcgccgtcgctgtgtaattattcaaggcaatcgatgtaaagtatttctccaaattttgagcgaaatcttatcatgt

SEQ ID NO: 49 - DNA, 1369 bp, Hordeum vulgare
gcggcaccagcacctttactagacctgacccgacctgcagccgcggccccactcgcggtgccccgtcacgaagccggttccctgacggtgccacgaaggccgtgcccgaccccaatggaagcagagtacccccaaataaaccctctccgcctctgctccaggcgccggaaaagggaggaggacgagggagggatcgagctgctgctgtccatggatctcgacgaggaggagacgcggccggagcagcaggcgccgcctcgggtcccggagaagctgaaagcagtgggacaagagcttggacatgagatccggatattttcaagcacaacatttgagctgatgactagcaaattgcccagggcagatcaggaggaagacgatgacttttatgagcttcagcctggtgattattacaagttgatttccaataggcttgcagaacaatcgaaagttctgaagactcgtaaaataagggaagcagaacttgctgctcaacgagcaaggctaacaaaggcagtgatgagggttcgattccctgatggttacattcttgaggttgagtttcatccatcagagacagtacatagtctgttggatcttctcatgaaagtaattgctagaccagacctgccattctatctttacacagttcctccaaagaagcgaataatggacacctcacaggacttctacacaattggctttgttcctggagctaatgtcttcttttcttatgatctgccagaagggtcggagttaaatacggatggtgtaaaatccggaccatatctccgtgaagaaattcgaactttggatggtctgtcacttcactcggaaccttctgaccagcctgatgtttcaaagacaaattctgattcagctcatcagtctgaagcattccgacctgattctgcaccaccaccagcaaataagaaatcagccaaaccgaagtggttcaaaaggtgagaccaccatcagagcgtcaatgctgcaccatgggcgcaatagcacttgattaggccttccagcaatcccaatgcatgattgatcatatttcatggttcaacgacttcagacatgccgcccgtagtagtgcgagagttcatcctgtgttacataggagttgtcgaaccatcggaattagatctcatatgttcctgttggtagcatgtaaatttgggtgtcaaactgctttgtgggtgtgtattggttacccacctcagatatgtgtaaaaggccgcatagaaacggaggaaatgactgggcccgtgttgtttacactttgttactgcaatgatatccagtagcattttcacgggaaagatggcttgagttgaccggaaagttaccaataaagcatgttggcttt

SEQ ID NO: 50 - DNA, 1755 bp, Hordeum vulgare
ctagagctgagctttgcatttggtgttagacttgcgcttgctcaccctgccatgacgtccaaggtacccaacagctccggcagcagcgacagtgcggagcccaagctatcgccgtcagggctctcggtccgggaggtcccgggcggctacggcgttcccttcttctcgccgctgcgcgaccgcctggactactactacttccagggcgcggaggagtacttccgctcccgcatcgcccggaacggcggcgccaccgtgctgcgcgtcaacatgccccccgggccgttcatcaccgccaactcccgcgtcgtcgccttcctcgacgcgcgcagcttcagcgtgctcctcgacgacgccaaggtcgacaagaccgacacgctcgacgggaccttcatgccctccctcgtgctcttcggcggctaccgcccactcgccttcatggacgccgccgacccccgccacgccgcactcaagcgcgtcatgatcagcctcgccgccgcgcggatgcaccacgtcgcgccggccttccgcacagctttcggtgccgtgttcgacgccgccgacgccggtctcagcgacggccccgttgaattcaacaagctcaacgagcaccacatattcgacttcacctgctccgcgctgttcggcggcacgccgccgagcaaggccatgggcgacggtgcggtgaccaaggccatcaagtggctcggcgtgcagctgcaccctctcgccagtaagatcatcaagccgtggctgctcgaggatctccttctccacaccttccgcctgccgccgttgctagttcgcggagactacgccgccctgacggcgtacttcgccgacgctgccgccggcgtcctcaacgacgccgagaaggcgcagtccggcatctcacgcgacgagctcctccacaacctagtcttcaccgccatcttcaacgcatacggaggcttcaagatcttcctgccgcacgtcatcaagtggctagcccgcgccggcccggctctgcacgccaggctcgccagcgaggtccgcgccgccgtgcccaacgacagcgacatcaccgtgtccgacgtcgataagatgcctctggtgaaatcggtagtgtgggaggcgctgcgcatgaacccgccggtggagtttcagtacggccgcgcgcgccaggaccttgtcgtagagagccacgacgccgcctaccaggtacgcaagggcgagatgctcttcgggtaccagcctatggcgacccgcgacgagcgcgtgttcaagcaagcgggcgagttcgtccctgaccggttcgtgggcggcgaagggcggctgctcgggaacgtggtgtggtcgaacgggcctgagaacagcgagccggcggaggggaacaagcagtgcccagggaaggacatggtgacggcggttgggaggctaatggtggccgagctgttccggcggtacgacacgttcaccgccgacgtgaaggagatgccgctggagccggtggtgacgttcacttcgctgaccaccagggccgagtgactatagtagtagcagactgtactactatagtgcaactgccaagtggcgccagcgctgccacaataataattgctatagtagactgtgctactggccaggccggatgtttgttgcatctctggtcaaatctgcatgattaagttcagtgggcatgtgacgtgcgtgtgttggcgattatgtaaagttctttgtggtgtgatcgtttgaacttgtctaataaaaagcttt

SEQ ID NO: 51 - DNA, 1221 bp, Hordeum vulgare
gaaaaaaaaaggcagagagggccctctgctcctcccatcctccgtcaaagccgcaagaagcagaggagggcaaggcggcggagcagagcagagcagaggaagatggcgccaccgcgcccgcgcccgcagccggcgctgctcctgctgctcctcgtctccctgctggccgcctccgcgccccgccgcgccgacgcctggggcaaggagggccacatcatggtctgcaaggtcgccgagaggtacctgtcggaggacgcggcggcggcggtgcaggagctgctgccggagtcggccggcggggagctgtcgacggtgtgcccgtgggcggacacgatgcggttccggtaccactgggccagcccgctccactacgccaacacccccaacgtctgcaacttcgacttctcacgggactgccacaactcccgcggggagcaggggatgtgcgtcgtcggggccatcaacaactacacggaccagctctacacctacggggactcatcatcaaagagctcatacaacctgacggagagcctcatgttcctggcgcacttcgtgggggacgtgcaccagccgctgcacgtcggctacgaggaggacgagggcggcaacaccatcacggtgcactggtaccgcaggaaggccaacctccaccacgtgtgggatgtcagcatcatcgacacggtcatgaaggacttctacaacaagagcctcgacaccatggtcgacgccctccagaccaacctcaccgaaggttggtccgacgatgtcggtcgctgggagagctgcgccaacaagaaggcgacctgcgcaaacgactacgcgatcgagagcataaacctggcgtgcaactacgcatacaaagatgtggtgcagaacattactctgggagatgattattacctcacccggtacccggttgtggagaagagactggcacaggccggcgtcagactcgccttgatactcaacaggatatttgacaagaagaaagcagatgctatgccgttgtacatacagtaaaatagctatacttgtacaaacatagatatactgatgactggaaggtattattgtagctaccgcaccacgccagtttgatcaattgccgcttcaataggtgatatgtaataagaatcaaacaaccttggcacaccattcagaaattcaactgttgtaaagttccataatatactactccctccgtttcacaatgtagtg

SEQ ID NO: 52 - DNA, 3271 bp, Hordeum vulgare
ggccccttcttcctcctcccgctctcacccgctacacccccgccgctcaaaaccctaaccctagatcgtgagggcccgctgacatggccagcaagttcgggctcgccggcggaatcccggagcggcgggtgcggccgatctgggacgccgtcgactcgcgacagtacaaggccgcgctcaagctctgcacctcgctcctcgccaagcaccccacctcaccctacgccctcgctctcaaggctcttactttggaaaggatgggaaagcctgatgaagcactgactgtctgtttgaatgccaaggagctattgtactcgaataacattttccattttgacgatctcacccttagcacactacagatagtgtttcaaaggcttgagagattggaccttgcaacttcatgctatgagtatgcttgtacaaaataccctaataacttggaattaatgatggggctctttaattgctacgtcagagagtactcatatgtgaagcaacaacagacagcacttagaatgtacaaaactgtaggagaagaaaggtttttgttttgggctgtttgcagtattcaactgcaggcatattttagcagcggaggtgagaagttgttagcatttgctgaagcattgcttaaaaagcacataagttcacatagtttacatgagccagaagcactttctctctatgtttcaattctggaacaacaggcaaagtatgatgctgctttggaagttctatctggagacttggggtctcttatgggaagggaggaggacaagcttcgtttgcagggacaccttcttactcaagcgtgtaactatgtggctgcttctgagatatatcagaaggttcttgaatcttgtcctgatgactgggagtcctttctccattatttaggctgtctgctggagcgtgacgtgaagttgcctaaaccaaccactggtgaacatacttgttcgtcctgctctgtagattcgactatgttgagcaagacttctctcagtgaggagctggtcgaatctcgccttgcaagtgcattgttatttgtgcaaaagctacaaaaaaatgactccagtgactctgttagaggacctcatctagccaatattgaaattgaacggcaacaccgcctcagtggaaactcaactaagttcatggaagctttggtaaactatttccacagatttggtcacttgtcttgttcatcgtcagatgttgaaatatacctccacatgctatcgggtgatgaaataacggagttgctagatacaatttccagatcttttgatgcatcatcagtttcagtaaaagcactgggtttgacaataactacgtttaaggttcaagaacttttgggaactttattttcaaagtcaactacagatcttcaacgcattgcaaaaggaatggtcgagacattttacaaaaacctgtctctctcaagagacttagatcctcaggaaagcatccatggagaagaactgctgtctatggctagcagtattcttgtgcagcttttctggcgtacaaggaaattagggtacttacttgaagcagttttggtgctagagtttggattgactgttcgcaagcatgtttggcaatacaagatttctttggtgcatttgtactcttacttgggagctcttccgttagcacatcgatggtatgtaagcctggaagtcaaaaacattcttctagaatccgtctcacaccacatcttgccacagatgttgagttctcctttcttggaacaaacagccagtcttgtgaaggattatcttaggttcatggatgatcatttgaaagaatctgctgatcttacttgtcttgcatataggcaccgtacttactcaaaggtaattgaatttgtgcagttcaaaaatcgcttgcaatgctccatgcagtatcttgctgtaaaatctgattctgtaatactgagcctgaagcagaagtcggagtctcttgaggaagtggagtccgttcttgaaaatgtgaatcacggaggaggcttggttgatctatcaaatgaagacaacatgaaacatttaacttttaatgaagatctcgaggcacgcccttggtggacaccaaccaccagtgtaaattttctttcagaaccaattgatgaaagttcaacacctgcgtgctttagggccaaagtgtgcaagcacaaatctactgagaaggatggccctaagatgggagatgctgagagaaaatgtcttgtcccccggcttgtttatctttccatgcgtggttgtgtatcttccctcagggagactgagcacaacgggtctgtttctgatatcactgttggggaaatgaaaaccttacttgagaaatatgctaggactattggttattctatggatgatgctctaagcatgattcttggtatatcttcaggcaagaagtctatgaaggattttgctcctgatattgtgagctggatgagtttcgctgtatttattaatgcgatgaacctgtggtcaaatgaatcagtgatccccagaactgaaccgagcagcccaagttcttgggagattgtggacagcttggtgaaactttgcatagaggagcacctgactgatgccaatcgaatcctgacttgtcctggaaataaaattccactgttagtgcagatggttacggagcccatttcttggcatctcatcataattcagtcctgcacgagagtggtggctccgcaaggaaagaagaaaaagaaaagcggcccatcgctgcgaacaaacatgcctcagttgcaaggaattcaaagatctgttcagtgcttgattgaaacgctccaaagtgtccaaaaatggctatctgatcagatgagtccagaggagcaaggtttggatatcttgctgtcatatttccaaggaactggcgatgaaggtccaggacagacattccgagtcttggaagagaaaccagcagcacatgcctctgagcttggtgatcgaattgctcagtctctggaagcatggagttctactagtgtggtaagaagaattgttggagcagaacatgaggtgctagccgagttcaagaaaatggtcgactctaaactaaagctgctcatgtcagaatcggcttctctatcttcggtgttgcactagagttgatgaaattttgcacatgaattttgttctattcttgttgtggtgttccattatacatatgttgtaacagtataacagaatggtgttgcactagagctgttcgttgtttgacttgcttttatttgattgatgacatc

SEQ ID NO: 53 - DNA, 1828 bp, Hordeum vulgare
ctagtaacggccgccagtgtgctggaattcgcccttggacactgacatggactgaaggagtagaaactcccccgatccccacgcgatctcgcctgccaccgccgccgccgccgccgccgccatggctttctcggcgcgaaggagcctcgccaccggcctctccagccacctcacccgccgcctccacccctcgctctcccacctcctcccttcctcccaccacgacaacaaccacgagaaccccacctcctccgcgcccccgtttcccacccagcaaaccccgcactttccctccggcgacctccgtcggcgcgcgagatcccagggcctggccctcccgctccccttcggcgcgcacctcgcggcccaccgcggcttctccacctccggatcctcccccgggccgcagatcgatggtatcctcaccgaccccgtcgctggccagatggacgtcgcggctggcgtcctctccgacgccgcggcctctgtcgcgcccgcctttccgttgccgttcccgggggaagtggccgccgccgccgcagactcgtttcccccggtcgccgccttgcagtacctcatcgacgccgtccattcgttcaccgggctcaactggtgggcttctattgcggtgacgaccatcttgatccgaacggtgacgatcccgctgctcgtgaaccagccgaagtccacgatgaagttgaatgcaataagaccagaaattgaggcaatcaacatggagatgcaaaattcaatggatccacaatcaatgttagaggggaagaagaaattgggcgagctattcacgaagcgcggtgttaatccattgacacccttgaagggtctattcatccaagggcctatattcatgagctttttctttgctatacaaaacatggtggagaaagtcccttctttgaaaggaggtggagcatattggtttactgatttgacaactcctgacgaactttatatcctcccagtgttgacatcggcgacattcttggctacggtggagctcaacatacaagaaggcatggagggaaatcctatgctgcaaacaatgaagaagttctctagaatattggctcttatgactataccatttacaatgcactttcccaaggcaattttctgttactgggtgaccgcaaacttgttttctcttgggtatggttttgctctccggaagacagccgtgaggtatttcttgaatcttcctgagatagtaccacagcccgcacctgcggaagtgtcgaccttcaaccttttcaaggcaccaaagccagtgtcagcagtcaatacacccaccggggacaacggtgattcatccaccgtagtcaacagtgattcaaccaccgcagtcaacgggtcagagcagtctaatgctgagctaagcgaccgggttgtgtttcttgagaagaagattgcagaacttgagaggcgggctaaagctagaggtgaatctcaggaggaataaactaacaagtaagtttctgaccgagcacgcgaaatccaaagaagcactaggtattgcgtttgtaacccgcgtctggtggccataaagggatatcttgcgcgggcaaatcgatatagtaccaagatttgacttggactagccaattttgtgagcatgtgttgcaaatgctgtttcgggcgaataaaccgtaggtatcctggcagttaaaatcgccagaatgtttgttggattaagcttagtgatgctggctgagaagaaaccagagggtggttattattattgtaccacttgacatttgaaaatcgaattatgtaatagtattaacttttagtttgcgatcaagataaaacg

SEQ ID NO: 54 - DNA, 1499 bp, Hordeum vulgare
ggcagcaccacctacctcaccgcggccgcatgtgggccgcctccccggccttccgcaggcagctcttcctgctccgctctctcgcgcccacctgcgtagacggcggccgcgtctcctcgagctctcttcggctccacgcgatgtccgcggcaccggcggcggccgggccggtgtacgaggcggacgcggaggcggtggtccggcgaatcacgccgccgctcgaccgcgcaaggcacaagggtcaggcagggaagattgcaataattggtggatgtcgcgagtacactggtgctccttattttgctgctatctctgcgttgaaagttggtgcagatctctcacatgttttctgcacaaaagatgctgcaacagtaatcaagagctatagccctgagctgattgtgcatccaatattagaggagtcctacagtgtaagggatgatgaaagagaatctgtttcttctagcattctcactgaagttataaagtggatggagcgctttgattgcattgttgttggccccggccttggaagggactcatttcttatggattgtgtcagtaatatcatgaggcatgcacgacaggctaatatcccaactgttgttgatggggatggccttttccttataaccaataacattggtcttgttgaagataactctcttgccatcttaacaccaaatgtatacgagtacaagcgtcttgtccagaaggttcttaactgtgaagtaaacgaggaaaatgcttctgagcaactgactgcactttgcgaaaaaattggtggcgtaaccatcatgaggaaaggaaaagcagatctgattagtgatggtaaaaaagtcacacaagtgagtacctttggttctccaaggcgatgtggtggtcaaggcgacattctctctggaagcgtggcagtattttcatcatgggcatggcactttctctcgtcaaatgagcaacctaaagagaatagtgtgaatcctatggttcttggctgcatagccgggtctctgttgctcagaaaagctgcggcgcttgcattcgagaagaacaagagatcgaccgtcactactgacatcattgagttcttgggccaaagcttggaagatatctgccctgctgggcggtagtttattgtgggtttcttaccataatactggaactgcgcctccgcactctacaataataccgatcctgttatcaggatgtatcatcaccgtgtttatgtacatatatctctagtaaaagaaggggatgctacaatgcttggataatatgctgtgttgtgtgtcgctgctgtccagaaatcctcagggaattgaaatatagtagaagcggttgcggcaggcgcaccgcttttccgttctctttgtcagatttattttctttggctttgtgcacggatcgacatacgaacaggcacaccacagtaacacatggttggagaacaatcttgcaatgacagcaatagcttgtctatatgaacgtctgacgtgagt

SEQ ID NO: 55 - DNA, 728 bp, Hordeum vulgare
cggcacgaggaggacacccacacaagaacaaacacacaccagcagaagaagcttttcttccaaggagctagcgagcggcgaggatgcagacggcgaaggtgaaggtgaaggacgcggtgagctcggccaaggagaaggccaaggaaggcacggccaaggcgcagggcaagacgggcaaggccacggcgaccacgcacggcgagaaggagatggccaaggaggagacgcgggccaacaaggcccaggccaaggccgagatgcaccaggagaaggcggagcaccgcgccgacgccgccgcggggcgccacggcacggcgcacaccggcccgcacggccaccatcgcccggcggccgccgcgcccgccgaccccgcgtacacgggcaccggcgcgggcgcgtacccgaccacggacaagtacgtctagacgttgagatgatccggggatcagaaggagctagcagatcaagtagtgttttttgttgttgtggctagtgatcctgcccgtctgccgtagttggcgcgcgcgtgtatgctgtgcgcatatgcgtgtgccggaataaaatgtatcggtcagttgtaaaatgcaccttttattatgttgtagtttgtgactttcgagtatttacaaccggaccttttaaaaaaaaagaaacaggtattacttaactagtttttatttggaccgaagactttttgggatcacatcaaaccgtttttactatattag

SEQ ID NO: 56 - DNA, 1993 bp, Hordeum vulgare
cggcacgaggggcgaaacggcgcgaccccaccggtgggtttagtagggtttggactcgccgctcggctcggctcggctccgctcccatggaggcggcggaagatgccggcggcgcccgctccacggcccggaagctggtgccgtggtcgagctgggcggagtggcgcctcgtccgcgacgccatcttctccccctaccctgaccctggcgccgctcttcgcaggatagcggcgtggcggagcaggggatgcctccccatccccgtggaggtcaccgcggccctcttcgagataaggctgcgggatcccttcttccggaatggagtggcttcggatgataagctggagtcagacgagatgctcgccttgctgtacagcatggcaatcatcaggcttgtaaatggttttatggagagcccgcacaaggaaactggtcgttcaatatctgatttagctgagactgttggagtaccacgaattctcgttgacattcgtcatgaaagttcacatcgcggcatcccctctctgcgactgctacatttggcagccattaaggcatttgattggttgaagtgtaattactgggattcccagactagtgcaattcctgatgttcgactagaactaagctcagtattgcatgatattgctcaattcctgaagggaaaagattctgaaaatgcaaaatcaggttccaaaaggaaacgttcccaaaaacatattttaaatgccataaaatatgtacgtcgactttactacacatgtccctctgaggctatctctgttcttttggagttctttcagctcgatgccccagaaatctctgacagcgatgtacatcaagctgatagtttggatggaaatccctcatctgatgttcaaagtcagaatcaaatatcaaatggagatatgaaaaccataataacaaaaccatcagaaaaagaaccaagagtgcttcttggcttactaaagtcaataattgaaatgattgaggccaggaatgaccttgaacacaaaggtggatcatatgcatccctgccagctgagtcaccaacaatgaaaagcttgtgctccctcgttctatggattgtcgcaagcataaaagagttaaaggattccggccgtattggacttgtccacgagataggagtactctctccagacaagaacgctgtccctcgtttctgtctcgcaaaacttctgcagaagttcttgactttgcccgttataggtgaaagatgcattgcagatgcagcactattgctgattgagatggccagcaataataacgtgaaggagaaactgaggaagcttcctttgttgtccctgcgaaggtcacccaaagattgtaccctcattgaatccagaatcttgtccaatggacaagaatcggttgaaagcgcaacacagaagctggaagcgttcaagttgcagctgaggaaaccagataatgcgagtatagctgaaaacggcaccgagggtactttcaacacaagcgtgccagagaaacgtaataggtggtctgtagcgaagtcctggaccccctgtccgttaggcatgataccttgttcatatagttcaactgctgttcttcctgtccttgatatcattgatgatgaactggagcatgacacagctgaacatggaaattttgaggatgatggtcagattgaaattgctgaccccgagaagcagttggatgatgaaggctttctagaaatatcaagatcgccacctgaacatgggatttctgttatgccagaactgatccatggtctcaagggtacattactggttggtggcgtgtggaaaaaggtgactgaagaagagttgctctccataaagtcaagcatgaaaattttgttgtgatattggctagttattctcgcccctctgcagtaaaatatttttcttctgtaatcgatcgaatggtagctttttcttggggtatgagaaaaccctctttaatcagctctgctcagttccttcacaat

SEQ ID NO: 57 - DNA, 2106 bp, Hordeum vulgare
agcatagtcgggctcgctcgtcagttctagcctcccagtcccagtcctctgaaccagggggattagttagggtttaacgagccgcagcgaccaccatgacggccgcagacgcggcggcggagtcggacgcggaggccaggagcatcctcgagcgggccgcggcggcatccttcccgccgctccacgccgtccaccacctcctctccgtcggggtttgtgtgcgatgcatctttcgcatgtttggagcctttagccatgcctgctcatgtgcgtctcttacggtgtccgtcttgcattcgtttcttgaagagcatgatgattccgcaaaaggcgggtcttgctcatgtttgtcaatggatgaagcatgctgctctatttgctttggaatattgctacccacctgccatcaggatgagggtgtagcaccgtttgaagacatttctcgtattgacataattacttcaatggtgtctcaagcaatacaaagagagggttatcaaatcggtgagttctctacagaaatttcagtgcctgcagttgtagcagcgaatgaacgtgccatcaggttatatatgaaaggaaaatatggcagtgaaaattggttcaaggacgaaatatttactcaacaaaccatgtcggtgaaggaggctctgagactattgatagtaccatcgctcgagaaacaactgggtgttaagcatagtaacaattcatttcgaattcgcttaacatatacccatgatgatgcttcactgaagctcaaaagtttattgccaaatgacagtaatcgcaaaaggaaagcagagtcaagagaaggaaatgatactagaaggaactcaacgtatgatgataaacagatattaactgaaacagatacattcatccacaagagtctcgagggtattcaagatcaagaattctgtactttatttaagctgcctcctgaaaaggtgttaaaaccttgccaacttgtgatatccttcctaaggtcacccatatatattggtggaagatacttgaagctttccagaaatgtcagtcagtcatgttggataattgatgatgaaagaatgggggaagcatcagttgaggaaataattaaagagaatgtctgtgccatctccagtggcgatggctacaagttccatgctgctggaagggaagatatcgatgtacggatgcttggatctggtcgtccatttctaattgaagtcttgaatgtgcgatcaattccgactgcgattgaaattcaacaaatctctgacaagatcaatagctccgaaaagaaatatgtcagagttagaaatctcaagttggtagacaatgaaatatgggccatgatgcgtgaaggagaatcggagaggcagaagcagtatgctgccctcatatggacttctaatcctctgacggatgatgacctgcagaaaatttctgttgttaaggatatggaaattgcgcagaataccccagtaagggttcttcatcgaagaagcccgttggagcggaaacggattatacattggatggagattgagaaagttgaaggcagctcaaactattacttgctgcatctatgcactcaggcaggaacatacattaaggagtttgtgcatggtgatcttggacgcacaaatccaagtatcggttccatgctacgttgcagagccgagatattgcagctcgatgtcaccgacgtaaagatggacttgctgcaataatatgctgctgccacgtgataccgttccgggcaagtattattggtagaggaggcgtgctgataagccaaggttcctgcagaagacgtatgccgatggcaagtgtgctaagaaggacgaatcgatttccttttcaatcgagcgcgtaacttgatgtcaatttgagaatgtacaccagccaggggcagccagcagcaatttcgagaaactggggtgaatttgggccccatttcgggtccaatgttttcccttctcccagagcaacaatttagagaaaagttgagaaattgaaccatctgttgtgtcgctttgtgttgttgtgctgctaaacaacattcattgagcagcatcacgcggatgatagaacaaagagaaaaaaagttgatttgga

SEQ ID NO: 58 - DNA, 1678 bp, Hordeum vulgare
atttcccgcctctccgacgggctcccggcagagagaaaccgccaaatcctccaaaatatgccgccctcccgggagcagcccgccgccgccgatggcggcatcgaggagaatgcgatggccatcctcgacaccttcggcatcaaggattcccgtgacctccacgacgaccgagccgcttttttggaggccgtgcgctctgccggcctggctggcgacaaaccctcgtcccccactcggagaatgtacgatgctgtctttcagattcttcaaagcagcacctctttggagctaaccattgcaagtttccatctcttaatggagctgggcaagcaatatccaagagtatatttgacaaattctggttcccgtcaagctctagttacagttaacgagtcatggtcaccatttctccttggcaataatgtagcttctggtgagattgggagaaacaccagtcgctcagatcacctctttgattctttgagattttctttgttgaccgaggccatggttgaagcatcgaatgccacaggtgctcataatgggcttaagcatatagagaacatggtgctgttccaatatctcgtttgcacacttgaggctgattttgtacctcgtcatattgcatataaagagtcattagactgggtgattatcagggaatctgttttaaatgtgcttctgggatcgcgaaaactggtattcaaaatgtttgtcaagaactgcatatcccttctgaaccaacaccagcgggaagtcgaagatgacgtatcttataaatcagcatctgatttagattcttccttaaccttttcatcgcttgagtttgaaagagaggcgctcacatctgtgaaaaaacttttcattatggttataaaccttgacttgattaggaaagaagcagataaattgggcctgacttcaagagctgatggtctcaggaatcctatcctggaagttattctagaggagctaacttataaccaaatctacttatccccatttcttttggccttcacggagtggaagtggaaattgcagattatcctgcagtacttctcaagatatcaagttaagcctgcagtccgtactcggaggtcagataattctcaacaagatttgacagtggaaagtgctctgagtatgttttcaacagaagcaagcgcaaaggccatggttaagatgatgtgtccagaagttgctcagcttctcttagcacatgcataccaggtctgcctatcccttgatggtgattctagcaaagctaatgatgcagcaaaaatgatgggagcgtctcttctcgagatatcttgcaagtttgtgtccgctttccagaatctgagaaaaatcaacacgagcattcagatttcacagtttgagaaagaagctttgttcactgcagcaacgctgacaagtaaactgcagaacgagtgaagattggagacttggaagtattcattttagattttgaagacttggaagcgatgggatcaaatggtttatcttaagagaacgatagtatctgtctcatctattgtacgacaaaatatgttacctgtgtatatatatgttttggcatctgggttgctcatctcagggtggatatcaaattcactagtttaccgttcggcaaatgtactaaaggcgtgatgtagttggtaaccaagaaaatcagcag

SEQ ID NO: 59 - DNA, 3701 bp, Hordeum vulgare
ccaacgccggccatccccaccgcctccggccgccgccgcacaactccatctcccaaagcagaagaagatacaaaaaaccgcgggcgccggagcgaggctggccgccgaacaaggctgcgaaccgcgcagcggagtcgagggttctggagagcggagggcggctctaaaaccctaaccccctccggatccgcgccgcgccggcccatggaggtggacccgtcgccgtcccctccgccaatgtcgacgccgggctacttcgacccggactcctcccgcctccgcgaggagtaccgccgctacagaaagagactatcttcttcaaatgactccccaatgttggggacctcagtctccagattctcagaagcaaggtcgttgcatgatggaagcagcatacctaggcggcccaatgctggtctactacttgaagacgtcaagcaggaggctgctgattattccgacattgatggcttgaatggaccgaaactgttcggatcagcaaaaaggacatcgctgaatggtggttcaggtaggagggcggcaagatcagcgttgaatctggtcaagctggaggacgatatgccaagggaaggagaaacaacttctacaacgtttgcatcccttcttgattcagcgatacaaggattgatgcccttcccagacgtgattttacaatttgagaggacatgtagaaacgcttcagagtcactaaggtatgccgccacaggaaacattcggatggcggaggacaaacttatgcaacaaaaagcgaaactattactggatgaagctgcttcttggtcccttctttggtacctctatgggaaagcaaatgaagagcttcctgaaggactattcatgtcaccaactacatcccatcaggaggcttgccgctatgttgcaacggatcttacagcacaattgtgtctgcggattgtactttggcttgaaggacttgcttctgaaagtcttgatttggagaaaaaggtgagaggatctcatgttggttcatatctaccaagttctggtgtttggcatcgtacacagaggcacctaaagagaaggaataatgattctaatatagtgaagcatggggatttcgatgctccaactcgtgaagtagcccaacttcttcctgatgaccagaagcaagatgaattgcttttagaagatatctggactctcttaagagctggaagactagaagaggcatgtgaattgtgccgatctgctggacagtcatggagagctgccactctttgccccttcggtggcgtagacctgtttccttccctggaggccatgctcaagaatggaaatgctagaacactacaagcaattgaactggaaagtggtattggacggcagtggcgtctttggaaatgggcatcctattgtgcttcagagaaaattgctgaacacgatggtggccagtatgagatggctgtatatgctttacagtgcagtaacttgaagcgtaccttgccaatctgtactgaatgggagtcagcttgctgggcaatggctaaatcctggctagatgttaaagtggatatagaattatctcgatatcaaaccagcagaccagaagagaaagagtttgatgatgatatgaatgggacccagcttggcccagaaaattggccatatcatgttcttgatcagcaacctcgtgatatagctgcacttctgcagaaactccactcaagtgaccttgtacatgaaactgtttctcgagcatgtcgggagcagcatcgacaaattgagatgaatctcatgagtggaaatttagctcatcttcttgaccttctatggtcatggttgtcttccatcgaagagggtcaaaatgtctcgaggtcccgtgatgattccgacatgatacgtttcggggcacatattgttcttgttttgagataccttctcagcaatgaaatggaagatgagtttgaggaaaagctggttactgtcggtgatctcatcatcaacatgtacgtgaggtacttgttttcagaggggcaggaagagttggttggagtatatgcctctcagcttgaccgtgatgtttgcattgatttgtttgtggacatgatggaactaaggttaaatagcagcttgcataccatgtacaagcttttcctctctgctgtggagtatctgccattctcctctggagatgcgtccaaggcttgttttgaagagatacttgagagggttctttcaaggtctcgagaaataaaactccatcagtacaatgaagatttttctgatgtcgcggaacagcatcacctgcaagcacttcagaaggcaatgatcattcagtggctttgcttcacaccaccatcctcaattccaggctttgagatgatcacagggaaacttctgatacgggcattgatgcatagcaacacactattcagagagttttccttaatatcaatgaggagagtccctgacctaccagtaggaccacataagttgcttgccatccttgctgaaccattgaaacaaaaggaaaatttattttcgctggaagatcaagaggtttctgataacttagaagagtttgaagattggcacgaatattactccctggatgcaacataccggggttggcttagatgtgagatggagaattattccgtcccccctgaaatgctttcggcagaagaaaaggatcaagctgttgctgcagcgacacaaactctggagttagcattcttgttattagaaagggaagagagaccatggttaaatgctatcgagacaagcccatttgagtcgtcagagcttgttttccttgagttgcatgcaacagcaatactctgtctaccttctggggaatgcatgacaccagatgcaacatcatgcacggctctgactagtgcactttattcaactgtcagcgaaggggatgtgctgcatcggcagctgaaggtggaagttaaggtctcgtctaaagatccttgctgtattgaagttgcgctccgttgcttagcaacagaaggtgatggatttgggcttcatgaagccaatgatggagctcttcttgctgcaattatggctgccggctttaaaggtgaactcaatcgttttcaacctggagtttcaatggaaatttcacgacttgatgcttggtattctgattgtcatggttcggttgaaagtactgctgcttatatcattcgagggctttgccgaagatgctgcctgccagaaacaattctacgatccatgcaggcatccatctccctttccgaagctggcgattctctagtccattgtgataaacttatcgagttagttgcttcatcagattttgggatgatgcacttgttcagccagcagcagttacaggagttcctgatttttgagagggagtgcttcatatgtaaaatggagcttgaggaagagcagatgcctgctgatggctaagccactcatggtttaaattatcagtttattgaagcctgaatctcttccacggtcttgccttttgtctctggcacgtccttcacaatgaacagaatagccagggcacagaggcatagaagcatgttccagcaagatctcaaggcgaaggagaagaatgttcctgctggatttgcatatcagtgagatgtccctggatgattcatgtattagacaaaaacgataggggtccgatgtagattcggcaacggcggaatgtctgcgtccaatcc

SEQ ID NO: 60 - DNA, 2134 bp, Hordeum vulgare
ctcgaaatggccggatagctcctctcgcgcaaagcttttcgtctccgtcccctgcccaactactcctccacctcgatcgagagaagctcggatccgcggaggagaggagaggtgcccacgagctatcggttgcgccgcggcgatgggtagcctgcgaggcggagagggaaggaacgaggacggagggaaagtcgggctaccggcgctggaggtggcgctcgcgttcccgcaggccacgccggcgtccctgttcccgcccgccgtgtcggactactaccagcttgatgatttgctgaccgatgaagagaaggcgcttaggaagaaagtccgtgctatttcagagaaagaaattgcacccattatgaccgaatactgggagaaggcagaattcccatttcatgccattccgaaacttgcaactcttggcttagctggaagtacaacgaagggatatgggtgcccaggactctcgcttacagcgagtgccgtttctatagcagaagttgcacgggttgatgcaagctgctccacatttattttagtgcactcctctttggcaatgtccacaattgctctttgtggatcagaggctcaaaagcagaagtacctaccatcgttagctcagtttaaaactgttggttgctgggctttaacagagccagattatggaagtgatgcaagctccttgaaaacttcagcaaccaaggtacctggcggttggcaattagatggccaaaagcgctggataggtaacagcacgtttgcagatgtgcttgtaattttagctaggaatgcagacacaaagcaactaaatggattcattgtgaagaagggagcgcctggtttgagagccacaaaaattcaaaacaaaattgggcttagaatggttcagaatggcgatatccttctgaataaagtatttgtcccagaagaagacagattaacaggcatcaactcatttcaggatataagcaaggtcctagcaatgtcacgtattatggttgcttggcagccaattggcatatcgatgggcgtctacgacatgtgccatcggtatttgaaagaaaggaagcagtttggagctcccctggcagcctttcagatcaaccaagaaaagcttgttcggatgcttggtaacatccaggccatgcttcttgtcggctggcgcttgtgcaagctctatgagtcaggcaaaatgacaccaggccatgctagtttgggcaaggcatggacgtccagcaagtcaagggaggtagtttctctgggtcgagagctattgggcggcaatggaattttggctgattttctagtagcaaaggcgttctgtgatctggagccgatttactcatacgagggcacctatgacatcaacagccttgtgaccggaagagaaatcactgggatcgcgagcttcaaacccgctgcagtagcaaaatctcggctgtaattcttcttctgcctccagctacgatgaacagcaaagtatgaccccccaccttgtattctggtgggtacgagtaagatcggaataagtgcaatggaatgatcaaatgtaatttgtaaggcggaaggataaagtcggagctggatttgtatctatgtaatggtgcagcatatggagtcacatctcacgatcagtatttgtgcactggggggtcgtacagcttctacatattgaaattgtgcagttcaggagaattttcccatgagacttacctgtgagatgagatgggtgcggatcatgtgccattttttggttgagaaaatatgttatgaccggtacaacgtaccaacggaggaggcccaatgggcagggttaattacgggcttagcccaagttatcttacctatcttagagtccaagttatattagagtccaagttatctagggtttagtggaggctgtcctcctatataaacacatgtaccccttcgatattaagcagacaataaacagtatattctgttgtcgtctccctcaggagacgagagccccaaaccctagccgcctctctctctctctctcacgccgcgacggcgcccaaccgccggcgccggcgtccccaacctcgcagcccgcacttccacccctacaacctacgtccgagacctggtagaaccctagcctctacca

SEQ ID NO: 61 - DNA, 3060 bp, Hordeum vulgare
aaacatcaccaacaaacctgcaggcgctccaactcctgccaccgccaccgccaccgccaactccctccgcgccgcctctgacgggtcgccgcagctgcggagcgcgcgctagagggagagatggggggcggcaggaagcgcgggcgctcgcagcgtcgtcacttcaagcaggagcgcgagaacgtctggaaggacaaccccaggcgccctcccgcctccgccggcgaaggaggcgagggcaacggctggcagcccttcgccacggagaacctggccttcgaggcttactacaaggggcagcaaattgttcctgaggaagagtgggatgccttcatgagcatgctccggaagccattgccagccgcttttaggattaatgcgagctgtcagttttttaaagacatttgttcacaattagaaaatgacttcaggaagtcgttagagactgaggtcagtgatgaccatgaaaaagaggctattcggcctttgccttggtaccctggcaatcttgcatggcatttgaacttttctcggatgcaactgaggagaaaccaggcacttgagagtttccatgaattcttgaagcaagagaatgaagttggtaatattaccaggcaggaggctgtcagcatggtcccacctttgtttctgaacgtgcaacctgaccatcatattcttgacatgtgtgccgctccagggtctaaaactttccagttacttgagatgatccaccagtcaacaaagcctggagtgcttccaactgccatggtggtagctaatgatgtcgatgtgcaaagatgtaaccttcttattcatcagacgaagagaatgtgcacagccaacctggtagtgacaaatcatgaagcacaaaattttcctggctgtagtgttgcaaagttctgtccagaagcatgcgtagacgagtccaagctgcagaggttggaatttgatcgtatactgtgtgatgtgccctgtagtggtgatggaactgtccgtaaggctcctgatatgtggagaacatggaatattggcatgggtaatggacttcatcgtctccaagtggaaatagctatgcgtggcattgcattgcttaaagtgggcggaaggatggtctactcaacatgctcaatgaatcctgttgaaaatgaagctgttgttggtgagattctgcggagatgtggggattctgttgaactccttgatgtttctaatgagctacctgaattgatccgccgtcctggacttaggacctggaaggtacgggatagagcgtcttggttgggcagtcataaagatgtacttcactacaggaagaatgtgatattgccaagtatgttcccctcaggtaaaggtagcatggatagctgtacggcgggtggcagtgttgaggtcagcatagatgcagttgatgcagatatgaatgagtcaggggatatggtagagggaaaacaagaaacgaaaatagcaattgatgacagcaagaacggcgacaatgccaatactgaagagataaaacaaggtgaatctgagtctgttaaactttcaaggggctcagatgagaaaacagattcagcctccattgttacagagcattcaaatttaccgctacatcgttgcatgagaattattcctcatgaccaaaacagtggagcattttttatagcagtccttcagaaactctctccgctgaatgagagtcaggtggtagaagcgatgaaaggtgagcgcagtacctcgaaagacaagactttaaaatgttctaatggtcaggggtcagataaggtgccggctgaagaaatttcagttcagcagccaggggttgatgacagccatgatctcgttgagcaacaaaacagagacatggatactgaaatttcaaaagataaaagctctgaggaagctaaggtgattgctagtgaggtgcaaaatgatcaagcgacaaggagggataagagaaagacccagaaccaaggcagatggagaggggttgatcctgtgatatttttcaaagacgaagcgacaatcagaagcataatatcctactatggcatcaaggattcttttacccttgaaggccatcttgtgactaggaaccctgatactaatcatgttaaaagaatatactatgtctcaaaatcagttaaagaagttttggacctcaatgtgaaagttggcgagcggctgaaaatcacctcacttggcttaaagatatttgaaaggcagtcgtcaaaggagggttcgccatgcacatttaggttgtcatccgagggattgcctctgctgcttccttacatcaccaaacagattctatatgcatctgcaatagactttcagcacctcttacagtacagaatcattaaattccctgattttgtggatgcaaaattcggtgagcaagctgcagctttgctacaaggttgctgcgtcgtaatattacgtgaagggcatgaggatctagagtccataggcatggatccctctgcaatcgccattgtttgttggaaaggaaagaccaatctgtgcgtcatggtcactcccatggatgggagggagctgcttgaaaggatctcatttcgtttcgggctcaaaatcccaaaaatcgacgatgggaagcccgacctgaagagtgatgatggatcagacgagcagcctgatggtggcgccgagacggttgatccagaatgcgtgcctgagagcaaagcaccagaagacatggatatcacagacgtcaaggacgctgagtagctcggtttgacaccatgcgaggaagcatgtcatgtctggttatgatgatgcatcagagccccgctacctggcttacgagttgatggttgctatagtgggagagttgttgccattccttggttcttcctgtagtaattctatcctattcctttgccatgaaaaccacaccgcatacatggtgccagactgctagctgctgctcccgtgtaacgtactatcagtttgtttttggtgtgatgttggcacacgactgtcgaacggaactgggaacatgaatgcggagaattctaatttgttttgagatattttgattga

SEQ ID NO: 62 - DNA, 929 bp, Hordeum vulgare
tcggcaaagtccccaagtgtaacacgcacgcgagcacaaaaccgcacaaatatgtcgacggtggaggaggaggagctgtccgagtgcgaggtgctgtggccggagacgcgccacggagctccggggagcccgtatgggccatcgacggcggctcccggaggagcctccagggatcaccgccggcagcgctctgcgcccgtggacattcccaggcccgcccacctgccccgcgggcgcgccgacctggacgacgaggaggaggaggaggagcacgacggcgccatggtgccgccgcacctgatggtgtcgcgcaggtggtcggaggggaaggcggcggcgttctcgctgcggtcggggcccgggcgggcgcaccgggacctcagccacctgcgcaactccgtgctgcggatgaccggcttcatcgaagggtgacagtgacagagaaggcgggcccgccgtcgtctgtgcatacgtgcgagcgaggaaagtagacggtggcaccacgcgtcttcgccacggtgttgggctgttggtcagtcaattttgttgggctcatcttccccgtggctgccagtcgaaatgatcagtctcccttgggttggttcatggaaatcggccggtagcgagtttaggattatttttctcggaatggaataaactactgtgagagacttcagaattgagatcgagcagattgaactccccctgacaaagccgctcttggagcgtgacgcctctctatgcttcccatgggttgatactaaaatacactaaaagacaaaccgttggataggggcttcattaggaacgttcctgttttgcaaaacccataatgcgttgaagtgaatatcatattcggcgagtttggtaggaaagaacacggccgtaatcaaagtgactgcatctgcaggagtaccctgaaatttaat

SEQ ID NO: 63 - DNA, 1450 bp, Hordeum vulgare
ccttccccgagcatcgaccatgtcggcctactgcggaaagtacaaggatgagctcatcaagaacgctgcctacattggcacccctggcaagggtatcctcgctgccgatgagtccacgggcaccatcggcaagcgcttcgccagcatcaatgttgagaatgttgaggacaaccgtcgcgccctccgtgagctcctcttctgcacccctggtgcccttcagtacctcagcggtgtgatcctctttgaggagaccctgtaccagagcaccaagggtggcaagccgttcgttgacatcctcaaggagggcaatgtcctcccaggcatcaaggtggacaagggtaccgtcgagctcgctggaaccaacggtgagaccaccacccagggctttgatgaccttggcaagcgctgcgccaagtactacgaggctggtgcccgctttgccaagtggcgtgccgttctcaagattggcccaaccgagccatcacagctttctatcaaccagaatgctcagggtctggctcgttatgccatcatctgccaggagaacggtctggtgcccattgtcgagcctgagatccttgttgatggacctcatgacattgaccgctgtgcttacgtcactgagatggtccttgctgcctgctacaaggccctcaacgaccagcatgtcctccttgagggtaccctcctgaagcccaacatggttacccctggttctgacgccaagaaggtgacccccgaggtcattgctgagtacaccgtccgcaccctccagaggactgtccctgctgctgtccctgccatcgtcttcctctccggtggacagagcgaggaggaggcaaccctgaacctgaatgccatgaacaagctccagaccaagaagccctggaacctttccttctccttcggacgtgccctccagcagagcaccctcaaggcctggtctggcaaggcggagaacgaggagaaggccaggaaggcgttcctggtgaggtgcaaggccaactccgaggccacccttggcacctacaagggtgatgccaccctcggcgagggtgcctctgagagcctccacgtcaaggactacaagtattgacctgccttcggtggtatggcccgtttgggcgtcctgcttaccagtattatcgtttggtttttcagagtcctgatatatagtatggaacctgtgctctcaaaataccataggtagtttgtttttggagtcgaatatcctgtttttggagttgaataccaagcggtaccgcatatcgtaaattggagcagcaggttttgttctatggtcctgtaatttggctgctacaatggcaaaacctgttatatctgctgagtagtgattacacatgtcttgagttgctctattttgattgtgttgtatcggctattttttcttccgttgctgcacttgcttaagcaatctttcagtttcctc

SEQ ID NO: 64 - DNA, 2087 bp, Hordeum vulgare
acgaaccttctcccctccaccaccgcggccaagaagaacctccgcgccaaccgccaccaagccgcccaccccaccccaccctcgccatggacatcggctcggtgccttccccggctgacgccgcggcggccccctccgcggccgccatgccgcgggaggccacgcaggggcaccacctcgcgcggcgcctggctgaggtgggcgcgcgcgacgtcttcaccgtgccgggggacttcaacctgacgctcctcgacgagctcgaggcggagcagccgtccggcggcggggtgcggctcgtcggctgcagcaacgagctcaacgccgcctacgccgccgacggctacgcccgcgcgcgcgccggcggggtcagcgcctgcgcggtcaccttcaccgtcggcgggctcagcgccatcaacgccgtcgccggcgccttcagcgagaacctccccgtcatctgcatcgtcgggggccccaacagcaacgactacggcagcaacaggatcctccaccacaccatcggcatccccgatttcacgcaggagctccgatgcttccagaacgtcacctgctaccaggcagtggtgaacaacttggaggatgcacatgaacagattgacactgcaatctccactgcactcaaggagagcaaacctgtttacatcagcatcagctgcaacctcccctcgatcccgcatcccacctttagccgccatcctgtccctttctttccctccccaaaactgtcaaaccagatgaacctggaagcagcagtggagactgctgcggcttttttgaacaaatcagtcaagcctgtccttgttggcggaccgaagatgagggtggccaaagcacgcaaagccttcctagagctggccgatgcatgcggttatccggtcgcagcgatgccttctgcaaaggggcttgtgccagagcaccaccccagattcatcggcacatactggggtgctgtgagcactccattctgtgctgagattgtggagtcagctgatgcatacttgtttgccggcccggtattcaacgaccacagctcggttgggtactcactgctactcaacaaggagaaggccatcatcgtccagccggaccgagtagtgatcgggaatgggcctgcatttgggtgtgttctgatgaaggacttcctgcatgcacttgcaacccggctcaagaagaacacagccgcctacgacaaacatagtcggatttttgtgcctcagggagaaccccgtccctctcagcatgaagagcctttgagagtgaatgtactcttcaaccatattcagaaaatgttgtctggcaacacagctgttatagcagagaccggggactcatggtttaactgccagaagctaaaactaccacaaggctgtgggtatgaatgtcagatgcaatatggatcaattggctggtcagtgggggctactctgggatatgcgcaggctgataaggataagcgagtcatttccctcattggagatggcagctttcaggtgacggcacaagaagtgtcgacgatgctccggtggggacagaacaacatcatcttcctcataaacaacggtggctacaccatcgaggtgaagatccatgacggtccttacaacatcatcaagaattggaactacacgggcttggtggaagcattccataacggcgagggaaaatgctatactgcaaaggttcgaacggaggaggaactgaaggaggcaattgaggcatccctgggacctaacaaggacagcctgtgctttatagaggtaattgtgcacatggatgacactagtaaggagcttcttgtgtggggagctaggcttttcgccgcaaataaccgcccgccgaatcctcagtgaacacaccaggtctctacaagatgctcatccagcttaatgaggtcatgtgaaagttcacatgtaccgaactctgaataaatcctccatttgagtttcactgttgtcgcaagtgctcatggttactgtacgtaggtgttctcagttcaggaactggtacttgtgtacctaaataaatctgaaaaagacgatgatgtggccagctaaagaagctcttggtct

SEQ ID NO: 65 - DNA, 809 bp, Hordeum vulgare
cagactcctagctctagctctctcttcgcctccgtgcaaatgggctcctcgcctgcgtcttcgccttcgccttcgccttcgccgccgatgcccatgatagggagggccggcaacctcaccgtcttcatcacgccgccgtcgccggccagcaacccgcgctcctcgcgcccgtccggctccccaacgccggacttctccacccctacctcccgcacgggcacggcaccgcctccgctgcaggagagcgctagcccgcccgcgccgccggtcaagttctcgccccccgcaccgcccgtgaaggtgtccccgcctcctgtgcaggtgcccccgccgcagtacggcaaggcttctgcggggggcaagcacgacggatcggcgttcggcttcttatgggacgccgtcgcgcgcgtgcaggaagcgcacgcgagcctggacgagtacgtcgccaactggttcggattggatcagtctaagtaccagtgggctctcaacgactactacgacaccaccggcaaggaagtggaatatggcaaagctgggaagccaaaggagcttactactactactaaagtgcagaaagtttagaagcaacttcgttccaggttgtatgtgtagtgaagtgaagttctatttgttagatcttgtcattggggcttcaagagtttttgcctctttacctgcctgatgaagtacgatctacatttgacacaaggggcacttggatcatagagagtctgatgttgttgttttttgttggctcctttcagggtctgctgtaatctgagacgcaaattgcgtatttgcagtgg

SEQ ID NO: 66 - DNA, 3618 bp, Hordeum vulgare
aagaaacatctaaaccctccttctccccccaaccgccgccgccgcggtgaactatcgcgatgtcgcccgctgccgccgcccccgcgccacgcgatgaccgcatccgcagcttcgaggacttcgcgagggtgcaccagttcctgctgattgcggccggcgtgccgccgtcgctgcatcggcggctgtaccgcaagctcgccgacgaggtgttcgacggcggggagagcttctccgtcgagccctgcgaggaagggaggcagcgccgcctcgtgctcgcctccggggcgcctcttgggagcgaggcggacgtcttcctcgtcgaccacgcgtggtccttccgcctctccgatgcgctcaagcagctacgtgaagtaccaggattggccgagagaatggcagctctaatgtgcgtggatctggataggagaattgaggtcgaagaggcagatgagcaagacagtgaaaagggtggtggtttggagcatgtcttgcaggttgtggagaaagaaaggattagaatccaggagtcgggaggtgattttgcagcatggctggagcttgaggagctcggaatcgatgatgatatgttagttgcactggatttatctgccaattttccgaatctggtagccctcaatctatggggggacaggctgcaggatccagaaaaagtaatgcgagaaatcggaaagtgtggaaggttaaaggcactttggttgaatgagaaccctatccttaaccaatgcactgagaaagatgttcttgatggtcttcctgaattggaaatctataattcacattttacaatgaaagctagagagtgggctttaggtttctgcggagatatgattggagcagaaaatccctgtttgtctgtgggaaacataccattggataatattgtgactcttgacctttctgataggtccatccacaaactacctgaggtgttctcctctagtaaactgtcatctctttcaaagttgaacatccgtggcaatcctttggaccaaatgtctggcgatgatctcttgaagttatttagtttgtttacacagttacaggagttggaggtagacattcctggccctcttggaaacagtgcaatttccattcttgaatctcttcccaatataactttgctgaatggtgtcaatgcgtcaagtatagttgagagcgctaagcatgtagtggactccgcacttaaaccacgtgttccagaatggtcacctgaagaatccctggctgaaagagttattggtgcaatgtggctgtatcttatgacctaccggcttgctgatgaagaaaagtttgatgaaacacccatttggtatgtcatggatgagttgggctcagccatgcgccatagtgatgatgctaactttagaatagctccttttttgttcatgccggaaggaaaattatcttctgctataagttacacaattctgtggcctatttgtgatgttcatactggagaagaatgtacccgagatttcttgtttggtattggcgaagacaaacaacgctcagctaggcttacagcttggttccacacaccagagaactattttattcaggaattcaggaagtaccgggagcagcttcaatcaactagtatttgtcctacaaaagagacgccctcaaccagaagtgtacgtccaagtgatggccgtccacttcgagtatttactgatataccccaagtagaggagttcttaacacgcccagaatttgttctcacaactgatccaaaggatgcagacatcatctgggcaggcatgcaaattgattctgaattaaagagttcactaggtctcacagaccaacagtacatgaatcagtttccttttgaggcttgtctggtcatgaagcaccacctagcggataccatccacagggtatggggctcacctgagtggcttcaacctacatataacctagagacccatttgtctcaactaattggtgaatactctgtgaagaaacgggatggtatggataacttatggatcatgaagccttggaatatggcaaggacaattgataccactgtcagtggtgatctatctgcaatcatcagacttatggagacgggtcccaagatatgccaaaagtatattgagtgccctgcgcttttccaaggaagaaagtttgatctccggtacattgttttggtccgcagtatatgccctttggatatacttctttgtgatgttttttgggtcaggttagcaaacaatcagtacactttggagaaaactagcctttttgagtacgagacccattttactgtgatgaattataatggaaggatgaaccatatgaatactccagagttcgtcaaggagtttgagaaggagcatcaagttaaatggctggagattcatgaaagcatacgtgatatgataaggcgtgtctttgagtcaacctcagctgtccatcctgagatgcagaactcattctgcagggccatttatggcgttgatgttatgcttgataatagattcaagccaaagattttggaggtgacatattgtccggactgcacgagggcgtgccaatatgacacacaagctctcgttggaagccagggccccatcaaaggcagtgattttttcaacacggtgtttggctgcctctttctcgacgacttgacgaatgtgtcaccactgtaatagtcttgtcgaaaagctgttgtaacaccaatgttcttgcaccttgagatggattagggatgttgtacgttcatgcatcaaggaactgacatccatgaaaggatagggcacccgtgaactctgaaatgatattgtgagtgaagcttaagatggaatttgcttgtgttgcttgataaatattgctgcttccgattctaatgttgcatgcttataagtttgaactatccaatgttacgtggtcaagtagcaataaactgcacaatgccatgtcatcgcaacactgccgctacatcagtgaatttcctgttctacaggttttaggtggattccaacaggagatatggaatttcagatagcaagtctgagcccatgattttcagcaagttttaaccacgacgttcaagagtgacttgaaaagaaaaccctccatcatcaaaagtatatgtgtctcattctccaaggcaatggtaacgtaacgtagccaatgcagccactcgcacccacagtaacttcaaagcatcatctgccaactcctcaaagcccaaggagcatacaatcatacgcacatgagccgtgactgctgaatgtactgatcgctgatcatacgttcgaggcgtagccatgggcgccacaaccaaccatgccgctcccatctctcgagccatcctttcgctcgtgacgatcatcttcttctccgccgtctgcagctccgacccggacctcctcgtcgactactgcgtcgccgacatgagggccgccgccggcgcgcaccggcacagctaccgctgccaccctcctccattctattttgttcccttgcgccaagcccagcgaggaagaagagaagggaactcgctcgcgctccgctgcagcagcgaaccccgcgccgcagcgaacccgatcgatggcctccgctgcggcgtcgcagcccgcggccccg

SEQ ID NO: 67 - DNA, 1262 bp, Hordeum vulgare
gcgttctcgtttcccatatcctacccgtttaccagccatagcctgcgggctagttgcgcaatggcggcgtgttccttcgcgctccgcctggggccgcgcttcgcggcgccaacggtggcgagtgcgacgaggggaggaggaggaggaggtggccgccctaccggcagccgagcgctggtgtcaaagaagccaaacaaggaccaccgtttgtggatcagaaaagattcggctgggtcagggaagaaggctctttgtcttgttaatactgtttcaaaactaccgaatgaaaaagaagctgtttatggtgcattggataggtggactgcttttgagcctgaatttcctattatagcagcagcaaaagctttggaaatgttgaaaaaacgaagaaaatggctacagattatccaggtaaccaagtggctgatgagtaaaggtcaggtgctgacatggacaacctacgatacactgctgttggctctttctatggatggaagagtagacgaggctgagtcaatttggaatactatcttacaaacttatacacgctcagtgcccaagaagttgttctctcggatgatccagatttacaacacgtgccatcttccggacaaagttttggagatatatgctgacatggaggaattgggcgtgcgtccagacgaggatacaacaagaaggatcggacgagcgtttgcaacttcaggccaggaagataagcagaagcctgtccttgaaaaatacttgaagaagtggaagtacatccatttcaatggcgaacgcgttcgggtacggagggcaggacctttggcctagtaaacgtcgtctgaatagcttggggcgaacaatgtgagtatcacctcgtctggacatatgcgattgctatcttcttccgaggtcctatgcgagcttgtcagatggaaggaagtgtcggagttgtaatgctctctagacaaatggatagtatcatagtacaggggtgagaaccggcattgctaatgatgttggtgcccaaacatgtgtaagttgtgatgtttcaaacaggttgccgccgacttcgataccatgtgtaggaacaaagtctgttaattttaaccgctacggcgtgtggcatgacaggcacagtcctgctcctgacaaatggtgcagttagagctacggcagtacccatcaaatgtctgcaagtcttttttgtgggtattctacaagatgaagtgtatggtatggtggatctgtcgactggtgcggcgatctaaaatatg

SEQ ID NO: 68 - DNA, 1100 bp, Hordeum vulgare
ataacatacgtacgtgcccaagcactcgaacgtgtagaaaacatgtcgaggcccctgtttggtgtaatggccgcggcggcgatcgtcgtcgtgggttgctgtttcgcggcgtgtccggtcggcgccggcgcgagcgctggtggcttctacgagaacttcgaggtgaagtggggcacggacccggaccctgaccggcgggtggagatcgtcgacggcgggcggctggtgacgctcaccctcaacaacgtctccggctccgggttccagtcccgggacgccttcctcttcggcgagttcaccatggagatgaagctcgtgccgggcgactccgcaggcacggtcaccaccttctacttgacatccaaggacccgacggcggtcggggacgggcacgacgagatcgactccgagttcctgggcaacgtgagcggggagccgtacctgatgcagaccaacgtgttcgcgcagggggtcgggggcagggagcagcggtcctacctgtggttcgacccgacagaggacttccacaactacaccatcctctggaaccctctaaacatcatcttctcggtggacggcgtgccggtgcgcgtgttccggaaccaggaggcgaacggcgtgccgtacctgaccaggcgggcgatgaaggtgcacgccaccatctgggacggcgacacctgggccacgcgcggcggccgggtcaagatcgactgggcgcacgcgcccttcgtcgcctcctacgggacctacgcctccagcgcctgcgtctcggcggccggcgacggcgacggcgatgaggacgtcccgtcggccttctgctgcccgggcgacgccgcgtcgtggatggcccggcggctgggtcccgacggcgagcgcgcgctggcgtgggcgcgggacaagtacatggtgatggactactgcgacgacccccggaacctgggccgccccgccgagtgcgacatggaccggctcgcctcggccgtctgattgttttgttccgtcggccataccgcttccacacacgtgtcgtcgtgtattaggcagacagacagacgtggggtgtttgcgttcgtgcttctagttctagcctagcctagcct

SEQ ID NO: 69 - DNA, 2602 bp, Hordeum vulgare
gggctcccgccgctccacaccggccgagagggcaagcccactatatctccagcttcgaacaaaagacttgggtctctcgttagaccaacgacgccaaaatcctctgttcctgctgtcagcgcgtttgagagcatcgaagattcagatgaggatgttgacctcgagccggattccaaaaatgatgatgctgtttacgccggcacaaatggggctattggatcagacccggttcctgttaaagcggatcagaatggggacatatcatcaacgagcatgattagatctcatagtgcaactggcagcctgcatgggatccaactaaatccagttgcagctgatatacttcgaaaggaacctgagcatgaaactttcagtaggatcaatattacagctgttgaaactccttctcatgatgaaatagaagcgtacaaagttcttcagaaatgtcttgagctacgagagaagtacatcttcagagaagaagttgctccatgggagaaggaaattataactgatcctagtacccccaaacctaacccaaacccgttcaattatgaacatcagatcaaaactgaccatcatttcgaaatggttgatggtgttgttcatctgtatcctagtaaagattctaaagaaagattatatcctgttgctgacgcgaccacttttttcactgatatgcattatatccttcgtgtgttggctgctggggatatacgaactgtgtgtcatcaccgtttaaatcttctagagcagaaatttaatcttcatttgatggtcaatgcggatagagagctgcttgctcagaaagctgcaccacacagggacttctacaatgtcaggaaggttgatactcatgttcatcactctgcatgcatgaaccagaagcatcttttgaggtttattaagtcaaagttgaggaaagaacctgatgaggtcgtgatttttagagatgggacctacttgactcttaaggaggtgtttgagagtttggacttgactgggtatgacctcaatgttgatctcttagacgtgcatgctgataagagtatatttcaccgttttgacaagttcaatctaagatataacccatgtggccagtctcgcctgagggagatcttccttaagcaggacaaccttattcaaggtcgcttcctcgctgaattaactaaagaagtgtttgctgaccttgaagcaagcaaatatcagatggctgagtatagaatatctatttatgggggaaagaaaagcgagtgggatcagatggcaagttggatagtgaataacgaattgtatagcgagaatgttgtttggttaatccagattcctcggatttacaatgtatacagggagatgggcacgattaattcattccagaacctcctcgacaacatttttcttccactttttgaagtgactgttgatcctgcttcacatcctcagctgcacgttttcttggaacaggttgttggcttggatttggtggatgatgaaagcaaaccagaaaggcgcccaacaaaacacatgccaacacctgagcaatggactaatgttttcaatccagcctatgcatattatgtatactattgttatgctaacctgtacacactgaacaagcttcgtgattccaagggcatgacaacgatcaaacttcgtccacactgtggggaggctggagatattgatcatctcgctgcagcatttctcacttctcacaatattgctcacggggtgaacttaaagaagtcccctgtcctccagtacttgtattatcttgctcagattggtcttgcaatgtctcctttgagcaacaactcattgtttattgactaccaccggaaccctttcccaacatttttcctaagaggcctgaatgtttctctctcaaccgacgaccctttgcaaattcacctaacaaaagaacctttggttgaagaatacagtgtcgctgcttcgctgtggaagcttagctcttgtgacttgtgtgagatagccaggaattctgtgtaccagtccggtttctctcataggctaaagtcacactggattggtagaaactactacaaaagaggtcccgacggcaatgacatccaccagacaaatgttccccacattaggatcgaattccgacacaacatttggaaagaggagatggagctgatacatttcggaaacgttaacctaccggaagaaaccgacaggtgaagatgttgcagcagttctcaaagccccgcgcacccatggtcaggcattccgtccatcccgttttctggccttcggagaagcgaacctatgctggtctgtgtagaagagaagaaaagcgcccgccccagtaccttttcgatgagtcttttactcgtgttacctgtataggcagatatatcagcatggaaggataaggagaagacactctaggattccagtggagacacacgcacacactcatcaggctcgctccctgggtacattagttagtgaccttccttggaataaaatccttgcatcttttgcttttattacccagatagtactacgtagattttacagcatgttaaatctggtaatttattcgcgtcgcctccctcactcatttatatcctaa

SEQ ID NO: 70 - DNA, 1516 bp, Hordeum vulgare
acaatttcaggcggcgacaatggccaccaacgacaagccgcacgccgtcttcgtgccgttcccggcgcaggggcacgtcacgccgatgatgaagctagccaaggtcctccaccgcaagggcttccatgtcacctttgtcaacaccgagtacaaccagcgccgccttgtccgctcccgcggccccgacgccgtggccggcctcccggacttccgcttcgccaccatcccagacggcctgcccacgtccaaagcagacgccgacgctgacgccacgcaggacccgccgtccctttgctactacaccatgaccacctgcctcccccatttgaagaacctgctccgcgacctcatcgccgccgttggggcgccgccggtgagctgcatcgtgggtgacggcgtcatgagcttctgcgtggacgcggccgcggagctcggcgtgccgtgcgcgctgttctggactgccagcgcctgcggcttcatgggctaccgcaacttccggtttctcctagacgagggcctcacccctctcaaagacgaagagcaagtgaagaacgggtacctggacacgccggtgacgcaggcacgtgggatgagcaagcacatgcgcctccgagacttctcctccttcgtccgcaccacggaccgcagcgacatcttcaacttcctgctgcacgaggtcgagcagtcggatcgcgcgaccgccatcgtcatcaacaccattgacgagctcgagcagacggcgctcgacgccatgcgcgccatcctccccgtgcccgtctacaccatcggcccgcttaacttcctcacccagcagctggtctcagaaggcgatggcggcggaagcgagctcgcggcgatgcgctccagcctctggagagaagatcagtcatgtctcgagtggctccagggcagggagccgcggtccgtggtgtacgtcaactacgggagcgtgaccaccatgtcgaagcaggagctggtggagttcgcgtggggactggccaactgcggctacgacttcctctggatcgtgaggaacgacctggtgaagggcgatgccgccgtgctgcctcccgagttcatcgaggccaccaagggcagatgcctcctggcaagctggtgcgagcaggaggcggtcatgcgtcatgaggcggtgggcgccttcttgacgcactgcgggtggaactccatgatggaggggctcggcgccggcgtgccgatgctctgctggcccttcttcgccgagcagcagacaaacagccgctatgcgtgtgtggaatggggcgttgggatggaggtcggcgatgatgtgcgtcgggtggtggtcgaggcgaggataagggaggtgatgggagggggagaagtaggaagggagatgcggaggagggtggcagagtggaaggaggtcgcttctcgctcgaccgcgcagcttggtggccggtcgttggccaaccttgagagtctgctcaaagatgtactgaagtgatcagatcaccaataacaaataattaagctgggt

SEQ ID NO: 71 - DNA, 2973 bp, Hordeum vulgare
gagcggcacagagacagcagagagctgagagagcacagagcacagagagctgagagagcaggatgagggtggcggtggtcggcggcggggtgagtgggctggcggcggcgcacgagctgctcgccgccagcggcggaggcgacgtgcgtgtcaccctgtacgagcaggaggagagcctcggagggcatgccaggacggtggccgtcgacgacggcgccggcggctgcgtcaacctcgacctcggcttcatgagcttcaaccaggtgacatatccccacatgacggagtggttagaagggctcggtgtagaaatggagagatcagacatgtctttctcagtcagtaaacaaccggaaggcaacggaagaggatgtgagtggggaaacggcaacggtatctcaagcctctttgcgcaaaaatccaatatattgaaaacaagtttttggcgcatgctcggcgagatactcaagttcaagaacgatgctctggcgtacctggagtaccatcaagataaccctgatctgtactgcaatgagacattgggacaattcattcagtcacatggatattccctattatcccaagaggcctatcttattccagtctgtgcaggcatgtggtcatctccatcacaaggcgttttgagcttgtctgctttcttcgtgctatcatttttccgtaaccatgatcttcttcagctatttcgtttcccgcagttgcccactgtcaaggctcgttcgcactcctttgtagaaaaagtaaagggagaattggagagcctgggctgtcgaatgaaaaccagctgtcgggtcaaatctgtttcaagccttgatggaacatctggctacagagtcttggagaatgatggttcagaggaaacatacgacagtgtcatctttggggtccatgcacccaatgctctcaaagtgttaggagctgaagctacacatgatgaactgagaattctaggtgcctgtcggcatgtccaaagagatatataccttcactgcgaccaaaatctgatgccccaaaattcgttcgcatggagtgcctggaattttatgggaataactagcagcgttttttctgttacttactggctaaaccatatccagaaaattgaatctgtcagacctttccttgtgacactcaaccccccttgtgttccggatcgtgtattgcttaaatggtctacaagccttcttgttccgtctgtggctgctacaaaggcttatcttcagcttgatcagatccagggaaagagaggaatatggttctgtggggcatatcaaggtcacagcttccatgaagacggattgaaggatgggaaagcagcagctcaaggtttgcttggaaagaaatgtgagcttttgctgaaccgaaagcagattattccatcatggaccgaggctggggcgcgccttatggttacaagatttttcaacctatacgtatccatcggtaacttgatatttgtggaagaaggaggtagtgtgttcagctttggtaaagcttgcgacaagtgccgtataaaatctgtcatccgagttcatgagcccttgttctattggaaggttgcaatagaaggaaatcttggcttggcagaagcctatattaatggttgtttctcttttcttgacaagagagaaggccttctgaatcttttcctgattctcattgctaacagagatgagcgtaggagcaaccggattgctagaaaagggggtcggtggacacccttgcatgtgatagctaggttggcacacgctagatacattttgcgcgaagtctcaaggaagaacactgtgacacagactcgtcgaaacatctctctgcactatgatcttagtaatgattttttctcgcttttcctggataaatccatgacctactcttgtgcagttttcaagatggagaacgaaagcttagaagtagcccaacatcgtaaacttagccttctaatcaacaaggctaaaatcaagaggggagatcatgttcttgatatcggtagcggctggggaagtttagcaatacaagcagttaagcaaactggttgcaaatacactggagtcactttgtcagcggagcaacataaatacgcagagagaaaagtcagagaagctggcttagaggaccacataacgtttctgctgtgcgactaccggcaaataccaccttgcaagtatgatgcaatcataagctgcggtatgattgagcatgttggccatgaatacatggatgaattttttgcttgttgcgagtcttacttggctgaagatggcatattggtccttcagttcatctcagccccagaggaacggtacgagcaatacagaagaaggacagacttcataaaagaatatatatttcctggcggttgccttccttcattggcccgtgtaatgtctgccatgaccacgtcatcaaggttcagcatggagcatgttgagaatattgggcccaattactatacaactctgatgcactggagagacaacttcattgccaacaaagacaaaattttggccctgggctttgatgacaagtttatgcgtatctgggagtactacctcatattctctgcggcttgtttcaagttacgagctcttggagattaccaggttgttttctctcgtccaggcaaccggcggctaggcctgccttgatggctgaacgcaacatatcgttctccggtcagctgtagaatggttgctgctcgatagcctacgatcttctaatcagtcaaccctcgaatggtttcttcatacgggcagcctaatcaggtggtttagtgatctatcttcttgttttaatcatgaaatgtttagttttcatggctatcaataaactgtatgtgcgtatgcaagtgctaccttagccttgtcaatagaatttgagaattgtacggaaggaactggtttgttgctttgatatctattagacatacgtgatgtcttggtttgtgattttcag

SEQ ID NO: 72 - DNA, 1451 bp, Hordeum vulgare
tgacgcacgcctcgcggcggcggcggcggatttcacactcctcctcgactccgcccttacccgcccgccgccggcgcccgcaacctctcccggacgcgcccctgcccaggatctgcaccgccgacgagcccccggcgctgcgctagagactacgaccggccggccgctccctcgttgccaccaacagccagcgctataagccaaacccggcgggcagcgcgaagcagcatacgcgcatgcgccaccaccatcgggtcctcctccgctgccgcgcgatgcctctcctgccgtcgccgccgaggacgctgcgggttgagggaggccttgtgcgccaccgcctcgtcagatgccgtgggttgcctatcccgccgaagacgccgggggtctcgggcgggcgcctgttctcctccctgccgctcccgccgcctctccagtccccaagagaggtgcatgtttggtatctttgtcccgatgagctgaaaaatcagtcccaactgaatatgtatgaagaactcctgtctccttctgaaagagagtatgccgactctatgaaagcaacaatgttgcggaaagatgctgttttgtcccgtgcattgctgcgcaccaccctctcaagatatacaggttataaaattgatccgaggtcattcgagtttaagaagaacaaatttggcaaacctgaggtattgtggccacaggatgataactctgcggagcaacctttgcatttcaacatttcacacacaacttctttgattgcctgtggtattgccattaatgctcgtattggcattgatattgaagagaagaagcgaaatacaaccaagaatattttatctcttgctcgccgttacttcaccccttcggaagttaattatctagctgagatttcagattcagatgctcagcgaaaggaattcctgaaactatggactcttaaagaagcatatgtaaaagctcttggaatgggtttctcaggtgctcctttcagtacattttcgatcatgctggatacaagtatgggaattcggatttctaaggcatcgaatgcttccaggtctgattgccacctgtccgagaactggctgtttacactcgcggagctaaatagctctcactacatatcagtttgtatagaggacagctccagaagtcaaggtcctgaagacagtccagcaccagtagggttgaaagtatggaagaccgtaccgtttgtcgaagatacactcgtctctggaacagaagctgtaaaacttattgcctgactactgaaacattgttgtgaaacacacttggtccagtagcgataggttttggtctctgcccactgaaacatcatttttcatgtgtgttggctctcttctcttggtggaaacattgttggtctgagctgccattcaatggctggcactacattaccatatgtatctgttgagtttctttgatcacaa

SEQ ID NO: 73 - DNA, 1504 bp, Hordeum vulgare
gtttctttttgttctctccggcgagggaaatgagcagcgagacgagcaagcgagatcatgcacgggagctcctcgccgctgacagtaagttgatgaccgtggcccgcacagtgcgacgacgccggctcgaggtccggcggctgggacgtactgcgtctgcggctgcagaggacgagggcgcgaagcgggtgcggccggcgccggacagctcctcggactcgtctgactccgcgaaggtggcgccggagccccccttggcggcgtctaggtgctcggcgtgcgtgtcgcacggggcggtgtccgtgatcgggcgccggcgggagatggtggacgcggtggccgtcgccgcgccgttcctggccgatacggcggcggtggaggggagcggcgacgtggagcgcggggcaggggaggagggcttcttcgctgtgtacgacgggcacggcgggtcccgcgtggcggaggcgtgccggtcgcggatgcacctggtgctcgcagaggaggtgcggcttcgtcgtccgcggcctgagggcggagggcagggtcgggccgtggacaacgaggcagacggcgcgcggtggaaggaggccatgacggcctgcttcgcccgggtggacggcgaggtcggcgtcgacgacgggaccgacaccggcgagcagacggtgggctccaccgccgtagtggccgtggtgggcccgcgccgcatcgtcgtcgcgaactgcggcgactcccgcgccgtgctctcccgcggcggcgtccccgtgccgctctcctccgaccacaagccagaccgacctgacgagatggaaagagtagaagcagctggtggcaaggtcattgactggaatggatactgtatcctgggagtgctcgcaacttctaggtcaataggagactattacctgaaaccatatgtgatagcggaaccagaagttaccgtcatggaccggacagacaaagatgagttcctcatactagcaagcgacggcctgtgggatgtcgtgtccaatgacgtcgcctgcaagatcgcgagaaattgcctaagtgggcgtgcggcctccaagtaccccgagtctgtctccgggagcacggcggccgacgccgcagcactgctggtggagctcgccatggcacgcggcagcaaggacaacatcagcgtcgttgtcgtcgagttgcggcgactgaagagtagggcagcggcggtgatcaaagacaaccgcagctagtactagcactagtggtaatgtaggagtggctggctggatggggatgtcacattattcgagcagggcgacaaggagagaagagagaaagaatttgcggctgaattcgctgggatggttgtagttttagagggcccagggacgatgtgaccactgttgagttgagtgtgctgtttgtcgccgttgtattgcgttgcgttggttctttggttcttctatatgctgatgactgacgttcggggcgaaacggcaagaaagataagctgctttcgtcagttctg

SEQ ID NO: 74 - DNA, 3388 bp, Hordeum vulgare
aatttcacacaggaaacagctatgaccatgattacgccaagcttgcatgcctgcaggtcgactcccgggtggatccactcgaggtccagatgagttcgaagaaggttccgttcaaccgtcataaggagaatgaggaggcgaggaagaagagggaggaagatgaagcggcgcgcgtctatgcggagtttgttgagtcattcaagggtgaaagcacatccgggtcgaagtttgtccgtgggggcgtgattgatcccaatgccaagctgagagctgattcagaaggtggaaagtccaaagatgggggttctgttccaaagaagggcagtaggtatgttccatcttttttgccgccatcatttgggaaagagccacacaaaaagaaggaagatgagcggccgaaggaaaaggaaaaaggaaagccacgggtgatagataagttcatggaggaactcaagtttgagcaagagcttcgggaaaggcgtaatcaagaaccggcacgaggtgacggtcgacacggtgacacctccgcgtcctctagccattttgatgaactaccagatgaatttgaccccagtgggagaataccaggatcatttgatgatggggatccacaaaccacaaacttatatgttggcaatctctctcctcaggtggatgagaattttcttttgaggacatttggtcggtttggacctattgctagtgtcaagattatttggcctcgaacagaagaagaacgcagaaggcaaagaaattgtggttttgttgcattcatgaatagagcagaaggacaggcagccaaggatgaaatgcaaggtgttattgtgtatgactatgagctgaagattgggtggggcaaatctgttgctcttccatcacaagcactgcctgctcctcctccaggacacatggcaatcagaaacaaggagggtggtactgtaatcatatctggtcctggaggtccacctgctgcatctgttacgcgacaaacctcagagctggtccttactccaaatgttcccgatatagtagttgctccaccagatgattcacatcttaggcatgtgattgacacaatggctctgcatgtacttgatggtggatgtgcttttgaacaagctataatggaaagaggacgagggaattctttatttagcttcttgtttgatcttaaatcgaaagagcacacatactatgtctggaggttatactcctttgctcagggcgatactttacaacgatggcgaactgaaccatttatcatgattactggaagtgcaagatgggttccacctgctttgccatccagccgaagtcctaatcgtgaaaaagaatctacttttgcagctggtagaagcaggcgtgcggaagtggagcgtacactgactgattcacagcgtgatgaatttgaggacatgctacgtgcattgacattagagaggagtcagataaaggaggccatgggatttgcgttagataatgctgatgctgctggagagattgtcgaggttcttgcagaatctttgacacttaaggagacatctattcccaccaaggttgcaaggcttatgctagtgtccgacatccttcataacagtagtgctcccgtgaagaatgcttctgcgtttcgaaccaagtttgaggctgctatacctgatgtcatggagagcttcaatgacttatattgcagtatcactggaaggattactgctgaagctctgaaggagagggttttgaaagttctacaagtatgggcaaactggtttctgttttctgatgcatatctgaatgggctgaaagctacctttcttagaccaggcaactctggggtcacccctttccactctctatgtgatgatgcacctgaaattgaaacgataactagctctgagggtagtaataatggatttaggcttgatgaagatggtaccctggccacaggaaaggcagcagcgacgaaggagctgttagggcttccgcttgctgagcttgaacgttgttgtagacataatggcctctcactatatggtggtaaagagatgatggttgccaggttgctcagcctggaggaagctgagaaggagcgagcatatcagaaagatgttgacatgaaatgtggacaaggagaacctcatagaactagtagagaggatattggtttgaatgcgcataatggtttgagacctggagaaggtactgttgatgatgaatcagttatgctgggcctctctcgtcacacaggtcaaaagcactatggaaaatcttcatctgccgaactgaaacaagttccaagcaagaagcagagggctggtcccatcttaccagcttctaaatggaatcaagaggatgatggcagtggcgatgaagatagaaaagatggtcaaggattgggattaagctattcatctggaagtgatattgctggtgatcctgggaaagctgatgcaaaagaaattagtactgatcaggcaattcatcatccagatacaattgttgatgaagagcataggcagaagttgaggcagattgagattggtgtcatgcagtatcgtgagtcttctgaggagaagggtttgtggaacatggaggagcttgagaggaaggttgccagccaccgtaggtgtcttcagtctgaatatgggttgtcttcttcagtagatggggcaaacaacaggcactcttccgagagaataccatcggaccggaaagaaaggtatgatgatgcacgcgattcttccaagaagcggcctcacagcccaagtaggagccgtagtccttcaaagaaatcatcactggatagagaccgagagcacaaccgcagcagagacagattgcatggtaatgatgttgggagagacagggcacgtgaaaaaaggtcaggccgagagaaggacgatcaccatgatagaagcagagaaagagaaaaggacaggagaaaggggaggtgactgaggtatgttggttctagccctaccaaatatttggctagccaaaatttcggttgaccttttggttgcccatgagttggccaacattggcaaggaaaacgtgctatagtaaccaaaaaggcattggcttgccaaatacttggcaaccatccaaacagaggccagtgttttggacatgaccaaaatattggtagagtaagtttagctaccatgcatacataccctgatacttgaaaatccccctgttgtgcacttgtccttcggctgaataagcgtcttgagcaagcaaatgtttgagctgggctgcatccgccgatacccgacgcatgtaaatgggtgcacatggcctgctcaaagacctgtttgtagcggatttgaggatgtaggtggttctcctaacggaggacctgtttttgtagtatcaaggaacagtagtttgt

SEQ ID NO: 75 - DNA, 4321 bp, Hordeum vulgare
ctcttcccgcggctctaagccctagaacaccccttgcttttcgtcgctgctccccccgccggtgatggccgcgccgccggagacgacgggcgcgccgtccccgccggaaggggaggacaagggaaacgcgggcgtcgaggtctgctgcttcgagcaatctgcagaggacttctccagagcggtacgcgccatctcggagctcgccgccggcgagcccgagcccggcttccccgacgccgaggcggaacggctcgcctcctcgataacgttcctcagagaatggaggcattttaattatgagccaaaaggtgtaagttttactcacggcactggatcaacttcatccagagataacacacatgagattaccttaccacaattctcgtctgcatctgttcctcaggtcactcacttggaagatgggagggataataatacatacagttctgatttcattttgttcgctgggaggaatgtttggtcgctggactggtgcccaaggttgtgcgacaagccttcttctcctgtaagttgtgagtatcttgctgttgctgctcatcctcctggttcttcttaccataaaattggtatgccactgattggcagaggcatcattcaagtttggtgtatcgtagcaccctttgaagaggcacgtactaatcagtcaacgcttgcatacagtaatagcaatcgtagaggaaggcctagaaaaataccgaatgagcacaattcaattgagagttcatcagttcctcgaaaaccaatagggggaccaagaaagataaaactgacgactagggatgatcacgcagaacctagtctgaaaaaaccaagggatcacacagaacctagtctgaaaaaaccaaggggcagaccaagaaaatatccactgtcagctaccaaagcagtagattcaacaaaaaatagcggaagtcaaggttctagttttgttgaccctcttgtcacttcaggagttattccaggcgatcttgcgttatcttgtgctataccatctgtgaagtctgtggactcagctccaaaaagaggtaggggtcgacctaggaaaatcccaattgacaaaataaagtgttcgcctgacactgaatggacagaagatgtctctagagctctaatatgctgcactataccaaagaaaaaaagggggaggccccggaaatatccacccccaagcagcagcaagcatgtttctggcactgataatgaatttgaaagagaaactggatacacagagtctaattctaatttaagtcttgttacagttgatgcagcgctaccagttccatcttcatctcttacaatttgtgggaaaagatcaagaggtcggaatggtagaggacgacctaaaaaggaaacaaatccttgcatactttcttcatcggtggtttctggtctccaattgcaaagtagggagaccatttcaaatgacccagcatgctctgttgagaatcatttgccatatggacactccaacttgacaagtgagctttgttcaattgatggcaatgtgcacacaagccccactttagaagattccttgctgcccatgcacattgcagctaaatcaaatggcgaggagtcaagtggtagtaggagacgaggacggcctagaaggaagacacgttcaattacaaacggttgtttatttgcttctggtaccgagtcctcaaaggtggcaactacaattaccgattcggacaatcccatggctttgaccaagagtgacggtgaaactatagcaagcgatcctgcttcagttggttcgttgatgaggtgtcatataggaatgtgcaatgtcaatatgagtgctgcatcaccacctcatggcttgtgtaatgcaaattacaaggaaaaatcaagtgcccagcatagaaagaagcctgttgcagtagagtggttttcttcaactgcattcagcggcaaagaacaaaacaatcagacaactccccagacaagtgataatgtggcctcagtccaaaattgcaagaaagaattacttgtctacaccagaaggcgtgtacgaggacctacaaagaaacctgcttcaaatgagacctgctcactggctcttagtggtgacgcgcagaagatggaaagatcctccacgtctatcatgccaaataatcatttgttttctgttgagaatcccaagctactgggtccatctataagcgaagacatggctaatgaggcaggtttggttggatgtaagagtgcacttggtagccatgaagtcatggaaaagaatgatagtgaagttgccaataaagttgtgcctgttccttctgaaaacagtgcccagatcataattgtggaagatgcagaagtagttccatccaaagaatcaagtaaaaatagtaatattattacttgtgcagaaaactcaaacttttctgcaatccccgaaggcattcatctaccaagggtcgttttgtgtttagctcataacggcaaagttgcttgggacatcaaatggaagcctcctttaccaaatcagtcagaacagaaatcacatttgggttttcttgcagtactgttgggaaatggctcacttgaagtatgggaagttccatctccaagcatgatccagaaaatatattcctcttcttcggtgaagggtaccgatcctcgctttctaaagctgcaacctgtatttagatgtgctaaagtgaagtgcggaaacatacagagcatgaagtttcattttgaaaatcattgcctctttataatgggaaacagcattcccttgacagttgattggtcgccttcttctcatgatatgatactggcaggatgtcatgacggaacggttgctttatggaagttctctacagacttgccatcacaagattcaaaaccttttatgtgtgtcactgctgaatctgttcccatcagagccctctcgtgggcaccatatgtaagcgaggaaaacacaaatatcttcgtcactgctggagaggatggcctgaaattctgggatttaagagatccataccgtcctctgtgggaactaactactgccccaagggctgttttaagtcttcattggttaaaggagtctagaggtattatcatctcactggaagatggcacattgaagttcatcagcctacctagaattgccaacgatgtttcagtcaccagaaggccatttgctgggactaaaactcagggtgtttctacttatcagttgtcagaatatctgatatggaatgtccatgtctcagaaattaccggttatgcagcttattgtgtggcagatggtactgctgtgcgcttccagcttacttcgagattctgggagaaggaacctgggaggaaccgtgtgccttatttcctttgtggttcggtagcagaggaaggggcaaccattaagattggtggaacattgcaaagctctcctttgtcaaatgttcctctggttgcaaaaaagggtccaaaaccatgccaaaaagtacctaaagcgcatgatacacaaacagagaaagtacttgccctcaccaactcagaacatgtagatccagaacccagagagggtcgactagatggacctggggagggccaagagaccaatactctggttttagctgattctctaatgccagagaatggtggcacatgcaacgtcccagttgatgaagacactaaagactttgagctcttccctcccaaagctgtagcgctgcatcgactgagatggaatatgaacaaaggtagcgagaaatggttatgctatggaggcgccgcaggcatcatccgttgtcagaggatctaaaaggcaagcataattgggaagtgttttgtcccacctagtttgttgcatgtttgccgcagactagggtcatccgtgtatatccacctacacaataagctgttgcagcaacatatggtatgttcttccgattctttccttgacctttcaaggggttgccattgcggacgttcagttatgcacaattatacttacataacagagctgtgtatcttaggaactcccagcagatccttgtagtttaggaactcaagttcaggcaatatgagctaccaggtcctgcatatcttgggctcagcaaatcatagttctgagaataaagtgcaccggtctcgaataagtgtgggcttgtccgcaacttttctgaatctggtgaaagttttttttttcatgtaaggctgtaacatatgtacatctattgtttacgcagtcacacaaatacagtaatgtcgtgccagttgtaacattgacaaactgaacaatgtcgcaccaatatgtaacaggccaataatggaaatcatgagccattgc

SEQ ID NO: 76 - DNA, 698 bp, Hordeum vulgare
actactctacagtcctttgtctctgccttcgtctctcaactccagcctctgcttgaccgttgtagtacgtacacaaagcaatggagcacaaggggcagcttcagccggagaagaagagtgcccaagaagaagaagaagaagccatggcgatggcggcctcgtctccttccttcttcttcgcgcaccccttgtctctactgcaccacgtcacccgcggcttcgccgggtacatgggcctctctcgtctctgccacgcgctcaaggatctcaagcctcgggccgccacttcttcccggctgcatgagcaagggcccggagcaggaggcgctggacatgctgcagatgatggttgcgcggccgtccaagtgcggtcgagaggggtgcctcagaggcctcgtggtccaagagaaggacgaggaggaacacaccactaggcttaggcttagcatagtctgcaattgtaggctatagcgttaacgcccatggggaattggctgcgtgtgttctttctggaaatctgaattcagagccttagagtgagtgcttccatctcttcctgttcttttcagaatacaagtttcaattccaggccgggcatgttgtttacgttcctcacttcagcttacaaaatgctaatttagtaagcaaggagctgttcctgtttgtatatctgtactgtattatagtattatacacga

SEQ ID NO: 77 - DNA, 2625 bp, Hordeum vulgare
cggggaggccgggatgctgcacgagctcctcctcgccctcctcggcttcaccggcgacttcgtgctcgacaactcctccgccccccgccgccccgagcccgccgaggccggcggcgccgcagacggcgacgcgggccccgccttccgcctggcgcccgacctcaccttcctccagccgtccgagaggagtgctattgaaaggctcatatctctgggcttttattacagagaactgaatcgttttgcgaccgagtctcgtgatctgagttggattcagtcttctgttgatgtttcatcacctaatgctgatattactctgaagggtaaagggagaaaagggagtgcataccggagggcaattggcaatggtattgctgagattttatcagtttataggtcagctgttctgcaggttgagcaaaacctgttatcagatccattgcctatcctggcgacagtaactcatgggctaaataagttcgaggttcttctgcctccactttatgagcttgttatggaaatcgagcagaaagacatcaagggaggacagcttcttaacctgttacataaaagatgccattgcggggttccagaattgcaaagctgcattcagaggctgctttggcatggacatcaggtcatgtttaaccagctgacttcttggatggtttatggtattcttcaagatcagtaccatgaatttttcatcagaagacaggttgacagggacgaggagaatgaatcagctcagtctgatgttgctgataaatttgcgcagaaattagctagagacacatcccttactagttggcactcaggatttcatgtattattggacatgttgccggagtatatccatatgcgagttgcagaatcaattctactcgctggcaaagcaataagggtacttagaaatcctagtcctggtgctacattgctggaaccaaccaaccaaagtcagacactgaaagggtctcatagaatgcaaagtttcgttgggtgctccggtgctctgaaagagctgccaaacttctctaacattagtgcagaagaattattgccacaggctgaagcagataaagttgatgccatgcttaagcagctaaagcatgcttccgaatttcataaaaggttgtttgagtctgctgttagctcaatacgtacaattgcagctaatcatctttggcagttagtggttgtacgcgctgatctcaatggccacttgaaggcacttaaagactattttcttttggcgaaaggtgattttttccagtgttttcttgaggaaagccgccaattaatgcgcttaccacctcgtcagtctacagccgaagcagatctcattgtcccatttcagttggctgcactgaaaactataggcgatgaagacaaatacttcaccagggtatccctaaggatgccactgtttggtatgaaatcgagcacctcacagaaagatcttcaaaagtccaacacatcagatctttcgttgcaaggaaaggctagctcagagttggcacttgatggttggcatagtattgctctggaatattctgtcgattggccactacaactcttctttactcctgatgttctttctaagtaccgcaaagtttttcagtatctcattcggttgaagaggacacaaatggaattggagaaatcctggacagctgtaatgcatcaagatcatgttgatttttctgattattgcaaggatcagaagaattcctctgcaacacaactgcgccggttacgcacgaagcctttttggcgagtaagggagcatatggctttcttgatcagaaacctacagttctacatccaggttgatgtaattgagtcacagtggaatgtcttacaaactcacgtccaagattcacatgattttacagaactagtgacctttcatcaagactatttgtcggcattgatatcacagtccttcttggatataggatcagtgtctagaatactggacagtataatgaagctttgcttgcagttctgctggagtatagagcaatacgaaacaggggcaaacatgtttgagattgatcacataacggaggagttcaacaagaaatcaaattcgctgtacactatcctaaggagtagtcgacttgcaggaagtcagagagcacctttcctgaggcagtttctgatgagactgaactttaactctttctttgagacaactgcgaggggtgtgatgaattcgggcaggctgcggccaggcacagcgagtacccagctgtaagcctatcaagccatggtggctgttctcgccgttatttgcatgaaaatcctgctacacactgacaatggcgcaaactcatcacacaagaagaggaggaagaatctgtaggatctgtaaattagctgtagcatgtgacttgttttgccctggaaagtaaacacttggtgatgtttgtttggctagtgttgtgatgtgtgcgtctttggggttgcttgcccactttccccatgttattggtatctctactgggaacatggtgtgtggcctcatgaaatggtagcagactagcagacccgttcagtacttcagcaacactgcaaggatatgacaacattgcaactgttctggcaggatgaatgcaacaa

SEQ ID NO: 78 - DNA, 3475 bp, Hordeum vulgare
aaaggcctacaggaggcgtagaaccctctccaggtctcggctctccgccgtcgccatgggcagcgcctccaagctgctctcctccctcttgctcacctcctccccgctccgtctccggccctccgccgccgccttcgcgctcatcctctcctcgcgcaccgcggcatcccgccgccaacacctgctctcctccccctctcccctccgcacgctctccacctcggccgccgccgccgccgcctcaccccttccctgcagctccagctccgcctcgtcaactccaccgccccacgtcccttcccctgactggtcccgcctcgtggaccgcctcgcggccgccggttacgcagcccgcgccccctcccccgccgacgagctcgccgtcccctccggcagcggcctgtcggccgagacggagtccgctgtgtcctcctgcctggccttcgcgcgcgaccggcccgaccttctcaggtcgctgcccacgaaggatgtcgaggttgtggtgtctaacgttgcaccggctctcttcaagagaggggaggaatctgcgcagcggctgcagcaatacctcgccggtgaagatgacaatgcaattcaatcagtcagagcggaaactgtggacatcgttcggtacttgttaagttacacatatggttcgtcaaacaactatttggaagacaaagaactcactgattcagttgtgagaaatatcttggctgagctagttaattttagtggacttccccacacctccagttttgtggagtcaacagttgataatcaacctgagcgattctctaggcatccaggacaaaatgttgagatgaaacgtggtgattggatttgcacaagatgtagctttatgaactttgcaagaaatgcgaggtgccttgagtgcaatgagcatcggccaaagaagatgttgactggcggagagtgggaatgccctcagtgtgaattctataattatgggaggaacatgtcatgcttaagatgtgcttgcaaaagaccagcgacaactgcatctgctggtgctggtttaggcggtgtggcggatcttcttagtgtaaccaatgctggtagatctgacattgagagaaaactcgctgaaaacgatgagaaggcagaaagatggttgagcaaagtatctcaacttgacgattctgctgatttgagtagtctggcagctgatgaggattttcctgagattatgcctatgaggaagggggtcaataaatttgtagttagcacacgcaagacaccattggagagaagattgtcaagtgcacagtacagcagtaataatagccctcaagcaacagcatccgactccaagattagtcaaactttagacaggatacttgggcgttctgcatctacctctgccccaagcaaccaatctgataatgggggtgtagatgctgggcctcccaggaaattaacaggccatcttggtgatatcgaccctgttccttttgtgccattatctgctgatctgtttaccaagccacagaatgcaaacagtaatgaacaggcagatacggactgccaaataaataaggaaactggaagttccacaccggataccacacaggcctcaactgggaggagggatgtcgataaatcgctagatactgctgagaaatggtccaagaaagtcgcagaactcgacagtgtaaatgacctttcaagtgctatttctgatgaagactttcctgatattatgccaatgaggaaaggagagaatcggtttgttattagtaagaaaaaagaccggtcactggcatcaccgcagtacaagaggcgcagtgtgcttgagcaggctgacaattccgatttcgtcccatttgttccgttcccccctgattattttgccaagaaagatgcgccagcagagagcactccagatacaggaacagtatcagaaagtcctccatcagctgataagctaccagaaacaaatgcttcaccaggaaattcgggaaatagccaaaacacctcacaggtgattggccctcagcgaagtagcaacatgactaatgagaactggaatagaaattactctcagcagagctcgagtacaggtggttatacacagggtggaagcagcagccagcagtatcaacagcaaccttatgatgtgggtgatcgatcgagtcgaacttcgaataccagtgcttggaccccaactactcccaggggacgtttaatgatcggaagaggaggatctagcaactatcagcatcaacagcaaccccaggagctaggcgatcaatctattagaacttcgaatactggtgctttgaacacaaactactcacaggggaggtttaatgatggcagaggtggatctagcaactatcagcatcaacaacaacctcgtgagatgggtgatcgatctagtggaatttcgaatactggagcttggaacacaaaccactcacaggatagttttaatgatggcagaggtggatctagcaactaccagcaacaacagcaacttcatgggataggcgatcaatctagtggaacttcaaatactggtgcttggaacacaaactacccacagggcaggtttaatgatggcagaggtagatccagcaactaccagtatcagcagcaacctcatcagacgggtggtcgacccagtggcactttggatacccacgctccaaactcaaactactctcaggggagcttcaacgagggccgagatacatctacttataatcacggcagctactctacacaaccgtcttatgcgcccggttacagtaataatagcaacagcaatgcttggagcagcaacaacaaccaaaattggagtggttcacatcctgatactagggctaccactaccggcattggttccacaaaccctaatcaagcaacaggctactcaagctacggaagtggaggttatactggaaagagcttagaaggctctgctgtgaaggaccctgatcctctggacatgtccgaggaagccaaggccgagagatggttcaggagggcagcccagataaaggacatctccgagctcgccaacatccccgatgaggacttccctgagataatgccgatgaggaagggggtgaacagattcgttgtgagcaagcggaagacgccgttggagaggagattaacctctcctcagtacagaaggaacctgccgatcgtaagctctgagccggacaaagatggtagctgaaagcaggtatatttattccgatgcaagagcgaagagtttacacatggatatgtacttctacttccgatcgtgataaaataagcagcaaggcgaagaaatccacgcggaggagacagctgaacgcccagaacatttttactgtatcctaaagttttgttctcgaccagtagggatttgctgtgtttcatttgttacgtgtatcagttgtatgcatgtgttgtcgtacctgaaaccgcgagtgcaatcatcaaataatttgtacgg

SEQ ID NO: 79 - DNA, 1753 bp, Hordeum vulgare
catactccctactcaccagctgacggcggcgccgcacgaaaggaacgaagcgcccctcgctcccactcgccgccgcctccggcgtcgctacagaatatacagaggctaaagtcaaccttaaaatggaggatgctaatgcagtagtagattggaatgttgacattattggcccagatggtggtagtgcttgccgcaaattggcaaaaactgaagaccctgatgccacggagtgttcaagttcctttggggacacactatccggatctcaggatgatgcaaagccttcagagatcagtgacattgaagtagactcaccattctgccgataccctcataatggtgatgctgctgcgctcttggatgcagctgcttctgacaatttggatagattattgaaaaagaaaaaggtgactgatcattggagaaactatatcagcccattaatgtggagatgtcaatggttagagctacggatgaaagacttgcaatctcaagtatctagatatgacagggagcttgcagtacttaaacatgagaaagagttgcagacaaaaatgatcgagttggactgttcatcgtcgagatcagtgcccttctcttctcattgctgcaggaagactatgaagaggaggaagagaaagagaaacgaggagaaaatcaatgctccatcatacatcgcaacccacaccatattgtcttattacgaaaaagagaaaacggaaggggatggcccttctatcgacgacaatggaaacttagatgacagcacaaaaggaaataatgacgctgactggctacttggtaatggagacgatgctactgtcgagcagattcttttaaacattcagtctattcaagacagagtctgtagtctgagatcagatctcaagaaagcaatggccaagaagagcaaggggcttgtccttaaagtcaacacacgtgtcaatggcgcacagagctctaattgctcacatggaaaaggcaaagttgctgaaatgcctgaaatatcacctcaagatgcatcagattgtgatatggacgatatggacatgcccgatagtgctgtctcaagctatggagaagctaacaatatggatatttttgagagcacgatgaacctattgtcagttgaagatccagataaaatcggtgaactacaccagacttcggaagatgtgttgatcgacaaccaaccagcagagggagggtatcaaaatttcgaggtgatcaatcatccatgccagcggctacgggtatcagtcaagagggaacaggtacctgtcaagagagaaaccatagcacattctgaggatgagagcgtcgctgcccccatggcggtcgttaaggaagaagacacaaccaggttgggcctccaggggatcttgaagccctgctacacgggcaagagaaaaggcaggaagccgaagattctaaggcgcggcggttcatcatccgttctcagctcatggaagagcgcccggactcgaaagaagaggaaatcatagacgcagatcgtctcagtgaatgcacccttattctttggcttcgaatcttccgtttaattagatgatgatgacgacaactgcgaaccttttcctttttttttctttctacctgactgatcgaagccagaagagggtgatggaaaacggcactacggcagcgaagtgcttgtaactctgttttatttctgttgttgttgttgcgtgtggtctttgtcctgaaagagtcaaactttggttgttacagtgtt

SEQ ID NO: 80 - DNA, 2701 bp, Hordeum vulgare
tgcatctttatccgaatcggtagcgtagacatctcctctgaaccggagcctcatcatcctccttccacttcgcttccgcgcgacgccagcacgcagcattttccgctgttgccattaatgaagtaaaatgagcgacgttattagtagttagcaccactactatagtgtgcgcaagggaccaagcagcgagagctgaagggactcgagggattagcctagggttttagggcggccgaggcggcggcatgggctaccaccacctcctcgtcgtctcgccgccggcgcagccgccgccgcggcgcctctccctcctctcccgcttgccgcgtggagccgtcaccgccgctgcctcgcccgacgccgcccggtccttgtcggtggtggcagcgtcggcggccacgcgaaggagggccgtgctcctggtcgggatctccgtgctcccgctcctgcgcctccgtgacgcggcggccgccgcgcagcccttagcggcagatctcgtcactgataaaatgggcattcagacgtctgaggaaatgcggcttgaagaaactagggctaaaccacctcagcctgaggtgaaaaggccatctccagggaatcctcttgcaaatcttctgaatgcaattgcagttattgcttctgggcttctggctgggcttcttggtactactcaacgtgaaaagaaggccttgcagtcaaccatctcatctatggagatcaaattggctgaagatgaggcagcgatgtctgtgcttagagagaactatgagaaaaggctattggatgagcaagcggcacagaagaaacaagctaggatgttccaggacgaggaagcttctcttcttgatcaattggcttcaacaacgagaactgtaaaaaaattaaatggggaagttgtgaaggaggaagagctagttgggcagcttaaacatggaatacatgatcttgagatgagcattgcacaagcagaggaagacaaacatgcatttgaagaaaatttgagggacaagttggaaacagttgatattttacatggcaaggtaaatctgcttagccaagatgtaaatgacaaggaggaacacattacagaactcagttcatcactttcaaccaaggaaggagactaccagaacctgcacttgatgtttaatcagactaaagggagcctggaacatgcaaattctagaatggagcaactggagaagtatgtttatgcagctaaaaatgatataaaatcaaagatatcctcaattgattcattgaatgaggatgtccaaacattgtacagtgcaaagagtgatgccgaggaaaaaataaatgagttaatgaaacagtatgcggaattggacgctgcttctgagatgagggcctctcgcgatttggaactattgtcaaataaagatgatcagctcaatcaactcgaagaacaactttctactgcattaagtgactctattgaagacagaattataatcgctgagttaaacagtgaattggaagctaacagaacaatgctagtcaatgaagttgaggcccggaaaaaaatgtcagatcttattcagtccactgaagatgcacttaaagaatccagaaacgagttgttcaaactgtccgaagagcttaatgaagtaaatatatctaaccattacttgagaacccagatttcagaattcacaaatgagtctaatgaagtgaaagaggccctgactaacaaagtagaagaagcggaatcagtttctaaagctctttcagatgaagtggcctcactcaaggagatacttcaaaagacgcaagaagatcttgaagtcacctctaatcaattggtgtctattacagaagtgcacgatgaacttaataaagaattgctggatgcatataaaaaattagagtctgcaacagatgagcttgttcgagaacgacagattaattctattttaaatagggagcttgaggcattggtggaacaatcacaggtggaatctgaagctagaagagctcttcatgtagacttggatgaggccaccgtttcactaaatgaggtgaatgagagtacattatttctgtctaataagcttgatagcactgtttccaggatttgtgctattaaagaagagaaagaggtgctttcagcggctcttttggagcaaaagaaaaggacagccgaagctcagaaaaatatggtggacgctcagcatcttattaaaaggctcgggatggagagagagaatagtgaaatcaggaataaaaagcttgaagaggaattggccacagcaaaaggtgagatgttatatctgaggaggcagattactgcaagtgggtcacagaatacagatgttatggaagcaaacccaacaccaaatttcagtcaacctctggaagatcgtgttccaaataccagtagtactgatgctgtacctcctcgttctgctaagaagatctataggagaagaaaagacagaccatcaacataagcattatcagaacatgtgatctaccatcaatcttccatttgctctcatttccaacatttgaatggtagcactttataagaaatgtttttgtttaacttccaacatttgaaagctagcatattagactactctagattatgaggaattgcaaatgtatgtttatctgtgtacaaatgtgttgttgtcttgagtgtgtcatgaattataatatggcgactcatgctatcttc

SEQ ID NO: 81 - DNA, 1124 bp, Hordeum vulgare
tttccacttccctgttccacgtctgttgactcctcccaccttcctctgctccggtagaccgtaaaaatggccgcatcactgccgtacctccctccgccgccgcctacgccgtcgccggcggccaccaccctgccgagcaacctcgtctccttccccgcgccgcggccgcgccccgcggccacgcaccgccgcgcggtactggccgcggcctcgtccaggccccctccccctccgccgccgtccccggagggaggggacgaggaggtgtacagggccatggggatggacggcggcatcccgggaacctccggggagctgctgcgccgcgtctcctcccgcgcctacggcatgcgccgccacctcatggagtcgctcgactccctcgcctacgacgtgttggagacaaacccatggagggaacaacagcccaagccagtctacgtcctggctagaagagacaatcaactatggacgatgaaaacccgcaggaaccgcagtgaagttgaaagggaacttggaatgcttttctcaaagggagggggctcaggagttgggactaaatccaagtactctggctccaagtttagcatggtcgttgaagatctgacagagggtgtgctggtgttcgaagacgaggatgatgctgtaaaatactgtgatgctctacagggcggtggtcaaggatgcgagggaattgcagagctagaggcttcatcagttttcaacatgtgccgtcaaatgaaagctctcgctatccttttccagcgtggaaggactcctccaacgccacaaagccttgagcgtgacttgagggcgaagaaccggtcactggaagactaggatcttctgaaacgcggtgtagatatgttaattgtattcttctagctgttgaagcacaggccatacgccttgtatactgaatggtacatagatgtttgaagccacaaagaaaatgatgcaaaataactggtacatagattcaatgatagccaagatggagtggaagtcaagtctgacagtgagtagtacatatttagcttgagattagcaatctctgtaaaactggatattcttgtaattatttacattgtttacagtgaataaatgagattttaaattactcg

SEQ ID NO: 82 - DNA, 1459 bp, Hordeum vulgare
cacctcgccgccgcccccaccatgtacggcgtcagcggcggcggaggcggcttcaacgcgccatccacggcctccgggcggcgccggaaccaggaggacgacgaggaagaggaggaggaggaggagcagaccggcgacggccgcgtcctcgaggcatgggagcgcgcctacgccgacgaccgctcgtgggaggcgctggaggaggacgactcgggcctgctccgccccatcgacaccaagaacctcgtccactcgcagtaccgccgccgcatcctgctccgctccgcggccgccgccgcccgcatccagaagggcctcattcggtatctgtacatcgtaatcgacctctccagggcggcttccgaaatggattatcgccctagtcgaatggcagttgttgcaaaatgtgctgaggcattcataagggaattcttcgatcagaatcccttgagccatgttgggctagtgacaattaaagatggcatttctcatcgacttacggagattggagggagtccagagtcacagattaacgcattgatgggcaagcttgagtgttctggtgattcatctctgcagaatgctctagaacttgtccatggttacttgaatcagattccttcctatggtcacaaggaagtattatttttgtactccgcactgaatacatgtgatcctggtgatatcatggagacaatagaaaaatgcaagaaatccaaagttagatgttcggttattgggcttgctgcagaaattttcatttgtaagcatctctgcgaagagactggtggatcctatacggttgcactagacgagtcccacttcaaggaattgctgcttgaacatgctcctccgccacctgccattgcagagtatgctgcagccaatttaattaagatggggtttccacagaggggagcagaggatcttatctccatctgctcttgtcacaagaaaattaaatctggtgctgaaggttatatatgtcccagatgcaaagttaatgtatgcgagcttccaacggagtgccgaacatgtggtctaacacttgttagctccccacatctggcacgatcttatcaccatctattccctgtatcgccgtttgatgaggtgacgttcaaattaggtcaaaagggaggacaaaattgtttcggctgccagcagagtctcattaacacaggtgggcaatctaatatccatgtccgttgtccaaaatgcaaccaccacttctgctttgactgtgatatttacatccatgagagcttgcataactgccccggctgcgagagtcagcgcagttcatctcgatagggacaccatggtgtgcattgttcaggtgttgatcctttttgagtcggagctgcgcattgttgtaagctttctggtgcactgacattgatgacagtattgctggataatcaaacagtgtacaggtaacacctggcatccttttttc

SEQ ID NO: 83 - DNA, 1505 bp, Hordeum vulgare
acgttggacgccagatcccctctcttctcctccccgtcacctcccccaatccccactttccccacacggccaagggaaaatggcgccgtccacctcgtcggcgtccgccctcatccacctccctggcctgcctcccaggagaccccatagtggcgggtgccggaaccagacgcggcggccgcgccatgcggccgtgcagtgctccttcgcgttcgcgcccgtggagacggcgaggataaaggtcgtcggcgtaggcggcggcggcaacaacgccgtcaaccgtatgatcggcagcggcccccagggtatcgagttttatgctataaacacagattcccaggctctcgtcaattcgcaggcacaacatccgttacaaattggagaacaattgactcgtgggctgggtactggtggaaatcctaatttgggagaacaggctgccgaggaatcaaaggaagtgatagccaatgccctccgagattcggaccttgtcttcataacagctgggatgggagggggtactggctccggtgctgctccagttgttgcccagatagcaaaggaagctggttatcttactgtcggtgttgtcacctacccattcagcttcgaaggacgcaaacgctctttacaggcacttgaagcattagagaagctggaaaggagtgttgacacactaattgtgataccaaatgatcggttgttagatattgctgatgaaaatatgcccttgcaagacgcgtttctccttgcagatgatgtccttcgtcagggtgtccaaggaatatcagacataatcacgatacctgggcttgtgaatgttgattttgccgatgtgaaagctgtgatgaaaaattctggaactgccatgcttggcgttggtgtttcttccagcaaaaaccgcgcccaagaagctgctgagcaggcaactcttgcccctttgatagggtcatccattgaggcagctaccggtgttgtgtacaatatcactggcgggaaggacatcactttgcaagaagtaaacaaggtctctcagattgtgacaagcttggccgacccctcggcaaacataatttttggtgctgtcgtagacgaccgttataacggcgagatccacgtgaccatcatcgcaacaggatttccgcagtccttccagaagtcccttctggctgaccctaagggagctcggatactggaggcgaaagaaaaggcggctagcctcgtatcagctgctgtgcaacaaccgacgccggcggccgtcccgacatggtcgcggaggctcttctcctgaacaccgttcagcaggcacaaacaaccttgtgaagctgtggttctcactttatcaaggcagtagagagttagccggtgcggtgtaaacactctgaaactagtttcgcgtagtgattaggttctcgcctggtgtatgtattgttcagaagtctcttgactcggttgttttagaaggtgttctgttcgttgacagctttggcaaccccagggctcgc

SEQ ID NO: 84 - DNA, 2398 bp, Gossypium hirsutum
ttttctctctcgagatttttgaatccccgtttctaaaattccaatctttcccttcttcttctcggaatttgacatggacggtgtgacggtggcgtcgacgccttcgccgtcgtactctacgacggcctatgtgagctgggacgaggtgaatgtttcaagcgataaaggaaggagagtggttcactattatttgaagagaagggacggcgtttcagatctggctgtgattggtaaagaaaagagcttgaggcacatgtcttatcatttcgctattaagaaccgttctcttttcttctcttcgacttctttttacaagctcaagtctcgccgggaggtcgtcaattggcttaattctgtcgtttccgattcttcttcacgtgagtctcactgttcagttgatggcatttggaatggaaaggacgtgaaaagtatggattttggagccgtcaaggatcttcagtcacaaaagctggtccaaaaagaatttttatggttaggttcttcgtggacgtgcaagagaaaaaagaaacactatgagtctttccgcaggaatggtgtaataatttcggttcacgacttcgtttatgtcttagctgaggagaataaacgacttgttgcctatttggaagatttgtatgaggactctaggggcaacaagatggttgtggtacgatggtttcacaaaattgatgaggttgatattgaccttcatcacaattataattgcagagaaattttcttttctcattgtcttcaagatctcagtattgaatgcatagatggattggctactgtccttagtcctttgcatttcaagaaatttttgaatgaggcaacacacactcggctggagccatttgtatgctgcaagcaatttgaaaatgatgttaagccttttgatgtgactcaagttaagggttactggaaacaagatatacttagatatatgtatggtctttctccttctaatgattgtgtgactcgtcagcaacgtgctgacgacctgaaaactgtttgggatgttgatgacgatgttgggattaggcctagaaagagatattgtcgatcaaaagatgatgatatgcacatgcatttcagtggcagtagagagtcaatggatacatcatttgcagatgtgcaagactttcacaaaagcaaaaatggaaatgtatcattcaatttcagtggtaggaattttgcgttcctgtccactggtgaggctaagcaatattcttctcaccatttaatggtaggttctgaggttgaagtgctaactcaagatagtggtatgagaggttgttggtttagagctcggataattaagaagcacaaaaataaggtgaagttgcaataccaagacatccaggatgcggctgatgaagctaacaaattagaggaatggattttggtaaccaaggttgccacttctgatgaagtgggtattcgtgtttctggccggacagctattcgaccgtcttcacaattcactaaaggtagtacttcatgtattggtgttgggtctgttgttgatgtctggtggcatgatggttggtgggaaggccttgttgttcaggagttggaagataaatttcgtgttcatttcccaggagaaaagcgggaatcagtctttggtatcggtgatataagacaatctcaggaatggctaggaaatcggtggataaatatgaaggaaaggcatgatcttgtgagtaccatactctgggccggaaagcaagacgcaagcaaatcctataatttcaataccgacaaaaacaccatttgtgagagtggacagtgtggtaaagaagccactgagtgtaaaggttctgctgttgaaccaggaaatgagagggcacaagatgcgagtgttgttccagatctttcaaaggatggtcggctttctcagttgaagtggaagtcatctaggaagagaaaacgtgtgacttcaacctgtgtacggaaactgaattgcagtcgaaacctcatcaaaagcactgcacagtcagttgcttgtgaacgatttttgatccctgcatccttaaaagtcgataatgagaactgcaagaacataggtgatccgttattcagttcttcagtagtgccgccgctaacaagcttggtaatgactaggtgattggagttgttgctttctgttttgtttggaagtgttaatttcggaagtctggcattggggcatccatctccctctttttttcttgtatgtaactttcagcctatggggctctaacttatagagtcttgcaaatttcaggctacagttttggatgcattataataacctggtagatctctaacttactaagcctcgtttgtctaggatgtttccattaggatctctgcttgttttgtattctatttattgtttttggaaataaaa

SEQ ID NO: 85 - DNA, 1414 bp, Gossypium hirsutum
agcgttttgttctttgcttgcagcgttgaaaagattgaaaatggctgctaccttctttaggagactctccaaagccaccccagctaccttcaacaatgcatttcgaggtcaacccaagtccggttttgctggatttcgcttctgtaccatcgccgccgttgccggtggaatctctacttactactgcttctccgactcaaatttggttcatctagatcaagtcaatgaagagactggtccaaaagttgctctgaaatctgataagtggcttgaatttaagttgcaagatactgcaagagttagtcacaacactcacttgttcaggttttcatttgatccctctgctaagttgggattggatgtcgcttcatgcatccttactagggctccattaggacaagatgctgaaggaaaaaccaaatatgtcatacgaccgtatactcctatatcagatccagatgctaagggatactttgacttattaatcaaggtgtatccagaaggaaaaatgagccagcattttgctagcttgaaaccaggcgatgtagttgaggtgaaagggcccattgaaaagctcagatactcacccaatatgaagaaacacattggcatgattgcaggtgggacaggcataactccaatgcttcaggttattgaggctatactgaagaaccctgatgacaagactcaggtgtcactgctttatgccaatgtctcccctgatgatatactgctcaagcagaagcttgatatacttgctgctagtcatccgaatcttaaggtattctacactgtagacaatccaactaaaacttggaaaggaggtgctggattcatttcaaaggatatggtcacaaaaggcttacctggtcctgctgcagatactcttatccttgtatgcggtccacctgggatgatggaacacatatctggtgataaggctaaagactattcacaaggagagctaaccggcatactcaaagaactcggatacactgagcaaatggtttacaaattttgagtaaagaggaattcaaggatttgaagagacgacactctcatagggtttcaacataaattttgtgtaataaactttcctgaaagaacaatgaattgggcagaatttaaagcccagggtatcgaataatatttgtagtgaaacaaacaatgtaaattagtacattttcacaggcttgtactagtgaaatcgtgacacagagcttttaatgaaaccctgcaatcagttgttgggtgggtataatgtctgaatcagattggttacaatttgagcagttggtcattttaagcaatgattgaacagaccagactggctagttgtagaccggttgaacggtatggatcggttgaatcaatagttgaaggtgttttaaaaaagaaaaaagtaccgactgcg

SEQ ID NO: 86 - DNA, 2696 bp, Gossypium hirsutum
tctctctctctctctctctctctcgcgtcggtcgtttcttttcttttcatttctttaggagggtggtcaatatggggtcttcgattttgccagatctcggagctgagatcttgatccccgtttgcgccgttattggaattgccttttctcttgtacaatggcttcttgtttccaaggtgaagctctccccgggtcgagactcgggttcccccggtaacaacggtgcgggtgggaaaaacggctattccgattacctcattgaagaagaagaaggtcttaatgaccataatgttgttattaaatgtgctgaaattcagaccgccatatctgaaggagcaacctcatttcttttcaccgagtaccagtatgttggcattttcatggttgcttttgcaatcttgattttccttttccttggctcggtagagggtttcagcacaaagagccagccttgcacttatgacaaatctaagatgtgcaaacctgctcttgccactgctatattcagcacagtatctttcttgctcggtgctgtcacttcagtagtttctggctttcttgggatgaaaattgctacctatgctaatgctcgaaccaccctggaggcaagaaagggagttgggaaggcatttattactgcattcagatctggtgctgtcatgggctttcttcttgctgcaaatggtcttttggtgctttacattgccatcaacttattcaagctctactacggtgatgactggggtggtctttttgaggcaatcactggttatgggcttggaggttcgtccatggcgctttttggaagagttggtggaggcatctatacaaaagctgctgatgtgggtgctgatcttgtaggcaaggtggaaaggaacattcctgaggatgaccctagaaacccagctgtgattgctgacaatgttggggataatgttggtgatatcgctgggatgggatctgatctttttgggtcctatgctgaatcatcttgtgctgcacttgttgtcgcttccatctcttcttttggcatcaatcatgaattgactccgatgttatatcctctcattataagttccgttggtatcattgtttgtttaatcaccaccttatttgctactgatttctttgagatcaaggctgttaaggaaattgagccatcattaaagaggcagcttatcatctccactgttctcatgactatcggaattgggattgttagttgggtagctcttccatcttcctttaccattttcaattttggagatcagaaagctgtgaagaattggcagctattcttatgtgttgctgttggtctttgggctggcctaattatcggttttgtaaccgagtactacactagcaatgcatacagccctgtacaagacgttgctgattcctgcaggactggagcagcgactaatgttattttcggccttgctttgggttacaagtcttgcattattcctatttttgccattgcaatcagtatttttgttagtttcagctttgcagctatgtatggcattgctgttgctgcccttggaatgctgagcaccatagctactggattggctattgatgcttatggtcccatcagtgataatgctggaggcattgctgagatggctggcatgagccacagaattcgagagagaactgatgctcttgatgctgcaggaaacaccactgctgctattggaaagggtttcgccattggttcagcagcccttgtgtcccttgccctctttggtgcctttgtgagccgtgctgctatttcaacagttgatgtattgacccctaaagtttttattgggttgcttgtcggggcaatgcttccttactggttctctgctatgaccatgaagagtgtgggaagtgctgctttgaagatggttgaggaagtgcgtcggcaatttaacacgatcccaggtctcatggagggcactgctaagccagactatgctacctgtgttaaaatctctactgatgcttccatcaaagaaatgatcccacctggtgcgctagttatgctcacaccccttattgttgggatcttttttggtgtggaaactctctccggtgtccttgctggatccctcgtctctggcgtccagattgctatctccgcatcgaacacagggggtgcttgggataatgctaagaagtatatcgaggccggtgcttcagaacatgcaagaactcttggtcccaaaggatcagaaccacataaggcagctgttatcggtgacaccattggggaccctttaaaggatacatccggaccatcactgaacatcctcatcaagctaatggctgttgaatcacttgtctttgcacccttcttcgccacacacggtggactgcttttcaagatattttaagtaaaagaacacaaaaacggttccagtctgccggttctcttccaaatctcctttttttttcgtaagtatagttttagtgtgtagcacattttgacatatcctcttaaaggttgaatctatagcgaaaattttcccttgtaaaaggttgacaatgaaatcaatgatgatgatgactatgataatggtcaatctagaaaagagttaagaactgtattgtcactttcttttgttctatggaagaaggcgttttgtttgtattgctgtgaaattcatgttataaattgcaggcaaaactcaacatttgaatgtatg

SEQ ID NO: 87 - DNA, 1192 bp, Gossypium hirsutum
tctctcaatctttatctccttcaattgtttgtttttgggttaaaaagctctgtttttttattacccttttcatcaaaaagcttcaatctttcgaccatgttgcttaaagcttcccctgctttttctttgttgaagaatccccaagttgaaactcgggttcctctgttttcaagaaacggttctgggtttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtatgcctattttgatagggacaacgttgctctcaagggtcttgccaagttcttcaaggaatcaagtttagaagagagagagcatgctgagaaattgatggaataccagaacaaaagaggtggacaagtgaagctgcaatccatattgatgcccctctctgagtttgatcatgcagagaaaggggatgctttatatgcaatggagcttgccttgtctctcgagaaactaacaaacgaaaagctcttgaacttgcacaacgtggctgagcgaaaccacgattcgcagttgactgatttcattgaaggcgagttcttagctgagcaggtcgaatccatcaagaaaatatcggaatacgtggctcagctgagaagagttggcaaaggacatggggtgtggcactttgatcaaatgcttctccacgagggagctgttgcatgaaaacctgaccaaagaaaccgccgcttgcttctgataccagccatcgttcttttaagttcccgtgttagtagttgttgagagattaagttttgcaagttgtatggctagtttagaaaactttgtgttgatgatataagaagattgagagactcgaagggataatttgtaagtcctcttgatcatagctatagattttcatggttttcgacttttcgtatcaacatttttcgactgttttttcttcggttaaatgctctgcacagttagcagataaaataatacaagtagggatcattttgaagtttggattgtgtttctatgaatgaaaaaaacgaagctatta

SEQ ID NO: 88 - DNA, 1400 bp, Gossypium hirsutum
ataagtatttgaaagttctctcttatttaagtcctccttccaaagccgaaaagccaagcaaaatttcactatctaccattttggcatatatgtttttaagttagtacttggctcttcttttgttcggaactctgttttttttagtgaagtaacatctcttgttcattaagaaagaaaataaggttgtgttctttctttgaagtttgaagaatcaaggagagtgctttgtgggtgagaaaatgtatgcagaaacagggttgtttttcccttacatgcagaaattttctgaagattttcagcagttcatagattactgcaaatcccagaaacccaatgcttccacgaacaacctggttcagatttccacaatatccgagtatgaccttggaggagaaggtgatctgttcaaagctccagagccaatcattgaagaaccaaatctggggcttgatcccatgactgctgccatctcattaatctcatgtggtgaagatgtcattacttcccaaggacttaaggctgctgatattgaatcaatccaaaatgagcaacttttagaggttctctatgagtgtgaaaaggatatgatggcaaaagcagctatggaaacaccactgtccgaggtccttgatatcaagattcctgttgtgaagatcaatgaaaaccaaaatcttgaaaacaaagtgctctctgatatcccatttcagaaaagtgtcagctcgagttgcttaaggtcaatggagtgggtgcaaggagctgtaatcaagcctaactttctggattttcctggaatggattttggttctgtttatggaatgaggagagcttttagtgaaggagatatacagactcttggcaatgggaatgggagcgtcatctgttctcctcttgagcgaccaataatgatcagctgctgttctactgaagatcgaagggaaaagctttccagatacaggaataagaagaccaagaggaactttggaaggaaaatcaagtacgcttgcaggaaggctcttgctgacagtcaaccaaggatccgtggaaggtttgcaaagactgaagaatctgacaactccaagaggcagtaattgttgactaattccaaagtaaaacaggaatgaagtagctagaccctagaggtgatggataatatatatatgtatatatatctcagtagtgtcaacttggcgcgcacacacatatatctatatatataaacctttgtggaaatcttatacagagttgatgctaaataaaccagaacgtagatcctgagaaataattctatcttatttgctgtaataacctcctctcctctccaagtaggatgtacatagtgtttgttcaataaaatgatggcaaagcagaaatttgcacttgttcaataaaaaaagaaaaaa

SEQ ID NO: 89 - DNA, 973 bp, Gossypium hirsutum
ctcgaaccacataataaaaatggcgatgtgggtctttggatacggttctcttatttggaaagctgggtttaactatgatgatcgtcttgttggtttcatcaaggactatcgccgtgtattctatcaagggagtactgatcacagagggacgcctgagtatcctgggagaactgtcacattggagcctgctcctggggaagtctgttggggagctgcttacaagatatccaaggaggaagataaagaaactgcaataacgtatttagaagtgagggagaagcagtatgacaagaaagcttatgttgatttcttcaccgatcccttagctacaactccagccatttctggagtaatggtgtacatagcatctcctgacaagaagcttaatccgaactacttggggcctgcttctatagaagacattgccaagcaaattgttcgtgcggaaggcccctcgggaccaaacagagaatatcttttccaactagaaaaggctcttcttcagattggttgtaaagataaacacttaatggatcttgcaaacgaagcaaggcgcattctttcagaatccgagcatactgcatcatgatgcaaatttgttggaaaggaaaaatgagagaataaatcacaaacctaggaaaaagcatgaatggcattatagatgttagcatcatggaaattgcatgttcctccatgttttgctctggaccgggacacacaccgaaacatagtttcttatagtgtgggacacagtcaccccaattctacaaacaataacttcatccccacaagcaaacagtttctgaaagtgggcgttttccatatttttttccttcatttctaattcgggtatttttccctattaaacctgcttgttcttcgatgacgaaagctatgttaacgtttgattcatcgttgtcccactatgatgatggatttgtttatgaaaaagttaattaaatatgtaagcaag

SEQ ID NO: 90 - DNA, 2260 bp, Gossypium hirsutum
tgcagttggcgctggctttgcgggtttcttcgctggctgcttctgctgctgattccaacttcttggatttcaattctgatgctaacaccaacagagtttcctcctcctcttcctcttcttcttcttcttcttcttcacctcagcatgtgtctcatcgattctgggtaaatggcattctatcttactttgatagacttccagatggattttaccaagtcaatgggatggatccttatgcatggactataagtgctgatcaaggagagattggcctgatgccctccatcgagtcattgagggccattgatccgcatgctgatttgtctattactgttgttctgattgatagattaagggatcctagtttgaaggaacttcaaaattgggttctcaaaatatctagcagctggatcagcacaaaagatgcaattaatcagcttgcatgtcttgtctgtaaccgaatggggggtgcagcttcttctgaagaagatgtttatagccaatggaaggagtgcaccgaagttctgaaaaactgctcaggctctatcgtatttccaattggaagcctatctgttggcctttgcgtccatcgtgtgttactgtttaagatattagcagacttggttaatctaccatgtcgcatcacaaagggttgcaaatattgcaggagggaagatgcttcatcctgtcttgtgcagttgggtcctgacagggaatatttggttgatttgtttgaggagccaggagccttaagtcagcctgattcctcactcaatggtacttcatcaattttagtttcttcaccgctgtgtcatccaagatttaaaccggttgagattgctacaaacatcaagacattggccaaactctatttcattgatgatcaatcccataaacatgcttgccttgatgcttcctcagacaatgctagcaatcaaaatgagcaaactggtccacagcctaggaaagcatttgatagaaactactttaacaagaacaaccccttttccaccttaagcaacaacaaagaatcttctctttcacctctgcaccagagcactttgtggaatattggctgtgataaagatcttcagatgctgaactcttcaaaattgttcccaaaagccatcaactcaacacacttgatcagaagtcctcctctgccaagttctgttacttctcacatgcacaaagatgtttatcaagcttttccatactcagatccaatgcaatgtactattaacttcaagcaatcagatgatccagtaatgagctttgaccaggaagatctaaatattccttggagcgaacttgttttaaaagagagaattggagcaggttcttttggaactgttcatcgggctgaatttcgtggttgcgaagttgctgtcaaaattctcatggagcaagattttcatatagaacgcttcagggaatttttacgggaggtttccatcatgaaatgtttacggcaccctaacattgttctgtttatgggtgctgttactcaaccaccaaagttgtccattgttactgaatatttgtcaagacggagtctctttcgacttttgcagatgcctgatgcttggaaggttttaaatgagaagcttcgcttgaacatggcattggatgtggcaaggggaatgaattatcttcatcaacttaagcctcccattgttcatcgggacttgaaatccccaaatcttttggtagacagtaattatacggttaaagtctgtgattttggtctttcacgttctaaggcaaatacatttctttcatcgaaaacagctgccggaacaccggagtggatggcacctgaagttctatgcaatgagaattcaaatgagaaatccgatgtttatagctttggagtggttctgtgggaacttatgacactccagcaaccatggaagcatttaaacccaccacaggttgtggcggctgtaggtttcaaaggtgaaaggcttgagatcccaagccatgtaaaccgagttgtagcttccttgattgaacagtgttgggctcgtgaggcttctgaacgccctcccttctcccatgtcattcaatgtttgcagcaagtcatccaaaatactgcatctcaagaacttaatggactaagtctttgatccacaacatatatgggtatgtccaatttttcatgcaaatatatgaaaactttagacaaaattcaacataattgtattaacgcatatccatattaaagacttgccctaatccaaatcacatgggtgatatc

SEQ ID NO: 91 - DNA, 1385 bp, Gossypium hirsutum
aacgcagagtacatgggaccgaaatgaaaggctaggctaggctgatatcttttttccatttctcccgctataaatatctaacctaacctcacagctcttcttaaaccctcctcctcctcttccatttcgaaaaccttatcttttgagaacgaaggttaaaggaaccacaccagccatgtctgcaacatctgcctcatctcttattctcccatcgctcaaacccaaagttctatctttatccgactcaactcccaattcactttccctcttctccctttctccaaccccccatgcaaagcctctcttttgttctgctcttccaagtttccagcttttaaccaaaaagtcctctttttcttccaggttccttacaaacgttgccgtttcttctgagtatgaccaggaagaggacttatttggcagcgatgatgaagaaaggtctcctactttctcccctgacttgaaactttttgtgggtaatcttccttttactgtggatagtgctcagcttgcgggtttatttgaaaacgccggaaacgttgagatggttgaggtgatttacgacaaggtaactaggagaagtaggggatttggatttgtaaccatgtccacaatcgaggaagtcgaagctgctactcaacagttcaatggctatgaattggaagggagagcattgagggtaaactcaggacctcctcctcctcgtagggaagaattttctcctaggggagcaagaggtggtccttcgatgggagcaaggggtggtccttctatgggagcaagaggtggtcctcctatgggagcttcaaatcgtgtctatgttggtaacctttcatggggtgttgatgatatagcactcgagaccttgttcagtgagcaaggcagggttgtggaagcaaaagtcgtttatgacagggaaagcggtagatcaaggggttttggctttgtaacttacagttctgccgatgaggtcaacagtgccattaaatccttgaatggttgtgatttggatggaagaccaattcgggtcactgtagcagagtctaggccaaggcgccaattttgagtgcggatatttcctactgatgctgctaaaattctttggggacgcctaagatatgcagccggaagctggcaactgcagtcttttcctgttcgtgggattctgctcggctgcatttggacgttatggttgatctggctgctttttacactaggaaaagctgataatatccatttaaatgtttttattgtatgtttcaagtatcttatgattgggtgactgacaatgtagcctaatgtttcgcctcattggatatagttgcttcaaattattgacatgtttggctcccttgtacaaccttgtggtggaagaaggccttttt

SEQ ID NO: 92 - DNA, 1514 bp, Gossypium hirsutum
gcggccgcgtcgaccaacatttcttttttcattgaaaccaaacaagaagaaagaaaaagtatattttttttccgaggatgatttcttcctggagaaagagaagagctggtaagcgtgcggggaaagagcaggcaaggaatgaaaatggtgaaatggagctaacaattcctagagattttaggtgtccgatatcgctggacttgatgaaagaccccgtcacgttatcttcaggtataacgtatgatcgacccaacatcgagaaatggatcgaagccgggaatttcacttgtcctcttaccaatcgagtgttaaggagtctcgaacccatccccaaccacatcataaggaaaaaaatccaagattggtgcgtcgagaatcgatcccacgggatcgaaaggatccccacgcctcgtgttcctgttagttccatggaggtttcagagattctttcgaaaatcgacatcgcttgtaagaagcaagatggggcagggtgccgagatttggtggcgaaggtcaagtcattggccaaagagagtgaacgtaacaagcggtgcattgtgagtaatgggacaggcaatgttttatcggaagcgttcgcggcgttttccatggcggctttcgacgaaaacgtctcggtcttggaggagatattatcggctcttgtaataatgttccctctcgatggtgaggccaagggtttcttaggatcagcttcagccatgcattgtttgataaggtttttaagcagcggagacttgtctaggagacgaaatgcagttttggccttgaaggagctcgtttcatcaatggaagatcaaagaaaaatactgaatcagttatcagagatggaaggcgccattgaagcattattgaagcttatcaaaagcccaatttgctcaacatcaacaaaagcatcgttaaccatcatttaccatatgatcacatcctatggtaacgaaaaacaagtgggtaataaacttgtaaacctaggcatagtcccattgctgctagaaatgctcgtggacgccgaaaggggaatgtgcgagaaagccttgggtgtcctagatggaatcttcgacaccgaacaaggcagagaaatggcctgcaagaatgccttgacgatgccggttttggtcaagaaaatcctcagggtttcaaccatggccaccgagttttcagtctccatcttatggaagctttgcaagaacgagaaaaaggaagatggtggagtccttattgaagcactccaagtgggggcttttcaaaagctgttgctgctattacagcttggttgtgtggagaagacaaaggacagagtttcagacttgttgaaaatgttaaacccttacaggagcaaaatagaatgtgttgatcccatagaccatttcaagggtctcaaaaggcctttttaaggaaaaaaaagttttggttataattttacagattacaattcaatgtacaaaagacatagattgaagtacatagttcccattattctttgtagacgcggccgc

SEQ ID NO: 93 - DNA, 2185 bp, Gossypium hirsutum
aaaaaaacataacccattaagtcagtcactgcacaaattgttccaaaaacagcttcaaacatatcttagtttgtctaaatatttaacagctaaagctaaaggaccatggcagtgacagtctctctttctgtctcccaccttcccggctgcaaagttcatgatttctctcatctccccaaaccaactaacaaagacaacccatcttctaaagcctcctctgacatcaaattaagcaaaagaaacctgttgttgagttcaatggcttcgggtcttattggaagaggtgtcttcgttggtgagccggtaaaagctgaaccagagaccccaatggaaagctcatcaagtagactatcgtattcaaggtttctgcagtacttggatgaaggtggggtgaaaaaggtggacttgtttgagaatgggactgtggccattgctgagatatataatcctgcattggagaaaattcagagggtaaaagttcagttgccgggattgccccaagaactgttgaggaaaatgaaggagaaaaacgtggacttcgccgctcatcctatggagatgaactggtcggctgctttattcgatttgttggggaatttggcctttcccttggtatttcttggcactttgttgctaagtagctcatctgttaataatcctggaggaggtcccaacttgcctttcggacttggaaggagcaaagccaaatttcagatggaacccaatacaggagtcacatttaacgatgtagctggtattgatgaagccaagcaagattttcaagaggtagtggagttcttaaaaaccccagaaaaatttgcagcaattggtgccacaattcccaaaggagtgcttctaattggacctccagggactggtaagacattgctggccaaggccattgcaggggaagcaggggttcctttcttttccctttctggttcagagttcatcgagatgtttgtaggcgttggagcttccagagttagggacctgtttaacaaggcaaaggctaagtccccatgtttggtgttcatcgatgagattgatgctgttggaagacagagaggaactgggattggtggagggaatgatgaaagggagcaaactttgaatcagctgttgactgaaatggatggttttactggtaatactggagttattgtcattgctgctactaataggcctgaaattctggattctgctttgcttaggcctggaagattcgatagacaggtaactgttggattaccagatataagaggaagggaagaaatattgaaggtacacagcgacaacaagaggctagataaggatgtttcactcagtgtaatcgccatgagaacaccgggattcagtggtgctgatttggcaaatctcatgaatgaagctgccattcttgctggtagaagaagcaaagacaagatcacgatgaaagagatcgacgattcgatcgatcgaatcgttgccggaatggaaggaacaaagatgacagatggaaagaacaagattctcgtggcgtaccatgaagttggccatgctgtatgcgcgacattgacaccaggccatgatccagttcaaaaagtgactttgatccctagagggcaagctcggggtctaacatggttcataccaattgaagattcagatctcatttcaaaacaacaactctttgctagagttgttggagggctcggcggtcgagcggccgaagaggtaatctttggtgagccagagattactactggtgcagcaggggacctgcaacaagtaactcaaatagccagacagatggtgacaaagtttgggatgtcagaaattggaccatgggcgttaactgatcctgcagtacaaagcagcgacgttgtgttaaggatgctcgcgaggaattccatgtctgagaaactcgctgaagacattgattcatcggttaagaaaataacggaaactgcatacgagattgcaaagaaccatataaggaataaccgtgaagccattgacaagctagtagaagttttgttagagaaagaaactcttacaggatatgagttcagagcaatcctgtcagaatttgttgatgaacctgtaataaaagtagatagaactcctgttcgtgagatgatcaacgcttgagtcgctatatacatgtaaataaatttacacgttattctataaaatatatatt

SEQ ID NO: 94 - DNA, 1553 bp, Gossypium hirsutum
atggactgaaggagtagaagaaagaacagaaaaaaaggaacaaaagatgggtgaggagcagcagagaattcagattcctagaatcaaactgggaactcaaggacttgaggtttcaaagttggggtttggctgtatgggtctcactggaggttacagttgtccagtctctgaagaagttgggatatcgattatcaagcatgcattccacagaggaatcactttctttgatacatctgatatctatggacccaaaactaatgaaattttggttggaaaggcattgaagcagctaccaagagagaaggtacagctagccacaaaattcggtttcgaaaaactggattcaacaggtatcaaagtaaacggtacacctgaatatgtccgtgcctctatcgaggctagcctaaagcgcctagatgtggactatatagatctctactaccagcacagagttgacaccaacactcctatagaggatactatgtctgaactcaagaagttagtggaagaggggaaaattaagtacataggtttatctgaagctagccctgaaactataaagagagcacatgcggttcatcctataagtgctttccagacagagtggtcgctgtacactcgtgatatcgaggatgaaatagtccccctttgcagggaacttggaattgggatcgttccttatagccctcttggtcgcggtttctttggtggcaaaggagtggtggaaactgtgcctgcaaatagtcatctgctatatttcccaaggtttcaaggagaaaacttggacagaaacaagatgttgtatttgaaagtggagaagttggctgagaagcatggatgtagccctgcacaattagcacttgcctgggttcttcatcaaggggatgatgtagcaccgattcccggaacaacaaagataaaaaatctggatagtaacattgattcagtaaaagtaaagctcacagcagaagatttgaaagaaatttctgatgcggttccgataaatgaggtagcaggtgatgttttgcctgatagatttagtcaattacactggaagtttggtaatacaccaccaaaggggagcaaagtttcaacctgaaaaaaaccatggatgccaagtctgcagcaaaatatgaagttttggatgaacggactctccaacaactcaaactattgaaaaattgtatcaatgatttagtaagcaatttggttagagtactaatgaagggttgagtgagagtagaagcctgcattaccaaaccaaaacaaataagcagttttgtattgtgtttctgcctgtgatatgtagctagtaatcttccaagttatgtagtttgaaaatgaaccaggttgtttgtttatcacctgaatgctgctagtaacagcagcattattgtattaggtttctactacctgctttacttggagaaataaaaaaatatctactttttccagaaaaattaacacaagtgtaatgcgtcccttgctctaaatctattaaaattattgatctcttttgtttcatttcatatttacatgagtaaaatctgtat

SEQ ID NO: 95 - DNA, 1127 bp, Gossypium hirsutum
acaaaactaaacccaaaaaaacttctgttgttgtcttcaatggtactcttggtacaaaggcttagtaaattataccacaagctggaaaatcactaccaccaccaccaccaccaccaagcagaggttgatgctttgtcagcctctctacaggcttttcggtctgatgtttcgaattgtgtgaatcagttgttgcatccagaacctggttcagaaatcttgtctttttcatggattcagcgatgttttgagttacttcctgttatcaacaaggcgtttttgaagctggttggggatatagactaccccatgagctgctgggatgttgcttccctcgatgagtatcttaactacggcttgcatttactggagcttctcaactgtgttacttcttctctttctcacttggcacaggctcggctttcctttgctcatgctttgaaccttgtggagagttcaccttctacggcgattgaacatctcaaagcaatccagtcccaaagttcaagcaaggacttaaagggactagtgagaaacaaggaaggtggtgaggggaaattgtcttcttgcaaggaaagggtagtccatgaagctttgatggaggtaaagagtgttgggttatgggtatttggggttgttttggctaccttgtctggagagaccaaaccatacttggagatcaaacaagtgattgtcaggttcaattctgctttgttaattgatgtagattcatgtgtttttaaggttatggtggagaaaggtgagacattaaaagaggttaaggagctgaacagtgcagcaaattccctagtatcagcaatcctttctgggaaaaccagtgttgcagccatggatttcggtggaaagttaggtgttttcgagaaggagatggatgctttagaaaagcaagtggatgccctgttttcgagtgtattggcagccagaaatgaactgcttaacggtgttcggcaacgcaagcaataacatcaaatccccagtttcttatgtaaatagaagaaaaaatatgcacatacagatttgtgtgacattttttttatatattgtatcttcaaaattattaatggaaatagaacagtttttcttgctaaaaaagaaaaaagtaccgactg

SEQ ID NO: 96 - DNA, 2807 bp, Gossypium hirsutum
tttttttttgccctactgtgtggccccttaaattctttcttctcaacaggttctgatgcattccatctttcaaggactatacttggtctgcgtttttctagcgttttctattgttgggttttgcgttttggggctaaaggcttttgagaaacgttttttctttcaagttcaaccatgcctgctcttgttaattacagtggtgatgatgatttctataatggagggtccttttatacaaattctactgacttgggtagattgtgttcaatcagtttccaagttgatgtgtactgcccgcctcgtaaaagaacgcgtattagtgccccatttcacttcggagaagctgaggttgagcagaataagcaaccatcgatcgatgtcctccctgatgaatgccttgttgagatctttaaacgcatttctgggggtaaagaaaggagctcctgtgcttgtgtctctaagcactggcttatgcttctgaccagcattcgcaagggtgaatatgagtcatcaaaggtggtcaaggagaacgttggttcgaattcgggtgatgttgagatgatcttatccgaggaagatgatgggtatcttacaaggtgcttagaaggaaagaaagcaactgacatgaggcttgctgcggtggcggttggaacaagtggtcatggtggtttaggaaagctttctattaggggaagcagctcttcacgtggagtaactaatttcgggctgtctgccgtagctcgtggttgtccttctctaaaggtactttctttgtggaatgttccgcgtgttggagatgaaggtctgtgcgagatagctaaagaatgccatttgttggagaagcttgatctttgtcagtgcccccacctttcaaacaaggggctaattgccatcgccgccaactgccctaatctgactgcgttgagcatccaatcttgcccaaagattggtaatgagggcctccaagctatcggaaagctttgccccaagctgcagtccatctctatcaaggactgcccacttgttggggatcatggagtttcaagcctgttgtcatcagcatcttccgtcctttcaaaggttaagcttcagggtttgagcatcacagatttttctcttgctgtgatcgggcactatggcaagtctgtgactaatctaatgctgagtggtctacaaaatgtgagcgagaagggattttgggtgatgggtaatgctcagggtctgcaaaagttggtctcttttacaattgcttcttgctggggagtaactgatgtgagtcttgaagccattggaaagggctgcgctaacctgaagcagatgtgccttcgcaggtgttgcttcgtttctggtgatggattggtggcttttgccaagtctgccggttctcttgagtgcttgcagttggaggagtgcaacagggtcactcaatccggggttatcggtgttctctcaaactgtgggttgaaatctcttaccctagtaaagtgtatgggaattaaggatatatccttggaagctcctttgtcttcctcttgcaattcccttaaatccttgtctataaggaactgcccaggattcggaacagccagcctggctatggtgggcagattgtgccctcagcttcagcacgtagacctgagcggactttgcggcattacagatgcaggtcttctgcctcttctagagaattgcgaggcaggacttgtgaaagtgaatctgagcggctgcttaaacttgaccgatgaggtcgttttgcacttgaccaagctacatggcgcaaccctcgagttgcttaatctcaacggttgcaggaggattactgatgcaagtttggctgcagctgcagaaaattgtgttttcctcagcgacttggatgtgtcaagttgtgcaatcaccgatgtaggtattgcagccttgtctcacgcagagcaactcaacttgcaagtcctttcgttttcaggttgttcaggagtatcaaacaaaagcatgaccttcctaaaaaaattgggcaagaccctggtggggttgaatctccagcactgcaattcaatcagcacccaaaccattgagctgctcgtggaaagcttgtggagatgcgacatccttgtctaatcgggggtcgagccactgaacaactacacttctggcgttaaagacagtagaaatatcaatctcgtatagtcatctcccacgggtagcaaaaatatttggcacagtttttcggttcaactaagtagccatgcgggttggctctatgacttggttctttttcctggggacttaggctcttttgcagatggcctctatccatctcagttttttgcaggctttctatgtaaaagtctgttgtaaatcaaagcctcccttcacctgaggcgatttcatagccatggttcctggagaatttcatcatcaagttatggttttaagtttccaatcatcatcatcatagcttttggttgtatttctgttggatgtgccgttccctagtcggtgttttagctttcgttgttttcaatcccatgaagtatgttgtttatatcagtcgataaatatctttctttcaagtgtgttctagtgtgtgaaactcctctaaggcggtccttgagtgtttccttttcaactttggctatggtagtggatctctcatctgctataacaaccttcgttatggtcgtgttgttttgttttgttttgcaagtccttgtcttgtaggtttttccctgtatatatgaaactgcaactactttgttattatcaataaagcttgatattttactctaaaaaagaaaaaagtaccgactgcg

SEQ ID NO: 97 - DNA, 1946 bp, Gossypium hirsutum
ggggcttggatagctggatatcaaagaggaagaaaaaaagagtttattgagcttgaatataggtatctagtccttcacttcagctcaaagaaccaagtatggctgcagagtatagagagcccctgttaaagaagaagcactataagaactgccctggatgtaaggttgatgaaatgaaggaattggagcaaggcctcccaattcggccactgctttccatatggattattgttttatgcactgctctgccgatatcatctctctttcctttcctatacttcatgataagggactttcatattgctgaaagagaggaagatattggctcctatgctggttatgtgggatctgcatttatgcttggaagagctttaacatccgtatcatggggaatatttgccgatcgttatggtcgaaagcctgtaataattatgggaactacttcagtggttattttcaacaccctttttggccttagtgtaaatttttggatggctgtaattacaagatttcttcttggaagtttgaatggcttacttggaccaataaaggcatatgcagtcgaaatttttcgagacgaataccaagcattaggcctatcaaccgttagcacagcttggggcataggattgatcattggccctgctctgggaggttttctagctcagccagctgagaagtatccaaatctcttttccagagattcattgtttggaagatttccatatttcttaccatgcttggccatatcaatttttgccttggcagtaaccattgctacctgctggcttccggaaacacttcataaacacaatgacaatgatcaatcatctgatgattcatacgatgctttggaagctgcatctaatgaatctaacacaaaagatataacagaaaaggatgaaggaagagaatcgacttctaagcaaagcctcctaaagaattggcctttaatgtcatctatcatcgtctattgtgttttctcccttcatgatatggcctacacagagatattttctctatgggctgttagccctaggaagtatggaggcttgagttattcgacggagcaagtcggggaagttcttgcagtctcaggtttcagccttcttgtctttcaaatgtccctatatccatttgtagagaggcttcttggacctgtaatggtgtctcggattggaagtatcttagccatacctctcttgcaaagttatccttggatagccatgttatctggcttcactcttaccttggtgataaactgtgcatcagtcctcaagaatgttctatcagtatcggtcataaccggattattcattctgcaaaatcgagctgtggaccagcaccaaagaggagctgctaatggcattgccatgactggaatgtctcttttcaaagcagttggccctgcaggaggtggtgcattgttttcttggtcggaaaagcgtctagacgcttcatttctgccaggtactcagatggtatttttcgtcttgaatatagttgaggcagttggatttttgttgacattcgaaccatttctagctcaacataggcaataaaacaagggatcccaatggttgggataatgatcttttattttattttaagaatgcaaaaaagaagagaatactccaaaggcttaaatcttggtcaacaaagtatccagataccagctatgtcactcgggttcttaattctttttgaatattcatgtacgacactatgttaaatataggtatgaaaataacagcccccccaaaaatgaacacacctatgtcaagtcaaggcatatttgtatcgtgtacttaccactgaatctgaataacgtagcttatgagtatatttattcttgtctattgatgatatttagtcatttattgctcccaacaaggttttggcaaaatgtgattgcttttaatataaagactgtttagcagtttttg

SEQ ID NO: 98 - DNA, 3990 bp, Gossypium hirsutum
agagatctcaaatctttcttcttcttcttcttcttcttcttctccttcttcttgtctataccttcttcttttttctgaaaactcccaaaatacgagagtgaaagcaatgaaatcaactgcagaagccgccgttgccgagaatggccggtttttgggaagcatttcgacttcttcgcttcgaaatctgcttcctaaatcaaaacttaagaaaagtatcaagaaatccaactctgaaaacactcctccaccagatcccaacattattcaaataaataattctgctcagttttcccccaaatctccactctccaaatcgcttacttctgactccttcgtgaacccatctgacgctcatccccaaattccgctttctatggactcttccgtcaagaaagatatggttgaatccgaagaacaaaatggagatttgacgaatttagatccatccgccaaggtggtagtgagaattagacccataaatggtcaagaaaaagaagtggatcgaacagtgacgaaggtttcttcagattctttatcagtcggtggccgcaaattcacattcgattctgttcttgatgcaaattccagtcaggagaatgcctttcaactaattggtgttcctttggttaaaaatgcattagctggttacaacacttcagttttgtcgtatggacagactggaagtggaaagacttatacaatgtggggtccaccaagcgccatggttgaggacccttcacctgcgagccaccaggggattgttcctcgtatcttccaaatgctgttctctgagattcaaagggaacaagagaactctggtgggagacagacaaattatcagtgtcgttgctcctttcttgagatttacaatgagcaaattggggatttactcgatccaactcaaaggaaccttgagataaaggacgatccaaagaatggattgtacgttgagaatttgacagaagaatatgtttctagctatgaggatgtaactcaagttttgattaaggggctttcaagtaggaaggttggagcaactactgtaaattccaagagctctcggtctcacattgtttttacttttttcattgaatcttggtgcaagcagggagcttcatcaaaatgtttcagcagttcaaaaacaagcagaatcagcctgattgaccttgcaggattggatagaaacaaacttgaagatgttggtagacaacatttacaggaaggcaaaaatgtcaagaagtccttatcacaacttgggtatttggtgaacactcttgcaaaagaaactcaacctgaaaaacctgaagatgttccatatgggggttcctgtttaacacgtatattgagagaatcccttggtggcaatgccaaactcacagttatgtgcaatatttctgcagacaacagaaatacaagtgaaatactgagcactcttagatttgggcaaagggttaaagctgtcagaaacgagccagtaataaatgaaatatctgaagatgatgtaaatggcttgagtgatcagattcgtcaactgaaggaagagcttataagagcaaagtctgatgcatatagctcagttgggagtaaaagtggatattttaaagggtggaatgcacgtgaaagcttgaaccagttaagaataagccttaaccgctctctgatccttccacgcatagataacgaatacgaggaagagattaatattggcgaggaagatgtaaaggaactacgtcagcagctagattatttagatagctcttgtgagacaaacttaagagatccattggacaagagaggttccattcaatcttctgtaaaagaaagttgtgagacagacttgctgagtgaagatgacattcattgcccaaaagaaacagagatagaagaaattgatgaagtggaagttcctcccatgtccagtcctgagccagctgatgacctttcagttacatcaaaaactttgaaggctgttgatccttcaattagaaatagcatctccatcagcccacatcgtcggtcttcaatccttgaagagcctacattgtctgaatctcccaaaattgcaaataatctaaggaaaagcatggctgttccgtcagcacttttggccagtcagaaaaatgtatcagagagttcagagtcagaggtattacgagagttgctcaaatatagtgaccacatcaggtcctcattacgtacaagcaagacgtttttaggacctacagagtctttggctgcaagccttcaaaggggccggcagattattgatcaacaccagcatagttcagttcccaacagatcttcagttgccttctctttcgaacacctgatgctgaaaccttctccagaagcagacaaggccaatgcttctgttcaaacattaccaaatgacaaaccatctccggatggttcttctactcctttgttttgttcatcttgccaaaggaagtttgacaataaccaccctgatgaggttcaggatagcttgaagacatggattgtaacggttgataaccaacagagagatggcaggaacacagtggaagaagcctccaaaaaagagaaaacacttgaaagtgtttgtaaggagcaagcagccaaaattgagcagttaacccagctggtggaaaaatacaaacttgaaagagaaaattctgcaattgaacatgctcctgagcctctgaagaatgaaataatactgtttgatgagcagtccaacaatggtgaaaatggaaaagaatattttgatatgactgaaaaggaagcacttcttcaggagattcagacattgaagagtaaattgcagtcatatactgcttctccatctccaaacaagtctactgaaatactgaggtcctctttgttgtcacgttccattcaattgcgaaaaagtgtagactgtcgtaataacagcgaggaagaacttgagcgagaaagacaaagatggatggaaatggaaagtgactggatatccctgaccgatgagctcaggatggatctggaatctaaccgctgccgtgccgaaaaagtagagatggaactgaaattagagaagaagtgcaccgaggagttagatgatgctcttagcagagctgtcctcggtcatgctagaatggttgaacactatgctgatcttcaagaaaaatacaatgatctggttacgaagcaccaggcgataatggaaggcatagcagagataaagaaggcagcagcaaaggcaggaagcaaaggtcatggtgcacgttttgccaaatccctggcggctgagctctcagctcttagagtggaaagggaaagggagaaagaacaattgaaaaaagagaacaaaagtctcagaatccagctaagagacacagcagaggcagttcatgctgctggagaactcctagttaggctgagagaagctgagcaagctgcctcaattgctgaggagaactttagtaatgttcagcaagagaatgaaaagttgaaaaagcaagtggataagttgaaaagaaaacacaagatggaaatggtgaccatgaaacagtaccttgcagagagcagattgccagaatctgcactacaaccattataccgagaggattcagatgtagcagcatcacacaacagcagtgcaattccatatgatgatcaggcttggagagcagaattcggagcaatatatcaagaacattactaattcatctaaaacaaatctgaccttactttggtcagaatgaagatatgtatacctatgttgtttgtgagtgtcggatacgaatatgtatcttacacaatttaattcttttaaaatgttttttttttgttgtgtaaaagttacaagtcaatcttatacccatatccggatatatgtatgttggacatgggttagagcaagagggacacatactactattcttgtatttttattttttatttttgatcaaaatactactattcttgtattgaatgcatcatctctaataatatttatttttgagtctaaaa

SEQ ID NO: 99 - DNA, 1136 bp, Gossypium hirsutum
atttaacccaatcaacgctgcaatacttttcacacctcaaattttatttgaagcaaaaacaaatcccaaataacacaagctttgtttttgttttgatttctctgttaattagcaatgaataccagcagcaaagaatcgcagcctaattaccccactatctcacctgatgaatataccaaccctttccatcaacagccgcacatggaacctgcagcggccaccgcggcggcacccgcatcaacatcttcgtcgcctcctcctccacctcctccggaacagtctgagaaatgggggactcatatcatgggaacaccagctgttcccacatgtcatccagacaacaagaaagcagccttgtggggtgctggtgaccaagctcaatactaccatcatccatacctccaatattcccccgtcgagagatcaagcaataaccccatggattccatgcttcaagtcttcaacacctggagtcacaaagctgagaccatggccaataatatctggcacaatcttaaaacaggaccatctgtatcgggagctgcatgggggaagatgaacgtgacagccaaagcaatatcaggaggtggattcgaatcgctttataagcaaacattcgcaacgtattcaaacgagaagctgaagaaatcattcgcatgctatttatcgacttcgacaggaccagttgcgggaacactttacctatccaatatccatgtagctttctgtagtgatcgccctttgtcattcacagcaccatcagggcaggaaacatggagctattacaagataatgataccactgagcaaagtagggataataaacccagtgataatgagggagaatccatcagagaaatatatacagattgtgacagtggatggacatgatttctggtacatgggatttgtgaattatgagaaagcgtcaaagcatctgtctgagagtgtttccagttttgtagcaactgggattgctgttcaaccttcacctgttgcatcgtaaacacaggattttattatatttttcttttcatatttacaggccttttcttttgttttgagattttgggttcggcttgtcttagatttattccatcgattgtaccatttttgtaaaataatttattatttcgt

SEQ ID NO: 100 - DNA, 824 bp, Gossypium hirsutum
acgagcggccagtatcaacgcagagtacatggggatcataaaactcagaccccaattatcatcttccatggaatcccagaatctcaaacaccgttccagggatgaccctcgttttgccaccaccacctccaacgaaaagaacagagcaaacaggcgagaaaaaagaatggcaatggccaaacgtgggctaagatcactagtcatagcagtttccttccctttgtctctcaccttgttaaacatatacttgtttggttcaggtcgtggttacgcctctttagccaaacctttctggttccctcctttgtggcttttacatacaggttgcttggcttcgagcttcgtgatggggctgtcggcttggtttgtttgggttgaaggtgggttccacgttaaaccgacggctttgtctctttatttgggttacttaggattgagtatggcttggcatccgactgtgctttggatgggagctagctgggctgggttgcttgtgagtttggcgatggttgggaccttggtcgggtgttcaagagattttggaaaggtgaatccgattgctggtaactcggttatgccttgtttggcttgggctgcgtttttggccactgtaaatctaaaacttgtcttcctttgaagcatataccaccatcttttgttctgcaagaattctctcatgaataagatcaggttgttggtttgttcattagatagcttagaaagaaacacgtccttttgattttcctgttgcttcttacagtatcatggttttgttgtacatactgtccattttagcatgtttttcaatggaatgttttgtagtt

SEQ ID NO: 101 - DNA, 985 bp, Gossypium hirsutum
acgagcggccagtatcaacgcagagtacatggggagtcaagcagaaaattcatcctttggaagctgtttcgtctttcacgtcccaatatccctgcatttttctcttctcttcttgtctccaacatcgatttgaaaaatgagcgccgtggccgacacacttacccattggattaatttcccagaaaacatcgagaaattaatgttcccttcacggactcacgaaagccgcgataacgagaacaagggattcagtagcataccggccgacattttggacactcccaaggagttcattttctacttagatgttccaggcttgtccaagtcggatatccaggttactgttgaagatgagaatacattggtgataaaaagcggtgggaagaggaaacgagaggagtttgaagaggaagggtgtaaatatataagactggagaggaaggcaccccagaagctgatgaggaagttccggttgccggagaacgccaatgtggcagccattacggctaaatgtgaaaatggggttttgactgtggttgtcgagaagcttcccccgccaccaaagcctaaaactgttgaagttgcgattgcttaaaaggatctagttgtttgggggggatagaaaggttaaattatagagggctttcaagtttctcacctttgggaactggagatcaaacaatggttgatgtatttaggtgtggttcatcagcatgtatttttatttgcagtgtaatttgattgggtggatttgctcctcctcagtctacagtctttccttctaattttgcaattcccgtggtttgtctggcactaaagggttgctattagaaaggcgaaattgaagagaacattacatatatatatttaatatattggactttattcatccaaaatttgttaacttgatggtgcggattgagggcaattgactcgatgaaatcaacgtgttcagttacagctaaagtgcagtggacttacgaag

SEQ ID NO: 102 - DNA, 400 bp, Gossypium hirsutum
atacattgcaagttagctaactactttagaaactaaacaaactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattgtctatgtctctcattttatac

SEQ ID NO: 103 - DNA, 2404 bp, Gossypium hirsutum
gagcagtattacgactcagcagtccgagagtgagatataaaaagcacatcacttccactacagactactccccataccaaacaccccgccgcagcaaccatctaccatccatcttctcattctactctttacctaccaagatcaagaaaccttaacaatcaacaactaccaactagatttggattaaatcacccaaaaccaatcaaccaaccaagcaaccgagaagcaaaaaaaatggactctgattatggcattcccagagaactttctgatcttcagaaactccgatctcaataccaaccacagcttcctccttgcctcgagggaactactgtcagggttgagtttggtgataccactacatctttagacccggctgatgctcataccatagcccgagcttttcctcacacttatggcaagcccttggctcactttctcagggcaactgccaaagtacctgatgctcagattataactgagcatccaactattagggttggactcgtcttttgtgggagacaatcccctggtggccataacgtcgtatggggcctccacaaagctctcaaaatccacaaccctaatagcactttgctcggctttttgggtggtactcaaggtttatttgcccaaaaaacactagagatcactgatgatattctttcaacctacaaaaatcagggtggttatgatctcttaggacgaacacaagatcaaattagaacaactgagcaagttaaggctgcactagctgcctgcaatgatttgaaattggatggccttgtaattattggaggtgtaacatcaaacacagatgctgctcaacttgctgaaacatttgctgaagctaaatgtcctacaaaggtggttggtgttcctgttacactgaatggagacctcaagaatcaatttgttgaaaccaatgttggttttgatactatatgcaaggtcaattcccaactcatcagtaatgtctgcactgatgctctctctgcagagaagtactattattttatccgtcttatgggaaggaaggcatcacatgttgccctggaatgcaccctccaatctcatcccaatatggtaattcttggtgaagaagtggctgcatcaaagcttacactctttgacataacaaagcaaatttgtgatgcagttcaagctagggccgagcaagacaagaaccatggggtcatcctcctgcctgaagggcttatagagagcattcctgaagtgtatgcgctattgaaggaaattcacagtttgctcaggcaaaatgtatctgctgataaaatttcttcccagttatcaccttgggcatctgctttgtttgaatttttgccacatttcataaggaaacagcttcttctccaacctgagtcagacgattctgcacagctatcacagattgagacggagaaactactggcgcaccttgtagagaatgaaattaataagcgcctgaaagcaggcacttacaaggggaagaaatttaatgctatttgccacttctttggctatcaagctcgtggatccttaccatcaaaatttgattgtgactatgcctatgttcttggacatatctgctatcatattcttgcagctggtctaaatggttatatggcaactataaccaacctaaagaatcctgtgaacaagtggcgttgtggtgctgcacctcttccagcaatgatgactgtgaagcgctggtctcaaaatcccaatgccgcgtcaattggaaaacctgctattcatccagctactgtagatttgaaaggcaaagcatacgagatgctgagacaaaatgcagcaaggtttttgctggatgatatctacagaaatcctggacccctccagtttgatggtccaggtgctgatgctaaggctgtgacattatgtgttgaagaccaggattacatgggccgcatcaagaaactgcaggaataccttgacaaggtccgtaccattgtgaagcccgggtgttctcaggaagttctgaaagctgctttaagtgtaatggcttctgtgacagaggttctgtcagtgatgtcttcatcgtcatctggcggacaagccctttgagaagaaagcagtgattgtaatggtgctctcgttttccttaatgatcctaaactgtttgtgagaaactgaattttgaggtacccctgttttcatgttttcgggatggaagatattttattggtttctgaaaagagataatatattaataacaaatgttaagtgtctacgcatgttaacagtattcagcggcaaaaagtggattttaagcgggctgatggagtcttagtttaattcacactcttattataataatgaaaaagacatgttcaaatagattttaagaggttttttaatgggatggtacggtcaaatcttatca

SEQ ID NO: 104 - DNA, 1838 bp, Gossypium hirsutum
acccgggacgatatcgggcagctgcccgtggcaacccaaaatggagttccttcacatacccaaaccttcttcagtttaaatgcctccctctgtagagcgcgcgactgtttttttctatttcattttcgtattcgattttgcgttgatttctttctttctttcgttctattttttttctttttaggaaaaaaacgataattaggaataaaagttttatcttttgatattatcattgatttttatgataataatggtgtggttctagttcttgttatggcggagatctgttacggagttgtgagcgaaggcgaagcatcaataccgtgcgagccgagttcacgtgcagcaaggaggcgtaggatggagattagacgaattaaaatcgtcgacgtggctccatctgaagctgacaacggccggaaacgcaagaacctgcaagcttacggagcatcattttctctggactgtgaaaacgctgtagaaaattgtgcctccgatgaggacggaaaaaagcgaactgttaaacctaaaaatggaagactaaaaacgaaaggaacaataatgaaaagtaactcgagtccctcgcttttgatacctgaaatcgattcagagttacatcctaaattcggtgtcgcttcggtttgtggtaggagaagagacatggaagacgccgtcgctattcatccgtctttccatcgtcaaggccaggactctgccgccattggcttccactattttggcgtctatgatggtcacggttgctctcatgtggcgatgaggtgcagagagcgtttacatgagctggtgaaagaagagttggccagtgaggaggaatggaaaggtgctatggagcgtagcttcacgcgcatggataaggaagtgataaagtggaacgagagcgtggatggtgctaattgccgatgcgagttacagtcacccgagtgtgatacggttggatctacagctgttgtcgctatcgtaacgcctgataaagttgttgttgctaactgtggtgattcgagagctgttttgtgtcgtaacggcaggcctgttcctttatcgtccgatcataagccggatcgtccggatgagctgaaccggatccaagaagcgggaggtcgggtcattttctgggatggtcctcgagttctgggagtcctcgcgatgtcaagagccataggtgataactacttgaaaccctacgtgagctgtgagccggaggttacagtaacggatcgaacggcagaggacgaatgtttgattctggcgagtgacggtttatgggacgtggtatcaaatgatactgcatgcggggtggcgcgcatgtgtttgaggggaaagtgtgatgtacaggcgccgctattgtcaccggaaggagaggcggttgtagggtcgatgatgggaggagagatcccggacaaggcgtgcgctgatgcgtccatgttgttgacaaagctggcgttggccaggcatagtacggacaatgttagcgtagtcgtggtggatctaaggagagccacgtaataggcgtctgaaaattcaatgtttttctctctctaattctctttttagttggtcgggacttggtagtgaaaactgaaaaaaaaaagttgggggtattttctttgtttagatttaagtttagcttttttttaaggagaagagagagagagggctgaaaatagtggggtgaatgttgaaaaaaaatttaaacacaaaaatactagtaaaatgaaaacgttagatcagttttcttgcttcattttcaagaaatcaaaatcttttagctgacagaaaaatgtatatgttctattaataatttttaaataatgatttga

SEQ ID NO: 105 - DNA, 1254 bp, Gossypium hirsutum
aaaaaaaaacatctcacttttaaaaatgtttgatagaagtggataagatcctccattaatcctactctcttccacctcctcaaaaactatccataaatgctctcaagtcccttcattcagaaacttcccttttgtctcatcttcttcaccaaaaacccatcatatttttggccttaaatgggtgccaacatatctggtggtggttcaattgacggcgatgcaaccggtcctccattaaggccaagactcgatgacataccagagagctgcgccgccttaattttagcaaggttaaacccaccggagatttgtaacttggcacgtttgaacaggtcttttcgtagtgcttcattggctgatttcatatgggaatcgaaattgccatcaaattataagttgattgtggaaaaattgtttgttgaagaagatagagatttgatgaatttgaagaagaaagatgtttatgctaggttgaccaagcctatcccttttgatggtggcacaaaggagatatggttagataagaacacaggtggggtttgtttatcaatgtcttctaaggcgttgacaattacagggattgatgatcggagatattggaaccatatttccaccgaggaatctagctatcgaacagtagcctacctccaacaaacatggtggttcgaagtcgacggagagctcgagtttcaattccccgccgggacatattccctattctttagactccacctcgggaaatcctcaaaaagactcggccgtcgggtttgcaacaccgagcacgtccacggatgggacataaaaccggtccaattccaactaacaacttcggacggccaacatgtcgtatctcggtgttatttagacaatccagggagctgggttctctaccatgtcggagatttcatagttgagaactctaatgcgttgacaaacatcaaattttcatcgactcaaattgattgcactcatacaaaaggaggcctttgtgttgatgctgcatttatataccccagtagtgctagaaaacaggttaaattgtgttcatgagaaaattaagaggtctaaaactgtaaatacggtaaatctaggttgttttttgatagctctagatgttgtggttattattattttcctcaaataataacaaattttgctgcaatgattatttttttgttttgtaatgttacaataggaacttgaaactatgttgttaattggtggtgtttgaattaaaactacttgaattggttt

SEQ ID NO: 106 - DNA, 2290 bp, Gossypium hirsutum
aaaccctatttttcggagttttacgtctgattgtatttctccagcagcgcactgtagcaccaaatttccttctagatttgttgtggtggttagatttcaagatggtgtccgacgcaagcaagaagaaggctgctcagaagaaggctgctgccgctgcaaagagaggagggaaggccgctgcatcttccaaggcggcagctgcagcgaccgcggagaacggcgttgataatgcttctgataaagttagcatgctccagatatccgatcggacctgtactggtgttctctgctcgcatcctctttccagagatattcgtatagagtccttatcagttactttccacggacatgatcttattgttgattcaacattggagcttaattatggcagacgctatggtttgctaggattaaatggttgtgggaaatccacgctgcttactgcaatagggttgcgtgaacttccaattccagagcacatggatatctatcacctgacgagggagattgaagcttcagatatgtctgcattgcaggctgtcataagttgtgatgaagagaggttgaagttggagaaagaagcagaaatcttggcagcacaggatgatggtggtggagagacacttgaacgtatctatgagcgattggatgccttggatgcatcaactgctgagaaacgtgctgctgaaattttatttggcctcggtttcaacaagatgatgcaggcaaagaaaacccaagatttctctggtggttggagaatgaggattgcattggcacgagctctattcatgaatcccaccattcttttgcttgatgagccaaccaatcatttagatttagaagcttgtgtctggttggaagaaaatttgaagagatttgatcgtatccttgttgtggtatcacattcccaggatttcctgaacggagtttgtacgaacattatccatatgcaaaacaaaaaacttaagttgtacactggcaattacgatcagtacgttcaaactcgttctgaattggaagagaaccagatgaaacaatacaagtgggagcaggaacagattgcttcaatgaaggagtacattgctcgcttcggtcacgggtcagccaaactagcccggcaggcacagagtaaggagaagacattggcaaagatggagcgaggtggactcacggagaaggtagtcagggacaaggttctggtgtttcgatttgttgatgtcggaaaacttcctccaccggtactgcagtttgtggaagttactttcggatacacgcctgagaatctgatctacaagaacttggactttggggtagacttggactcaaggatagcattagtaggacctaatggtgcagggaagagtacactgctgaaactgatgacaggtgaattgactcctattgatggaatggtccgacggcataaccatctgcgaattgcgcaattccatcagcacttggcagagaaactggatatggaaatgtcagctctccagtacatgataagagaataccctggaaatgaggaagagaagatgagaggtgcaatcgggaagtttggattgtcagggaaagcgcaagtgatgccaatgaagaacctatccgatggacagaggagtcgagtcatcttcgcgtggttagcatttcgacaaccccacttgctgctgctagatgagcccactaaccatttggatatcgagacgatcgattcactggcggaagcattgaacgagtgggacggtgggttggtactggtgagtcacgatttccggctgataaaccaggtagccgaggagatatgggtgtgtgaaaatcaagctgcaacacgatgggaaggggacatcatggacttcaagcagcatctcaagagtaaagctggtttatctgattgaagcaaagcagtaattagcatataactttaaagcagatggtgtccaccatcccagatgggttattctcgcgcggtggattaagctaagtagctgctatttagtatttttatagagcagaggtaacgaggaaaggctttgttattgtttgaagccatcgagttttcgtgacctctgtttggtgggtttcgcaaagcaggcatttggtgccttttgcttttcaaacctgggtttgctttctccgagaggttggtttttcggtgatacttataatataaagagtagcttaaattttgtcgtttattttatagatacttattgcaattaactctacgaaatactagtatttctgttaattatatcctacatacatagcagtatttcataattattttgaa

SEQ ID NO: 107 - DNA, 1695 bp, Zea mays
agaagagcaacccaagtcgccgagagcgactcccacacgacccacctaccccgccgccgccgccgccgcatccccctcgatcccgtctggcgatcgggggctcccagacacatcacagatacacaccacgctaagccaaatcgagcaacgcctatcatcatattataatttcccctcattcatctcacagtcctaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtgcatacaagatatccaagggtttgcttggcaagtatggccccgatagggttctcgatactccgatcactgaggcgggcttcactggcattggtgttggtgccgcttaccatggtcttcgacctattgtagagttcatgacatttaacttttcgatgcaggcaattgatcacataattaattcagctgccaagtcgaactacatgtctgctgggcagatatctgttcctattgtctttaggggtccaaatggtgccgctgctggagttggtgcccaacactcacagtgctatgcagcttggtatgcacatgttcccggattgaaagttctagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatactggccaaggaaggtatcagtgccgaggtaatcaatcttcgctcaattagaccgctggatagagctactattaatgcatctgtgaggaaaaccaatagattggtaaccgtagaagaaggcttccctcaacatgggattggtgcggaaatatgcatgtctgttgtagaggacagctttgagtatcttgatgcaccagtcgagaggattgctggagctgatgtgcccatgccgtacgctgccaaccttgagaggatggctgttccacaggtcgatgacatcgtccgggcagccaagcgtgcttgctacagggcagcagtaccgatggcagcaaccgcctagtccagcagaaccctgcatgttgcatttctttgtctaattttaatatccgtgctgcagaaagacgtgtcacataatggtgtgacgagtacccactgccgctgcaactcaactatagcatgagctgagtttttgtagagccaccgagaggtgttcagtactccagttccagttccgcttatcttcgccgccgcagccggaaggctgcgcatgactctgcgtctgttttatggttcacgaatgattgcagatttgcagcagagcctctggagatgagaattttacttgtggcgagatgttgtgagtaacttgtattcag

SEQ ID NO: 108 - DNA, 1957 bp, Zea mays
tcatcactgctactagtgctacgctagccgctgctcatataaggtactgctactgctagctccaggccgccagaggcgacaggccaatgggtttccgcggtggtttgaggccgcccgtgacgcgcgtctgcttcgtcctcctgtgcctgtgcgcctcgttgtccgaagccaagaggacgccgcagcctgcgcctactacgggcaagaagcagcagccaccggcagcgtcgtcgtcccagcagagcccagcggtctcgtatccggctctccccgtccgggcggtgtgcctcggcggttggctcgtcaccgagggctggattctgccctccctcttcgacggcatccccaacaaagacctcctggatggcacgcagctgcagttcaagtcggcgctgcggaagacgtacctgaccgcggacaacggcggcggcggcgccgtcgtggccaaccgcacgcaggcctccgactgggagacgttcaagctgtggaggctgaacgacacgacgttcaacttccgcacgtccggcaaccagttcgtgggcatcggcgccagcgacggcatcatcgtcgcgacggccaccacgccgggcctgccggagacgttccagatagtgcggtgccccttcgacaagaacagggtccggatcaaggcggcgaacggctacttcgtccaggcgatagcgaccggcgaagtgatagcggactacggcgagcccacgcggtggtccgacttcgacgcgtcagtgttcctgatgaccaccgtcgggcagcagctgcaaggggagtaccagctctgcaacggctacggcgccgacaaggccgcgccgctgctgagggagcattggagcacgtacatagtggaggacgacttcaagttctttgcgtcgagtgggctgaccgcagtgaggatccccgtcggatggtggatcgccagcgaccccagcccgcccgctccgtacgtcggaggctccctccaagccctggacaacgccttcagatgggcagagaagcacgagctgggtgtcatcgtcgacctgcacgcagctcccgggtcgcagaacccctgggagcacagctcgtcccgagacggcacgcaggagtggggaaccacggacgccagcatcgcgcagacggtgcaggtcatagatttcctcgcgtccaggtacgcgacgagcccgaggctgctggcggtggagctgctgaacgagccgctggcgcctggagcgaccctggacagcctcaccaggtactaccgcgacgggtacgccgccgtccggaagcacgcgccggcggcctacgtggtcatgtccaaccgcctgtcgtcggggaactccacggagctcctctggttcgccggccgtgggttcccgggcgccgtcgtcgacgtgcattactacaccgtcttcaacagcttgttcggtaacttcaccgcgcagcagaacatcgacttcgtccggactaacttctccggcgagctcgccgccgtcaccacccgagatggcccgctcaccttcgtcggcgagtgggttgcggagtggaaggtgccgaacgcgaccaaggaggaataccagaagtacgcagcggcgcagatgaacgtgtatggacaggccacgtttgggtgggcctattggacggccaagaatgccaacaaccattgggatctcgagtggatgattagaaatggatacatctcgttgaaaggctaggacccaagccaacaggtttcagtctatataaaactctaatctctattggtagtacgtaggaacccgggcgagccagagatatttgctatatgtcgttgtaattaaattaaggccaagttcaatgaccttggcttcgtcagaacgaacccggccgggcgtactacttgtgccatgaacacttttgttggttgttgtgtgtacccgagcaaaccaatttaacgatgtactaatactattagaccaactccagc

SEQ ID NO: 109 - DNA, 691 bp, Zea mays
ataaatatacgccacacagatggctctccattctccacagcacgcaggcagcacccagcaccacaccacagaccaaaacgaccaccgcacccgcagcagcgaagtgtccaagcggcggcatggcggagagcaaggcgcgtgtcgcgctgttcctggcggcgctcgcggcggcgagcctgctggcgctggccccggccggcgccgcgacgacgtgcgcgccgacgcagctgaccccgtgcgcgcccgccatcgtcgggaacgcggcgcccaccgcggcgtgctgcgccaggctcaaggcgcacccggcgacctgcttctgccagtacaagaggaaccccagcatgcagcgctacgtcaactcccccaacggcaagaaggtcttcgccgcctgtaaggtgtccctgcccaggtgctgatgctgagtgagtcgtctgccgccccatcaggtcgatgtcgatccatcctgctcgatcgatcgatcatgctactacttgagcacctttgggcagagtttagtattgctcgagaataataaacggagacgtaccactcccagtacttggtacagtgtgagttcgatctgctctctgcagaaagacttggtatatatgccgtcatgtatgtatacgtgtcacgtgtactactatgaactatgatgttacaaagacgaatacaggtgttgccacttgtg

SEQ ID NO: 110 - DNA, 1643 bp, Zea mays
aaagccggaagcatttccctatattgattgatttatccaaagcagcagcggcaggagcactgcaccgtccagcacacaccagcattgtcctgaggcctgagcagcgctgcgccgcccaaccagaacgacgaagcggagccagcgccaacgaaccaactaaccaacggacggaagtggcgaggcaaggccgccgcgaagccgagcaatagcccccctcctctacccgttcctctcctgccttctcgggatctgcccgcccgccttgtgcccccgcggttggagctccggctgcacgacaccatgagcccccgcgcgtagaggctgggagagagggagcggggaacaaagttaggcaccaacaaagttaagtggggaggccagagctggccagctgggtcgctgttctaccagagggatggacgggagcgccggctccttcgtcgccgtccgccggctctctggctccgaccgcgccgccgccttccaccactcctcttcggcggaggtcgtgacggggtcgacggcgtggatcgggagggggctctcctgcgtctgcgcgcagaggagggacagcgatgcgcgcctttccttcgatttgacgcctgtgcaggaagaatgcctacagaggttacaaaaccgtatagaagttcagtatgatagtgcaaacagagagcatcaggaagcactacagtccctttggtgtgcttcttttcctggcaccgagcttcgggggctaatatcagaacaatggaaagagatgggttggcaagggaaagacccatctacagattttagaggtggaggcttcatctccttggagaatctattgtacttcgctaggaactatccaaaatctttccaggaactccttcgcaagcagaatggtgaccgtgcaatctgggagtatccatttgctgtcgctggtgtaaatataaccttcatgctcattcaaatgcttgatctccaatcagttaaaccgaggtcattgttcggagcagttttcctaaagcttctttcagaaaacgatcaagcttttgacattctctactgcataaccttcaagctgatggatcagcaatggcttgacatgcatgctacttacatggacttcaacacggtcatgaagtctacacggcgtcagctagaaagggagctgttaattgaagatattcagaggattgaggacatgccatcatacaggcttctggcccggtagctagaagaaactgaaaccttaacatggctacatattgcaaggcggcttgagatgctaatggatcgcaacttatgtggacggcgacaatcttgaaatgtagatgacatgtatccttgtgtgttaggtacttgtggtctctggtaacctgatctctgaagattacaaggtagggtttttttcctggtgatagaatgccacgtagggtaactgaagtgtctgatcagctcccatggccaaaaaaaaaatttgtagggtgtgttattacaatctggtcgttgtccatcataccacgaaaggaagtattcctagggttgttgttgtaaacaggaggatttgggaaagatgatctgtgttgtctcccatttgcttgaagataagaggctagttctttttaagtgggcagctactctgctgtgccgctccccaa

SEQ ID NO: 111 - DNA, 1396 bp, Zea mays
cgccggctggttgactcgcgtcgcgtcatgtgcgcgtctctcgtctcgttgggattatattccccatccgcaccgcttgccaatcacccgataataagtagcaggggcagggagaacgaagacgacgacgacgtacgccacccgtaagtgagccgagagccctcgagataccatcagctagctagataaccagccagcgcgagcatggaggcggcggcggcggcggtcctgcaccggacggtggaggcgaacggcatctcgatgcacgtggcggagtccggccccgacggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcgtcggcgacgtcgtcgccctgctcgacgcgctcggcatccacaacaaggtgttcgtggtgggtcacgactggggcgccatcatcgcgtggtacctctgcctgttccggccggaccgggtggcggcgcttgtcaacaccagcgtcgccttcatgcgccacatcttcgtccgcgccgccgccgccgccgtcacgcccatcgactacttccaccgcacctacgggcccacctactacatctgccgcttccaggagcctggtgtcgcagagaaggagttctcgccggccaacgccgggtacctgatgaagcggatcctgtgcaaccgcttcacctcctcggcggccggcgacgacaagcgaccgccggcggacgccgccgaggaggagccgctgccgccgtggctgacggaggaggacgtgggccacttcgcgtcggagttcgagcggacgggcttcacggggcccatcaactactaccgcaacatggaccgcaactgggagctggcggcgccgtgggcggacgccaaggtgcgggtgcccaccaggttcatcgtcggcgacggcgacctcacctaccactacccgggcatccaggactacatccacaagggcgggttcgaggccgacgtcccggggctcgagagcgtcgtcgtcatccccggcgccggccacttcgtccagcaggagaaggccgacgaggtcagccagcacatctacgacttcatctccaagttctgatacatgtgcatggatcgaccatcagcttgcttgcttacctgctaaagcctgtaatctcaacctcgatatccgtgctgccaacttgttttgtttgacgaactaagagtaataagtgttcgcatatatgtctggtttaatttgtgacttggacatggtatgttcgatgtgaaatggataaaccatgcgtttcgtaatt

SEQ ID NO: 112 - DNA, 1929 bp, Zea mays
gtccgagcgagatcgatcgcccctccgcaaggccgcaacaacagacgcggcaagcgggtacaagggagttcttctggaggcgcgggagatcacgcgagtgtgttgcgcttgaaaagaagaaaaaaacaggcagggaggagggagtcccgttcccgaacccgaactacaagcccacgcaactgctgctgccgccgcccgcccagcaggaggagcgagggcattgcccggccccatcgccgtcgcgccgtcgccgtcgccgcgctgcaggcagaggaggacggcgccggccagcatgggcgggtacgagctcgtcaggagcgacgacgcggcgggcgccgcgggagccgacctcgagtccggctccggcgccagcaaggtcgccggcgccccgccgccctcgccggccccgtcggcgtcgcccgccgcgcggcagcagcgcctcgcctcgctcgacgtcttccgcggcataaccgtcctgcttatgatcatcgtcgacgacgctggaggcttcctcccggcgctgaaccactctccctgggacggcgtcacagtagctgatttcatcatgccgttcttccttttcatagtcggagtctcactaacactagcgtacaagcgggtgccggatagagtggaggcaactaggaaggcagtgcttcgtgccctcaagctgttctgccttggtcttgttctccaaggtggatttttccatggcgtccacagtctcacgtttggtgttgacctaacgaagattcggttgatgggcatacttcagaggattgcaatagcctatctcctagctgcagtatgtgaaatctggctcaagggagacgacgatgtagattctgggtatggtttgctgaggagataccgctaccaactgtttgtaggattggtcctctctatagcgtactctattcttctctacggcatgtacgttccagactgggagtaccagatagcaggccctggttccagttccacagagaagtcgttctctgtgaaatgcggagtgagaggagacaccggaccagcttgcaacgcagtcggaatggtcgaccgtacggtcctagggatcgaccacctctacagacggccagtttatgcgcgcacgaaggaatgcagtatagattatccagagaatgggcctctcccacctgacgctccgtcgtggtgccaggcgccatttgatcctgaaggcctcctcagctccgttatggcgattgtcacttgcttgatcggactccagtttgggcatgtaattatacatttcgagaagcacaggggaagaatcgccagttggttggtcccttccttcagcatgctagctctagccttcgtaatggacttcgtcggaatgcgaatgaataaaccactatacacgatgagctacactctggctactgctggcgctgcgggtcttctcttcgctggaatctatgctcttgtggatctgtacgggttcagaagacctaccatcgccatggagtggatggggaagcacgccctgatgatatacgtgctggtggcgtgcaacatccttcccatgttcatccgtggcttctattggagggaccccaacaacagccttctgaaagtcattggtatcggggcgtgaagccatgaccttctacatgttcaggcccaaacttggacatgcacagcgctctcgcatgtttaagagcaataatctaggtgctcaggccaagttttgctatgcggttagaggaccatagcgcgctcaggtcatgcgccatggggctgcctatattctcagcactgccgagatgcctgttgccacttgcagatgcatggaatccattctcccagccaactttgtatatggtggagttgagcacatgtacatgatatcacacgagtaatatgttgtgattcagatgaaatatatactagtacatatcagtccat

SEQ ID NO: 113 - DNA, 1079 bp, Zea mays
agcgagcaagcgaaacagcactatacaagtcgtcttcttctccgtcccttgggccacctggtgttcttctataccacgcgtccacgccactgctaagctgctccccgttcgccaggtcggcgaccaggcgaaacgtgctgctgcaagaagaagaataggtacacagacagcatgtccggagttcaggcgatgccggcggccgtgggcgtggcggggctgagagggtcagggttggttagcagcagcagtaccggcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctccgtgctctcggcaaggagaggcaggagctcgcagagcgagtgatggtcaccaggcttcacctgtacgggaaatggataaagaaatgcgaccatgccaagacgtacgagaagatctccgacgagaacctggcgctgatgcgggagcggctgatggagacggtcatctggccaaccgacgacagcagcacggagaagatcggctgatgcctgatgcctgcggaggcgccgagtcctttcgggttgctgatcaagcttagctccttctattagcatgtagagcagcactctgggtttctctatcagtcagtcagtcagccagccagtcagtgggttgtatataatcggagttgtagtagacagtatacatttctctgggcaggcaatcactgtttgaggtgttaacagtgccgttttgccctcccaattaagcctctacagtcggtctaagtgaagcaaaaatgcttaccttgtagtagctaaatttacatgtgcggggatatacgttgtaatagaatatttctgcgccc

SEQ ID NO: 114 - DNA, 2084 bp, Zea mays
tcttctcggcacggcatgtggcgtgcaggtgtgcgggctgccatgctagcgcacaaatggcgttcgggcaccgtgtaccctggcccccactcgaaaaaggggaaacccgtcaggcctcgctcctcaccgtaggccgatagccaaccagccagacaacacgtggacacggcagcggcagcggcagcgccctccgacccccgccgggccaccaggcagaaaaggaacggaacggcgcagccgcggcggcggcggcggcggcggcggctgtaggttcccgcaccagcgactggcggacacgtatatccaatcatccatcttctctcgcacggccgcacccgtcctcggactcgttccgtctgctagcaatgccgctggcgctcgcgcagttgcaggacctgcgggaccgcatctccgaccgcctccgcccatggagccgctccgcgcagttctgggtccgcgccgcggacatctacaccagctacaaggtgtgccagctgcgggctgggtttgtgaaggatgaggacgagcgggaggccatgtgggagcagcagcacgagctcggcgcccagaagatgtattccctctgctccgagctcggcggtcttttcctcaaggctgctcaaattctggggaaacctgacctggcacctatggcttgggtgaagagacttgttacgctgtgtgacaaggccccagccacgccatttgatgtggttagagatgttgtggagaaacagttcatgaagaatttcgatgacatattcgaattcttcgatgttgagcctgttgggtctgcttctattgcacaggtgcatcgagcaaggcttaaattgtcaaatactgatgttgctgtcaaggttcaacatccaggagccgaacatctgatgatggttgatattcggaatatgcaagcaatggccttgtttctgcagaagtatgacataaacttcgatctattctctgccacgaaagagatggaaaagcagatatgctatgagtttgactttgtgcgcgaagcaagtgcaatggaaagaattcgagaattcctacgtatcaccaataagaaacctccggttatggtgccccgtgtgattcctgggatggttaccagagaggttttggtaatggaattcatcaaagggaccccaataatgaatcttggcaatgaaatggctagaaggggcatagatcctagcggtaagattgcagccatggcaaagcagaagattttgtcagatcttactcttgcatatggtcaaatgatcttgaaggatggctttttccatgcagatccacacccaggaaacatccttatctgtaaggatacagaggtggctttacttgattatggacaagtgaaagaaatgccagaagatttacggcttgcttatgcaaatcttgtagttgcaatggctgatgatgatttcttgagggctgaggaaagtttcagggagcttggtattcgaacatgggccatatctgacaacaagttagaagaattgtttcagttatccctgcgaatgtttgatacaagattaccaccaggtgtaactgttatgtcaccttttgctgatgattcttcgcttactaaaattggagtggagagtttcccagaagagctattttcagtgcttcgaacaatccagcttttgcgagggctgactgtagggatgggccttacattctcgtgcgctaagcattggagatcaatcgctgaggatgcattgttgaaagcaggaagacaaagcgcttcaaaatcaagaaagcaaaagagaagttttctcaggagactgttttggtgaagtagggataggggctatcaaagaacatgatatacggacattctgtgatgaaagtatgaaacggaattagccaacagctcaagccttcgattcttatattcacagtacatcagttcacaattcatttactttgggtgcttgttatttgactcaacgatgttgctcattcctttataacaatgtgttatttggattttagtatatgtttagggattgtatctgaagttgacttgtccacaggcccttccataatctaactgagccctcctacatttttagccc

SEQ ID NO: 115 - DNA, 1827 bp, Zea mays
ttcataagtcgtctttctccttgaccagccattagcgtcgatcgatgatttagcacggagaggctcaaggctgtccacacagcctggattgttcgatcgttcttggagctcgcagctggagcgagagagtaatctcatgcccgctcttcttctgtagattgatggaatgatcagtaacctttatccatccatccatccatccagggattttaatttgttcagagaactaaaatttgattcctggtttttgactcagcgtagactctaaacaagcttacagcccggatgcgtcgccgacatggtgaatgcagtggctacaatcatatctacagtagcctcaactgcgacagtggtagtaatcgtcgccctcatcagaaggtgccgcgtcgtgaggaagaagatgaagaagaaaatcgtgaagaaagtcctggaggagattgagaaaaagaaccgcgagatgcaggccagcaacgccgtggaagatgtggcgatcgaggtcgggccagtggagacgtttctcaaccagatcctcaacgagaagccgatgcgtttcagctccgagcagctggcggcctgcacccggaactactcgtcggagctagggtccggcggctacggcgtggtctacaagggcgagctgccgaacggcctgctggtggccgcgaaagtcctcaaggtgtcgtccatgaacaggaaggtccaggaggcgttcatggcggagatcggcaccatcggccggacgtaccacgtgcacctcgtccgcctctacggcttctgcttcgacgcgagcaccaaagcgctagtgtacgagttcctggagaacggctcgctggagaagtacctttacggcggtgacgagggcagcacgacgagcacgaggctggagtgggggacgctgcacggcatcgccgtcggcacggccaaggggatcaggtacctgcacgaggagtgccagcagcggatcgtgcactacgacatcaagccggccaacatcctcctcacggccgactacaccccgaaggtggcggacttcgggctggcgcggctgggagagcgcgagaacacgcacatgtcgctgaccggcggcggccgcgggacgcctgggtacgcggcgccggagctgtggatggcgatgccggcgtcggagaagtgcgacgtgtacagcttcgggatggtgctgttcgagatcctgggacggcgccggaactacgacccctgccttgagggcgagagcaaggagtggttcccgagatgggtgtgggagaagtacgagcagggtgagatcgagcacgtcgtgtcctgctcctgcgacgggatcgtcggaggggcggacagggagaaggcggagatcatgtgcaaggtggcgctgtggtgcgtgcagttccagccgtcggcgcggccgacgatgagcagcgtggtgcggatgctggagggggagatgcccattgtcccgcccgtgaacccgttccattatctcatggaaagcggcggcggctcaactagctcgggattgtggagcggcacataccagagcagcagcagagacaccgccggcgcagagttgtcgcctgtcggatagctctgctgccaggtcaatcggcgtcgacgcgccgtgatcgaagatgttgagcggactcgtggggggtcgtgttgatgaaacagagtttgtagtcctgtagtacacgttagttaatgctttaaaataacaatgaaggccgtggtttgtaaattagcatcgtgttttggaggattatataaaagataaaagattcgcgcacgacaaaaaaaaatcgtgcatgcgttgagtgaaatgtacttgtaccggca

SEQ ID NO: 116 - DNA, 1887 bp, Zea mays
ttgtgcaacaaatttgaactatactttcaactcgataatcaatctaaacggtagtgcctttaactggaaaaccctaattaaatggcaactgatcaacctacagctacaagcttacaactccacgagcttccacggctcagcgtcggcgcgcagggccatgacagctccgagggcgctaccagtaccaccgcacaccgcgcggcgcgcccagggccgccacccccgttccacgcctgcgccgccgccgccgccgcgccaccatctccatccacagcagcagggggccacggcgtccgtgctgggcgtcggcgtcccgagagcctggctctcgcagcgcaccccagtcctcggcctccgcgcctgggtcctcgtcgccgcaggcgctgcggcggccgccctcgccctcttctgcctcgccgtctgcctctgccgccgctgcagccggcgccgcgcaccgcgcctggccccgtgcccgcatcggcccggcgccagcaagtccctcaagcaccgcgtgcatgcgcaccatcaagcagcgacaatgccgccgctcccgccgccggccaacaaggacgccgaggaggctgccgctcgctggcgccccgcttcgttcgaacagccgccgatccaggccatcaaggcggagcagaaggcgccgctgatcctcgcggagcatttcgcgaattcgacgagcggcgagagcaccgcgagcgaccagggcggcagcgatgcggaggttccagaggcggcgcggcgcgggtggggccggcggtacacgcgccgcgagatggaggaggccacgggcgggctcgccgccgccaacatggtgggcgaaggcgggtacggcgtcgtgttcaggggcgtgctccgcgacggcaccgccgtcgccatcaaaaacctccacaacaacaggggtcaggccgagaaagattttcgaatggaggttcagacaatcgggcgcgtccggcacaagaacctggtgagtttgctcggctactgcagcgagggagcttgcaggatgcttgtttacgagtacatggagaagagtaatctggacaagtggctgcaccacgacgacagcgaaaccagctcactgacctgggacatcaggatgcgcatactccttggaacggccagagggctggcctacctccacgagggtctggagcccaagatagttcaccgcgacatcaagtccagcaacatcctcctggaccggcagtggagcgccaaggtgtcggacttcgggctcgccaagctcctctgctcggagaggtcctacgtcaccacccgtgtcgtgggaacgttcgggtcggtgtcgctttttctctgtttttttttcgcagggagagagggctgttgtttcagttcaagggagttcgtcatcgtctcccgcgtgcgttgcaggtacgtggcgccggagtacgccgagaccgggatgttgaacgagaggagcgacgtctacagcttcggagtgctcgcgatggaggtcatgaccggcaggactccagtggactacactagaccagccgacgaggtgaacctggtggagtggctgaagcgcatggtcgccgaccggagggtggaggaggtgctggacccgaggctgccggagccgccgccgtccaaggcgctgaagcgggcggtcctggccgcgctccggtgcgtggacccggacggcagccagagacccacgatggcgcacgtggtccatatgctcgaagacgaccagattctcagagacgaattcaagctcgcgcgggatctgtctcctcgggagtcggatagctacgaacgcgaacacagcaggtgatggatgggaggcagggcagcagtctgggacagggacaggacactgggagggatgttaataatagcaagatgtttttg

SEQ ID NO: 117 - DNA, 1751 bp, Zea mays
tataaagacgtctttggtaaagttctctctctctctctctctccgtatctcgcttcgccaccgccggcgagagctagggtttcgtgcgccaccgtcacttccgcccgccatggccgagacctccacgtatcagattctggtgcgtctcctcgacgggcgtaccagatgtctccgcttctccacgcccaccgtttccggcgccgtgctcctcgacgccgtcgcgtcgatctctcgcgttcccgccgccgctctccgcctcgtcaccggcggcatcgacgtatcgccctcttccgtcctcgcctcagcagctgatggccagttcccctatgcgtcagcgctcctccgccttcgaggaggcaagggtggattcggctccctcctcagaggggctgcctccaaagcgggtcagaagaagaccagcaactttgacgcctgccgcgacatcaacggccgccgcctccgccacgtcaacgctgagcgccgcctcgaggaatggaaggccgaagccgccgaccgccagctagaaaagctcgccgagaacttcatcaagaagaaggccaaggaagcgggccgcggtggcggaccctcaaccgctgaggtggacaaatatctagagaagtaccgcaaggatgctgagatctgcgtcaacgtggttgaggaatccgtgcgtgcatcacttggaaagaggaagaccgcacctaagctgccctctggcgcagacgctaagaagcttaagttttggttaggaaagaacaaagtagaagaagatgaaagtgatagtgacactgatgtggatgatgaggacattgaagatcttaagagcgcagatgcaaaatctgtagtagttgatgaaggcaattactcaaatggatgcagaaaaaatgaggagaagcttgatcttggttctgtttctgggtcatcacattcagaaggagagtcttcaggagaaaagtcccaactgacaacaagttcaggagctgaaggtggtgactttgaatctggtgatagtgcagagcttgaggtaggaatgttggatcatcccatttctgttgctgctgcttcagaagaagtgacagcagatgaggataacactgctttagctacttcaaaccaaaataatccagaggtaccacaagttgaagaagtgcggaaagcagacaaggataacactgcttcagctacttcaaaccaaaacaatcaagaggtgccacaagtagaacaacatgttggcatcagcaactcttattcagagccgttggaccttgcaaagtacagttcatctgcagaattggaggtgcttggtctggagaagctaaaaatagagctgcaatctcgcggattaaaatgtggtggaactttacaggagcgtgctgcccgactcttccttctgaagacaactccattggacaagttaccaaagaagctgcttgcaaagactaatgggcggaagtgagaagttgtaccaatatatataaagaagtaccaatgatgcaacgtttaagattttctttgtcaatatatggaaatctgttgtggtgtaatcatgtgttataagctcttggcttggtttgacaattaatgagatgtctgtacgtgctatatgttaaccgttacttggaaggcgctcagtttgggctagcgtttgaattcgttttagtttttgatgttttagtgtatgtttggaacagcttcaccaaccaaaaaaaagtagtaagatttatctggatctattatagagcaaagatttacct

SEQ ID NO: 118 - DNA, 1894 bp, Oryza sativa
ctctactctctttctctctctctctctccccccttctccgtctgcgttgtgctgcgcgagcccccggaggcgaggcgactccgcgtcgccttcccccccgagcgcgcggccggcgagaagggcgggaggcgcgggcggcgaggtgctcctcttctctctctgtgtctctcgtcggcgacctcgcgcggtagcctcctctccggtggtggtcgcgcgcgcgcggacggtcgacgagggaggtttggagggtgggggcgcgactcggggttgaattcgctcgagctgactcactccagagggttttatagtttcaagcacaacgctgctcaagatgccagcactgaggatgaagaggaactttgacgatgatgtttttagggatgagtttgattccaaacccacaaaatctatgaagatctcacattttcaagtcagcgaactagagcagtcagctgtgttgaacttgccttataaagatccccacgatgagctggatttgacaactcagttagctggccaggacattatgatcatggaagctgctagtttggatgatgctcttggaggagcatctttgctcaaggatttaatatctgaggtggcagtttcaccaaatatggagaatgatatgttagttaattatgaagacatcagatctcagttaaatgtagtaaattattttgacaaagatgaagatgcaaattctgcatcatataatagctgtaccgttaattgtcatgaagaaagctggggctcgaatgagggttgcagtctgttggacatttataatcctgatgatgctttctctttcctattggatacgccctctgagtttctgggtagttttactgcattatatgatgaagttgtaccaattgattcattggtgaatataagtggccgatgtggagtattcccacttactgagagcactacagaagccagtattggtaatgagccatgcagatctgagggggatatgctatttagtaactcagaggtgttagagtggctcaatccacatctggctgaggaggatttgcctaatctcgttgattttactgagctgaactcacatgctgtatcaaaggagcaaggggccaggaaggtcactcttgtacttgatttggacgaaacccttgttcattcgaccacagagcagtgtgatgactatgactttacctttccagtgttctttgatatgaaggagcatatggtttatgtgaggaagagaccacatctccacatgttcctccaaaaaatggctgagatgtttgaggttgttatattcacagccagccaaagtgtttatgcagatcagctgcttgacatcttggatccagagaaaaaactgttctctaggcgttatttccgggagtcatgtgtatttacaaacactagctacacgaaggatctgacagttgttggagttgaccttgctaaagttgtcataattgacaacactccgcaggttttccagttgcaagtgaataatggtatacccatagagagttggtttagcgacgactctgatgaggcattacctcagctgattccgttcctggagacccttgcttctgcggatgatgtccgacccataattgccaagaagtttggcgacaaaaaggatattgctgagattttccaataaatgttagggatagctttttgtttactcagatagaggaacagaaacttaattaacatgttaaccgggcttgttgacctttttcttttccttttttacagtgggtggttttcataggattaagaattttggtgttagagctagttgtgaattgtacatatcctcgtatttcttaaacagttctgtacatagtatgctgccggaaatgaaagtgaacttcacaaattttgttctctgtttccttcc

SEQ ID NO: 119 - DNA, 612 bp, Oryza sativa
attgtaaccctgcattgcacatcacaaaaacaatcgtagtaattaaattgcagctagttgtttgcaccatggcgcagtactactcggaggtggaccactgcgcggaggagatgaactggccgccgcacgccggcggcgagcactacgccgtcaggagggagtcgtacgaggaggtggacgagatggcgcgcgcaggcagggggcaccaccacggcggcggcggcggcggccacctgggctacagcggcagccgccacggtgatgcccatctgggcggccaccgggaggagcacctcgtccacggtgacgagcaccgccacggccacggcggcgggcgccagtacgactcctgcaccggccagtactacggctgagcacgtacgaggctgcagtttctgtatgactactatgtgtgagtgtgcgtgtgtacggtcgtgtacatggtgtgtgtgtgcgcgctgacgcacgtacgagcgtgtgtctacgcgcacatgcagcatcttatctatgtgctgtacgtacgagaataattgagaccgtggtacatgaataaataagagcttcgacgtgcttctatatatgcacgtttgttacagtactcctttttcattc

SEQ ID NO: 120 - DNA, 1566 bp, Oryza sativa
catgaacccaagccacatcttagcttaattacatagctcctcctcctttctccactgactgctcagtgtgttttgcatctctccattgagcaagaggagaagggaggctcagctagctagctagctaccatctatactagtatcaagtttttttgttcagatttttttgttggaggaagagttctagggagatcgatatggccttcatgtccatggaacgcagcacttgggccttcacctttggcatcttaggtaacttaatctcactaatggtattcctttcgccactgccgacgttctaccgggtgtaccggaagaagtcgacggaggggttccagtcgacgccgtacgtggtgacgctcttcagctgcatgctgtggatgtactacgcgttcgtcaagtccggcgccgagctgctggtcaccatcaatggtgtggggtgcgtcatcgagaccgtctacctcgccatgtacctcgcctacgcccccaagagcgccaggatgctcacggcgaagatgctgctcggcctcaacatcggcctcttcggcgtcatcgcgctcgtcacgctgctgctctcccgcggcgagctccgcgtccacgtcctcggctggatctgcgtcgccgtctcgctcagcgtcttcgccgctcccttgagcatcatcaggctggtgatccggaccaagagcgtggagttcatgccattctcgctatccttcttcctggtgcttagcgcggtgatctggttcttgtacgggctgctcaagaaggacgtgttcgtggcgctgcccaacgtgctgggcttcgtgttcggcgtggcgcagatggcgctgtacatggcgtaccggagcaagaagccactggtggcgtcgtcgtcgtccgccgtggtggcggccgggctggagatcaagctgccggagcatgtcaaggaggtgcaggccgtcgccaagggcgccgtcgcggcagcgccggagggcaggatcagctgcggcgcggaggtgcaccccatcgacgacgtgatgccctcggaggtggtggaggtgaaggtggatgacgaggagacgaaccgtacggacgagatggccggtgacggcgatcacgctatggtcagaacggagcagatcatcaagcctgacatggccattgttgtggaagtgtagtctgattaagcttagagaactagtagtaattctctcatgtgaggtatagccagctagctggtggtacacaaacataaacacgaacacatgttcatcgcgtacgtactagctactaggtgagacacctcttggcgtagtacgtacagtagtactccggccagatctagtagggactgtattggcgcgtgactcgcctggttcgtccagcttgcatgcagagaccgaccgagcaagcaagctaattaagctggcccgaccgaccgagtgcatgcgtgttttgtgaacctagctactgaggggggagtgaagggtgtgggtgtgcaatcgaccggcctgtcgcgtcgatgctcttgcttagcttcattcgattcatgcagttcaataataaaatttggattttactgcaaca

SEQ ID NO: 121 - DNA, 481 bp, Oryza sativa
cttctgtacctcgcagcaccaagctagctagcttcgatcagtagctggaggatgatgaggaagttggcggtgttggtgttggcggtggcgatggtggcggcgtgcggcggcggcgtcgtgggtgtagcgggggccggttgcaacgctgggcagctgacggtgtgcacgggggcgatcgcgggcggggcgcggccgacggcggcgtgctgctccagcctgcgggcgcagcagggctgcttctgccagttcgccaaggacccgcgctacgggcgctacgtcaacagccccaacgcccgcaaggccgtctcctcctgcggcatcgccctccccacctgccactgatccatccatccatcgtctcctactcttttattttgtgatgtggtgtacgtgttcgtagtattgtcttggcgtcatctcgtcacgacgcgtatatgcatgcgcagtgcggcttttgaataaaaggggatcgaccgatgtt

SEQ ID NO: 122 - DNA, 1719 bp, Oryza sativa
ttctcaatcgctctcaccgcttcgaggagagaaaacatttcttgcttgacgagctgagctgagctgagcagaggagctcccaccttctctccctctgttgcaagggatctttcggagattttgttagttcatggcggagatttgctgcgaggttgtggctggatcgtcgtcggaggggaagggcccggagtgcgacaccgggagccgagcggcgaggcggcggcggatggagatccggcggctcagggtggtcgcggagcgtggggcggaggaggagacctccgggaagaggcggaggcttgatggcggcgggggagaggcctcgacggacgaggaggacagggaggtggagcgcgctaggtacggctttacgtcggtgtgcggacgccggagggacatggaggactccgtctccgcctgcccggggttcctccccggccaccacttcttcggggtgttcgacggccacggctgctctcatgtggcgacgtcgtgcgggcagcggatgcacgagatcgtggtcgacgaggccggcgccgccgctgggtcggcggggttggacgaggaggcgcggtggaggggcgtcatggagaggagcttcgcgcggatggacgcggaggccgtggcctcgtcacgggggagcgtcgccccggcccccacctgccggtgcgagatgcagctgcccaagtgcgaccacgtcggctcaacggccgtcgtcgccgttctgggccctcgccacgtcgtcgtcgccaactgcggcgactcgcgcgccgtcctctgccgcggtggcgccgccatacccctctcatgcgaccataagccggaccggcccgacgagctcgaacggatccacgcggcgggagggcgcgtcatcttctgggacggcgcccgcgtctttggcatgctcgccatgtcacgagccatcggggacagctatttgaagccgtacgtgatatgcgacccggaggtgagggtgatggagaggaaggacggcgaggacgagttcctcatcctggccagcgacggcctgtgggacgtggtgagcaacgaggttgcctgcaacgtcgtgcgcgcctgcctgcggagcagcgggcggcgcgagaggaaccggtcgagcccgacgtccaacctaagcccgaggcagagcagcagcagcggcgacgaggcgcccaacgacggtgctccttccgccgccgctggctcggagagcgacgaggagagcgccgccgaggaggacaaggcgtgcgccgaggcggccgtcctgctgaccaagctggctttggcgcggcaaacctcggacaatgtcagcgtcgtcgtcgtaaatctcaggcgccggaaattgtgacaagtggatccatcagacatactactcctctcggtttcctggccatctctaactcgaattcacctggacgaagccgtgatcaaacagaacgttccgaattatgtgatcaaacagaatgtggcatcctcaaagcatataattgcagattattatagcattatttcgttcacttcctttctttgggcgtttgtgatctcgtcagacagatcagcccgctccttatttcagcaaaaaaagctcatgtgtttccgatgtttgaagagaaacttcctcaagcgtcagagaaattgtagtataattgagtgtcccctttgctcgtggaaatataaagaagttcctactttgctctgactagattactagattgcgacaca

SEQ ID NO: 123 - DNA, 919 bp, Oryza sativa
gtcgccgcttgctgatgatctgttccacggtgaccacgactcgctcagtttatgtatacgcacgcggctcgcttgctgtagtgtaagcagtggcattgcaaatctgtcaccgaagctgtcaatagctagagagagatagagagagagagagagagcagggtgcggcgccggagcggaggaagatgagcgggagcagcaacagcagcctggagacgcgcacgttcctggacgaggtgcgcggcctggagaagaactggatggtcgacctcggccacccgctcctcaaccgcgtcgccgagagcttcgtcaaggccgccggcatcggcgcagtccaggcggtcgcgcgggagtcttacttcatggccatggaaggggagggtgggggcacgggagccgtgtccgactccaccggcgccaggaagcgatcgttcccggatctcaacggagggaacagcagcaagtcagctgaggctatggtgaaaagcgtgagcaaagagtctctccagtgggggctcgcggccgggttgcactcggggctgacctacggcctgacggaggcgcgcgggacgcacgactggaagaacagcgtggtggcgggcgccctcaccggcgcggccgtcgcgctcacctcggaccgcgcgtcgcacgagcgggtggtgcagtgcgccatcgccggcgccgcgctgtccacggccgccaacgtgctctccggcatattgtgagccgctcagccggcaaattagctgtccggagttttaactacctgcatcttaacttctcaagtctgccattgttatgctagctgttggagcttggaagtcttcagtgtagcactcgttgtaattggcatcttgtatgcttgatttcctgtgctatcacggggtacaaataaatcgaaaaatcatgtcgaacctgttct

SEQ ID NO: 124 - DNA, 720 bp, Oryza sativa
aaaacacgtcgcaagtcgaagcacaaaacgcaagcaacgaatctcaatccacaggctcacactgatacgcaacgcacgtagctactgtactgtaggagcaaaagaaaagaaaagatgcagacggcgaaggtgaaggtgcaggacatggtgagcggtgccaaggagaaggtgaaggaggggacggccaaggcgcacggcaaggccggccaggcgacggcggccacgcacggcgagaaggagatggccaagcaggaggagaaggccggcaaggcacaggccaaggccgacgagcaccaggagagggcggagcaccgcgccaacgccaccacgggccgccacggcacgcgcgtgccgcttacggccggcggcaaccgccaccaccacgctccggtcggcggccccgccgtcgaccctgcatacccggccgccggcaccggcaccggcaccggcacgtacgcggcgtccgacaaatcgtacatctagatttggggtagatggacatgggcgggcttgatcgatctggatcgctagtgtgttttttttcagtgtagcgagtgatctggtcccagcccggccgctgatcgtgttagcttgtgttcgtacgcacgcgtgtatgctgtgtgcacatgcgtgtgctggaataaaaagtgtcagatgtaaaattaacatgcttgatgtagttctgttcaatgaaagggctttcgttttcatgtgtttttg

SEQ ID NO: 125 - DNA, 1103 bp, Oryza sativa
gacatccataacgttttcaccaaatcaactctgccatttcgtcgattgtcctcctcttcccttgacggtgcaaagcagcatctccatcgcaatggattaccaccgaatccacccggtgggcgtcggctcgccggcgccggcgccggacagccagcagcaggtcggcaaggggaggtcgacggcgagctacggtgagaaggagcagctgccgatcaccgcgccacggccgtacgcgccggcaccgctgccgccgccgccgccgcggcgcaggagccgcgggcggcggtgctgccggtgcgtgtgctggacgctgctcgccgtactcgtcctcgccgtggcgctgggcgccacggcgggcatcctgtacgcggtgttcaagcccaagataccggacttccacgtggaccggctcaccgtgacgcggttcgacgtgaacgcgacggcggcgacggtgagcgacgcgttcgaggtggaggtgacgtcgacgaacccgaaccggcggatcgggatctactacgacggcggcgaggtgacggcgtcgttcaacggcacggagctgtgccgcggcgggttcccggcgctgtaccagggccaccggagcacggtgcgccccgtcatcctgctcgccggcgagacgcggctggacagcgccgtggcgctgcagctggcgcggcagcagcaggccgggttcgtgccgctcacggtgtgggcgcgcgtgccgatccgcatcaagttcggcgccatcaagctgtggaagatgaccgggaaggcgacctgcaacctcgtcgtcgacaacctcgtcgccggcaggcagatccgcatccgctccaacagctgcagcttcaagctcaaggtctgatcgagctttgtagaggcgttgatccatctccatttctgtgaatccatccgttgagttgagattagcaggtggtagaggcgtgtatttttacatttttaccaatactagtttctgtgaatccatccgtttttggaagctctgctactcagattaggtttaatgtatgagcaccgatgtatatatgaaaatgcatacgcgatgaatttctttgaaaatggcaataaagatggcgaatttgttcgtc

SEQ ID NO: 126 - DNA, 740 bp, Oryza sativa
acgaacacgtcgccgcgcccgagctcacggtgcgcctcacctactgcaaacctctgcaaatacctataaatacaccgacgaggcagcgatcactctccattcacagcaacagcacatctcgcagcttaatttcagcttactgatcagtgatcactgagctagctgagacaagtttttgagtatggcagcgaaggcatctgcagtgttcgtcctgctggtggtggtgctcgcggtggccgcggcgatgcggggagcggaggcggcgacgtgcacgccgacgcagctgacgccgtgcgcgccggcgatcgtggggaactcgccgccgacggcggcgtgctgcgggaagctgaaggcgcacccggcgagctgcttctgccagtacaagaaggacccgaacatgaagaagtacgtcaactcgcccaacggcaagaaggtcttcgccacctgcaaggttcccctgcccaaatgctaagcacctcgtatggtcacacacgcactggtcatcaatacagtagcacaccaatggcatatgcatggttttcaggctgccattatgccatatgggtgtcagtttaagtatactaataaaatgagtcactagacagtgttctgtttaaagtttcagaataaaatccaggctcagtacgtgctcggtgtgttatgagcttctgctctgcaagctttatgtgtcatgtatatgttacagaaataaatgtgagacggctttctgcttaaggtcc

SEQ ID NO: 127 - DNA, 803 bp, Oryza sativa
gtgtagaaaagttttgatatgatggaaaagttgggagtttgaaactaaactcggccatacatgcaccgacctaacttcaacccgacgcgcaggcaagcgcggcctataaatgcatgctaacaaaccatgatcccatttccagtatttgtcgccggctatataatatatcggacgtccagacgacgtcactctttactccgatccgtttcatggcatcagaagctgctacgacctgcatcgggtttatcctcctcacagcaagctcgatcgctgcgatccacaggtcacacggagaaatcaccgagacgtcgttcatcgtcgtgtcgtacctcagccttgtgctgctcttcgtgttcctccgccgcttcgaggcggcgccgcggaattcgccggcgaggggcggcgccaaggccggcgtatgggtcgtcacggcgctgctcgccgcggtgttctcgtggagggtttccgcgctcatgccgtggccggtggatgcgattatttgggtgatggccgcctcaactgttcttgggggattctacgccttgttccttcatcatcccggcgtagactgaaaatgatcgatcgatcgatcgacatgctgaagcaatggaacagttaattcctgtgtaaatatcgttacgtactggctgctagctattggatattgcaaatgtttggttctttctacacatgtatatatacatatctagctttactttatatatacataaaccattgtacatgtacaaatgttacacaaaatgtattaattgtagtagtagtacttaatttcgtcttcgact

SEQ ID NO: 128 - DNA, 2233 bp, Oryza sativa
ggcaaacttacaaattgtgcggcccttcctatcattctgggaatcgcatctgttgcaacttccctccattttcaggccttctgattcaggctgcccccagcttagtttgagaagcaaactgccaataaacacagggtgaaaaactgaatcagtaactgtaaaaattggtaagcctcaggcgctcagttttcttttacctcctcccatcttttatatgccaccggaagacaaagccctttttgtctccagacttcctgctccctctgtgtgtaatgcagacatgaggaaattcatagcagcactgcggcttgcactagcagcagcagctcatctgctgctgacgctgccaccggcacaatgctactggctcaacccggagatctacgacgccggcgggctgagccggcgagccttcccggaggggttcgtgttcggcacggccgcgtcggcgtaccaggtggagggcatggcgaagcagggtggccggggccctagcatctgggacgctttcatagagaaaccagggacgatccctaataatgccacagccgatgtgacggttgatgagtatcataggtacaaggaagatgtgaacataatgaagaacatgggctttgatgcgtatagattttcgatctcttggtcaagaattttcccaaatgggactgggatggtgaaccaggaaggagttgattattacaacaggttaatagattacatggttaagaaaggcatcaaaccgtacgcaaacctctaccactatgacctaccattagcactccatgagcagtacttaggctggctaagcccaaacatcgtagaggcgtttgcagactacgcagatttctgcttccagacgttcggagacagggtgaaggactggtttaccttcaatgagccgagatgcgttgctgctctaggatatgacaatggcttccatgccccgggaaggtgctctggctgtgatgcaggaggcaactccacgacagaaccataccttgctgcccaccatctcatcctttctcatgctgccgccgtcaagcgataccgcgaaaagtatcagctttatcaaaaggggaggattggaattctcttggattttgtctggtatgaaccattcagtgacagcaatgctgatagggctgcagcacagagggcaagagattttcacctcggatggttccttgaccccattatccatggtcggtacccatactcgatgctcgaaatcgtcaaggacaggatgccaaccttcagtgatgaggagtccaggatggtgaaagactcaatagattatgttggcatcaaccactacacctctttctacatgaaagaccctgggccatggaacctgacaccgaccagttatcaggatgactggcatgttgggtttgcctatgaacgaaacggcgtgcccattggagctcaagcaaactcctactggctttacattgtgccatggggaatcaacaaggctgtgacctatgtaaaggaaacatatggaaaccctacaatgatcctttctgaaaatggtatggaccaacctggcaacgtcagtatcactcagggtgtgcatgatacagtaagaatcagatactacagaaactacatcactgagctcaagaaggcgatagacgatggtgccaaagtgattggatactttgcttggtcattgcttgacaacttcgagtggaggctcgggtacacttcccgttttggcatcgtctacgtggactacaagacgctaaagaggtaccccaaggactcagctttctggttcaagaacatgctctccagtaagaagaggaactaaagtatgcagacaaaaggatcaagctgtgaaagcctcaaaggcttccactgtcagatttcagaacaaagctaactctagcgtatgctcatcgtagcgcgttagtttagctttagttatatgtgaaaaacaaccaatgtggagattggtagcttcactagcttctgcaacagaaggagaaataaatggattgaacttcaatacagatttgttcatcagaaccgtaggctatttgtacaataaagagctgacagaagggactattcaaaatatctaataattcctattcaacagcacagatttcattcccacagagaagttcagataacagttaattgcaaaaagaagtgtctgaaaatggaactcattatacttgattactccagttcgacatacactaatataaagcgcgatgacataaaa

SEQ ID NO: 129 - DNA, 4420 bp, Oryza sativa
atcgcttcttttcctggctgtacagctgctcagtggcttccatatccataacaagcatatactgtaactagtatattttgttttgtcctggctatgctgatgctccttaaaacgaggagttggggtggttgatggcgtgcttatcttccacttccatggatgtcaaatgagcaaaacgaatgaaaatggtgaatataccccggaggaaatattcggtgcgctactgccccacatgtcaggcgcacactgattcgtactagtaataaaaatggccctcacttcatcacccatataagaacacacaagaggagaagagaagggaagagcccaagcaaaagcaaaagcccagaaagaaggaagggaaaccccacgcggaggcggagagcggagtggcggcgggatggactccacctacgccctccacctcgccgtcgccaccctcctcggcgcctccttcgccgccgcctccgcctactatatgcaccgcaagaccctcgaccagctcctccgcttcgcccgctcccttgaccgcgaccaccgccgccgcaaccgccacctcctcgacgccgacgacgacgatgacgacgaccctcccagagaccacgatcgccgcaccacccttcccatcccaccgggccttccgccacttcacaccggccgagaaggaaagccaattatctcaccagcttccaccaaaagagttggacctttggttagacctactacaccaagatcccctgttcctactgtcagtgcatttgaaactattgaagattcagatgacgatgatgagaatattgccccagatgccaaaaacaatgccgtttccttgctcacaaatggaactattggatcagatccccttccgggtaaagcaagtcagaatggggacacaaaaccagtaccatcaacaaacatgattagatctcaaagtgcaacaggcagtctgcatggggcccagcacaatccagttgcagctgatattcttcgaaaggaacctgaacatgagactttcagtaggatcaatataacagctgttgagactccatctcctgatgaaattgaagcatacaaggttcttcagaaatgtcttgagctacgagagaagtacatgtttagagaagaagttgctccatgggagaaggaaatcataactgatcctagtactccaaaacctaatcctaaccctttctattacgagcagcagactaaaactgaacatcattttgaaatggttgatggtgttattcatgtataccccaataaagacgctaaagaaagaatctatcctgttgctgatgctactaccttttttactgatatgcactatatccttcgtgtgttggctgctggggatattcgaactgtatgttataaacgtttaaatcttctagaacagaaattcaatcttcatttgatggtcaatgccgatagagaactacttgctcagaaagctgcaccccatcgggacttctacaatgtcaggaaggttgatactcatgttcatcactctgcatgcatgaatcagaagcatctgttgagatttatcaagtccaagttgaggaaagaacctgacgaggttgtgatttttagagatggtacctatttgactcttaaggaggtttttgagagtttggacttgactggttatgacctcaatgttgatctcttagatgtgcatgccgataaaagtacattccatcgctttgacaagttcaatttgaagtataatccttgtggccaatcccggctgagggagatctttcttaaacaggacaaccttattcaaggccgatttcttgctgaattgacaaaagaagtattttctgatcttgaagcaagtaaatatcagatggctgagtatagaatatctatctatgggagaaagaaaagtgagtgggatcagatggcaagctggatagtgaataatgaattgtacagcgagaatgttgtttggttaattcagattcctcggatatacaatgtatacagggagatgggaacaatcaattctttccagaacctccttgacaatatttttctgcctctttttgaagtaactgttgatcctgcttcacatcctcagctccatgttttcttgcaacaggtcgttgggctggatttagtggatgatgaaagcaaaccagagagacgcccaacaaaacacatgcctacacctgagcaatggactaatgttttcaatccagcatatgcatattatgtgtactattgttatgctaacttgtacacgctgaacaagcttcgtgagtccaagggtatgacaacaatcaaacttcgtccacactgtggggaggctggagatattgatcatcttgctgcagcatttcttacttctcataatattgctcacggggttaatttaaagaagtcccctgtcctccagtatctgtattacctagctcagattggtcttgccatgtctcctttgagcaacaactcattgtttattgattatcaccgaaaccctttcccaacatttttcctaagaggccttaacgtttctctatcaaccgatgaccctttgcaaattcacctgacaaaagaacctttggttgaagaatatagcatcgctgcttcgctgtggaagctaagttcatgcgacctatgtgaaattgctaggaattctgtgtaccagtctggtttctctcataggctcaagtcacactggattgggagaaactactacaaaagaggtcatgatggcaatgacattcaccagacaaatgttcctcacatcaggattgaattccgacacactatttggaaagaagaaatggagctaatacatctgaggaatgttgatataccggaagaaattgataggtgaagacctggcaagaattttgcaaaccctgaagttacttggttgttgatgatggtcctggaaggcaccccatcttcctaccataaactttccaggtacaaccaagaccgtgcggtttctacttgcttgcggaagggaggagaaagggatctaggatgattctacttttcgatgaatctccgtagcgtgttgcgttccctagtagtaggattttgataaaagaaattatgttaggactgaggccgtaccataaaataagaaagatttgagtcatggaatactggaagtttaaacatacgcatgcatcgggggtcatatagtccaaaataacaatggaaaattgataaaccccaactagccaagggtctagtgaggttgcacatgtgctgtaagctattactagtacacgcgtacatttatacatgtgatgccgttcgatacactacctattttgttttggtcgaactgtacgacgacatgctggtccatctcaatgacagctgatagcctgaggcatactatgcatgtagagctgatggctgagcaatcacaacttcacaaggggaaggaagtgtgatgacggtcacgttagtcgttagtacaaacttggacacgggtgtccttgtcctctttggcacgttcgttctttcggcatggcagacaccaaaggcgacaagaggccgtttgatgtacactcttgtgtttcgtctttgtttgtttccgattctaatccctcccttttttttctgattatacaaaaagaactactcacagattgcatagcagcaagggagaataaatgagatgagattagttgcaggaaggaaggaagggctaggcggcatgggcgacgatgtgggcgtagaggaagtggttccaggtgtcggggaggccagggaggcaccagtggatgcagtcggcgtaggtgcgagggtcggcctgctgctccggggtcagcagcttgccctgccgcagcgtgtgcaccgacgtgtgcgcgtccttgcgaagctccgacagcgccgtgatgtccacgaatcgcacgcccacccgccgcatcgaccgcagcacaccgcgcgccaccccgtgcagcctccagtccgtcccgatgtccagcccccctgatgtccggttcacgatcggctgcgtctccatcgcgcacttcaccgcccccgccgatcccccccaagcctccggcctgtacatccgatatttcacttattagatcacacaaattcagagctggccaccatatggaccaacaaacagtaagcactccactgcacagtagatacgactcgactagccaaatcccactcgcatatggatctgcctgtcacccactttactttaactcactttcaccaaagccactagtgagtgactcagtgctgtagcactggagtggagcatcttagcaaaataatggtcagattctgtcaggcaacactgtgctgctatacatgatactactgatctgtagatgcgacaaccaaccttagccgcccttgagctgatattgccagcctaaaacaatctgattacggccaccgttgctcgatccggagctgcaaaaca

SEQ ID NO: 130 - DNA, 728 bp, Oryza sativa
cttcaacaattacaataatcatcaagcttcttcttatgttcatccaaatccacagccataaaagtagccatacttgagtttaggtagccagcatgcaggccgggaagaacgcgatgcagtcgaccaaggaggccgcggcgaacgtgggcgcgtcggcgcgcgccgggatggacaagtcccgcgccgccgtgcagggccaggtggagaaggcgacggcgcgcaacgcggccgacaaggacgcggcggaggtgaggcggcaggagcgcctgcaggccgccgaggaggagaagcagcacgccatggccgccaacgcagccgccaaggagcgcgccacgggcggcgccggcgcgtaccacccgtcgcagggcgcccccggggtggacccgcgtgcggcgcagccgacgggagggcacgtccaggacggcgtcgccgagagccggccggtcgggacggccaccggcacggcgaggcccagcgccgcccacaacccgcacgtcggcagcgacttctcgcaggcccacggcaccggcggccagtaccagtgatctcattctcatatcaatgtgacaatttatgatctactagtagctgttcatcagttcatgtagagttcacttcgctactatgagttgatggggaataaaattgtacgtgttagaagtggtatcatgttgtgggagatgcttaattatgaaataaaacagagtactctcttcgtttcacaatgt

SEQ ID NO: 131 - DNA, 672 bp, Unknown
  Sequence found in Organisms: Oryza sativa, Brachypodium distachyon
acacacacacgcagagaagatcatatcggatcggagaggcaatggcgagcactaagatggcggtggtggcgatcctggcggcgctgctgctgatggcagctgcggagccggctttggccacggcgcccagcttggtgccggcaagaaagttgcagatgcctcgcatcatggatgtcatctccgcagagtcaaagctggcttgcctcccagcaggcggtttttgcatgtttcgtcctatggattgctgcggtaactgcggttgtttatatcctgtcggggtttgctacggctcacggtgtgaggaatgaactgtacgtacgtacgtgtccattttactagctaatcacgcatctgcagtgtcacaataaaatcgccttctgcgttcggtccctagcttgttgctcatgatcaacaagctctgttcaagtatcgagtctgttagtttgttgtcaggtacggtacgtaccccctggagtctagcttccggccctggactcgctcttcacgtcctgcatgcgtcgtgggggatgtgacaaggatcgagctcccagggccgttccttttgagtcatataaataaaacatagggatcagtgtgcgcacgttgtgatcgtctacgtttgtactgtgtttctcaaaaataataataaaaaaattccaagtgtatgttcgc

SEQ ID NO: 132 - DNA, 1072 bp, Oryza sativa
accgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctctgagagtgttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccaccggcggcatgggaacgcacggcaccaccggcggcatggggacgcacggcaccaccggcaccggcggcggccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgccgccggcgacggccgccacgtcaccttcctgaataataagatgagctagccgagcgcaataaaaggaaaaaaaaaatgttactgtcgtgtgatgagtgtgaatgtgtgatggcgttctccagtacggaccgtgtctgcgtgttgtttgtactgtgaaagtacgctgtgtatgtacgtcgtatgtgtacaattccgctttgttgaaatacgtataaatatatactgtgtgtacattatacggtgt

SEQ ID NO: 133 - DNA, 769 bp, Oryza sativa
gcctccgccacctcctccccctctccacacactcttcttctccactcctccgccgctcgcctcgccgcgcgccgcttatatacccgcgtctctgcgctcatcgattcatcacccagatcgcaatccaaccaccgcaaccaattcgccggagaaagttgtgaataccgacctaccggcggcgaagatcgatgatgtacatgcgcgcgacgcaccgggacgaggaggggaagaaggtgacggagaaggtggcggtgccggagacgcggcacccggacacggccaggcacttcgagcggaagctggaccagcaggggctccaccgcatggagcgccacccggcgaacggctcccgcggcatcggcgcgccgccgcccaagtccggccgcggcggcaagttcacctgggagggccccgacagcatcgtcgacagccagctcgatcccctcccggccgccatcgaccgcaacgaccccaactacgaggaggaggaaggcgaccacgagcgcgaggccgacgtcgtcggcgaggtggaggtcgccaaggtcgccggcgacgccagggatggtgtcgccagggtcgacgtcgtcgcgccgccgcagctgcacgagaaactgcagctgcagccgcagtaggggcgcccagccgccatttgagtggtgttttcgaagtgtgtttgttactttgtttgagtgtttatttacggttttgtatgcgtgttatttatgcctctgtatgaataataatcgagcatcaaactgaacttggatga

SEQ ID NO: 134 - DNA, 1015 bp, Oryza sativa
ttctgctgcagtataaaggaggacgcggcggccggggcgagcagcagagagcggcgcccgcggtggaggagattcggaatcggatatgcggcttcttcgccggaagtcttcgatgggcggcggaggtggcggtgggagggggctgaggcgggtggttagcttgccgaggtcgccgatggcgctgtcgctggcgccgagggcgtcgctggccaagaccgagtccatcaagaagagggataagaacaacaacaaggggtccaagagggcccgcctccgcgccgggctctccgccgcgctccacctcggcggcggccaccgccgcgccggcagaagaggcggcggcggggacgaaggagccggagcggtgtcatcagcggcggcgccgggtgttgcagtgctgcttcgcgcggccgctgatgacgccgacgagcggcccgcggcggcggcggcgaacgtggggcacgggggcagagatcacgcgagcggtggccgcggccggagctgggcggtggcggtggcgatggtgctcgtgctggcgtgcgtggtggcgctcggcaggggcccggccatctgctgctgcacctgcgccgcctggtggtgcggcggcagggcggtcgaccccgcgtgccggcgacggtggagcagcataggcggcggcggcggcggccgccatagcagcgtaccacctcaagctggttgcttgaagcactagtacttggcttgtgaattgtgatgcgtgcgtggcaatgtgtatagcattttttccccctttttgtttactccctccgtttcacaatataagtcattctatcatttctcacatttatatttatatctaaatttattaacatcaatatgaatataaaaaatattagaatgatttatattatgaaacggaggaagtatttattagtataccttttccatcttctttagtattttttcacagtgcaattttgtcctctagttagtcacggtaatttacagtgttttattaattttagctttgttgata

SEQ ID NO: 135 - DNA, 1953 bp, Sorghum bicolor
atgacgatgacggacgaagcaggcgagctactactactaccctccagccgggcctgacgagggcgacgacccgggatctgacaatcccaaattccaacgcgctgagcggcgtcagctgccaacgccgccgccgcagctcaaacgtgcgccgcaaccacgtgtcccgtcgcacgccccgcgtcagcggcatctgtaaagccccccttgtcgccgctccggcgtccaccccgcccccgcccccgcgcttttattccccactgcaccgcatctccccctcccctacgatgccgttgcgcacctcctctctcaccgccccgagacctccacgcttccctcaccgccctgaaccgtggcgcctccccccgctgcctccgccgccgcgatgctgctcgcggcagagcccgacgacgctcatgaggaaggggagaatcagcagctgctaatcacgacgaagggagggcccgggcttgagggactggtggtggggagctactgccacgatgtgctgatccggggcgggcgcgtagtgggggagacgctcggcggggctgcggccttcgtgtccaacgtgctcgacgccgcctcgccccaggacgctgcgctcaacgggacagcccccttcgtcgtcgtggccaaggtgggccacgacttcgtctacgcctccgcgccggcgcccgcgcggcatccgcctctgctctgcgcgtcgccgaccacctccttccacgcccagttctcggagaccgccgcctcggcgcacgcccccgaccgggagctccggcgcgtgcgcgcctgcgacccgatctaccccgccgaccttcccgaccgccgcttcgcctacggcctcgccgtcggcgtcgccggggaggtgctaccggagacgctcgagcggatgatccggctctgccgcgcggtgctcgtggacgcgcaggcgctgatccgggcgttcgacggcgacggcgccgtcggccacgtggcgcttgacgatacgccgtacgcgcggcttctgccccgggtggcgttcgttaaggcgtcgtcggaggaggcgccatacgtcggggtggaaacgacgaggcagcggtgctgcgtgatcgtcacggaggggagggacgggtgccggctgtactgggacggtggggaggcgcgcgttgcgccgttccccgccgtccaggtggaccctactggcgccggagacagctttctcgcgggttttgcaaccggactgctgtgggggttgtcggcgaccgacgccgcgctgctggggaacttcttcggcgccgctgcggtatcgcaggtcggcgtgcccaccttccatcccaagatgttgcaggcagttaaagaaatacttgaagagaagacaacaaaacgatatagtccgtgtataaacggcactagttttaccttcgagaagtcaaatttgcacaatgagttacacgcagctctccaagaagcggcgatgctgatgtctgaacagcagcaggctgataaggccaacggcaatggtggtgatatttgctcgccataggaactttacttcacagtgaagcagtcagacgccaaactgaaagttcgtggcaaaataacccagcactgcaatacagatctcacattgaggtctgtaaacacgttgccaacaagtggagaaagtttgtacattagtacatacgttctatcggcttatactagtgtactgctggtgaggccgtgagggttcgtttctacctgctattgctgaggagaaagtgaaaagcagttgagctgtgacgcttgtacgcatcctgttttattgagctttctggcatcgtgcggttaacgttttaccattatatgtcgacttttatcaagatctagcgtttttaccctgccgacaaggggatttatgactgaaatgagaacgggccaacacgcaagttagcgcgtcacggatgtctgaattcgctttcaacatctagcatt

SEQ ID NO: 136 - DNA, 3433 bp, Sorghum bicolor
gccgggggatcgaattcggcgggggagccagcgcggtgggggcgaatggctggcggggcggaggtagcggtcgtggaggacacggcggtggtgggggcgccgactgcgacggcgacgccgccaccgcctgacgcggccggtggcgcggaggaagggatgcggatggagggctggctttacctgatccgatccaaccggttcgggctgcagtactcccgcaagcgctacttcgtgctcgaggacgccgcgctccgctgcttcaagtccgcgccatcctccaagcgcgaggatcctgttagaagtgcaataattgactcttgtattcgtgtgacagacaatggcagagaaagtttacataggagtgacttttacatattcacactttataatgcttccaatcattatgatcaacttaagttgggtgcgagaagttcagaagaagcagctaggtggatcaggtgcttaatggagtctgccttaaagtcccctagaaaagatgagcacattgttgcttgttcacacagaagatggcaggctttcaggttgagccgccgcaatagacaaatgcactcaatagattggactttattttcatctgctcataacgatccaatggcatctgatgttattgcaccttctccatggacaatatttggctgtagaaacgggttacgtttgtttactgaggcaaacgatggtggctctcgtgggaagtattgggatgatcatccagctataatggcagttggtgtggttgatgcgaattctgaggctgtcttccagactctaatgtcccttggccaatcaagatctgaatgggacttctgtttgcgggaaggaaaggtggtcgagcatcttgatgggcatacagacataatccataagaaattaagaggcgactggttaccatggggaatgagaaagagagatctattacttagacgatattggaggcgagaagatgatggaacttacgtaattctataccactctgttttccactacaaatgtcgtcctgagagaggctacatccgtgcatgtcttaaaagtggaggttatgtaatatcaccagtcaatcaaggaagacaatcagttgtaaagcacatgcttgccatagattggaaattctggaagtcttatctgtttacatcatctgccaaatatatcactatacgtatgctaggcagagtagcagcactacgagaattcttcagagcaaaaaatggtaattgtgcttgcatggagttctcatctggtgagttgaccagggacatgggactaccacaaggtgaaaatcagcgaataaatttggagattcagcaagaaaatgagaacagaagacttgagggtcctactgaaggatcagtgggtggttctaacaggcacttaaacagtaccagttcctttgttcaacttaatgacgcgacagacgagttctttgatgtaccagatgaatcagaatatgatcaaagagaagttatgtttccttctgatgagagcacacatgcttcggatcagcgtcatgctaaattgtccaccgctgctgtttttgtaaaaaggttgcatgatcttgcagtccagaaaagaggatatgttgacttacagggagctgcagatgctgataatgggccatgttgctatggatatactcttcccaaagattcgagctatgcagtaccttctacttgggcaatgacagatcctacaacattcttaatccggggagagacttatttgcatgatcgtctaaagatcaaggcaaatagtaccctgatgcaaatggtaggtgctgattggataaagtctgataagcgtgaggatgatctagctggtcgccctgggggactagtccagaaatgcgcagcacaaggaggcaccaaattcttcttcgttgtaaacatacaggttcctggttcaacgacatacagcttagctttgtattatatgatggatacgccattagaaaaggtccctctgcttgaaagatttgtaaatggagatgatgctttcagaaattcaaggttcaagctcatcccttacatctcaaagggatcttggattgttaaacagagtgtgggcaagaaagcttgcttggttggacaagcattagaaatcaattatttccgtggaaacaactatttggagcttggagttgatataggttcatcaacagtggcccgaggtgtcgtgagcctagtgcttggctacttgaacaatctggtgatcgaaatggccttcttggtacagggcaacacatatgaagaactcccagaattcctcctaggtacctgccgactgaattacctggatgcctccaaggcagtatcgatagacgagtgctagaaggaccccaactgacctcattctttttgaagactgtacatcaaaagaccaaaaggctgaatccattccttgctgccgacacaatcggcagccccagatgctccttgtattgcccccgccaaaagtggggatccactgcagacgttgtacattctcctctcgccgactgctcaggtattgtgttgtaatgatgatagcaatccatgataaaaggcccccattctttggcatcttatcaccacgaaaaaaagaacggaaagaaaagaagtgtattctaatccttgtaccatggtgtcccatctgacctgagtgatgtcagatcgttggatctaacagcaagcaaaccattaactatgcattgaccaggagagcaatagctggaatgattgtatttgagaactcgcggttcccccactttgaactgaaagggatccccaaccaaaatagcagtgatcatgggtgctcagatcgcttgaaccgaaagcatcaacaaggagtggagcttgcgtctatcccttaagtcctcgctcctctacaaggacagcatgataaaacggtggtttcatcatcgctgcatcatcgcgctcgggcgcactgttttatgctagcggtagcatcagcttttcgaatgttcattgttcgccacgctgtgtggtccttcaagtgcttggagccgccgatgtgacggctgaacggccgggatcgcttttgctgtgccagtcgcacttttgatccaacgacgtgtcggtcgcgtgcaatcttggttctgaggtttcggtcagcgtgcgaacatggcacggacggtgggattactgaactggatagcgcgatgcacgggcgcgtgccggtccggcccttcacgtgtgtccggtgtgcagtgcaacgtaattagggcacctctaaggacacctctgctagctcttataaatcaaggcagcaaattgctgccatggaacacctctgctagctcgtaggcagcaaattgtaattgaagagagacattttttattctcatgttaggttcagaaggactactaaaatatatttttcgtgggagacctatgaaagttgccatctaaaaaagattgag

SEQ ID NO: 137 - DNA, 2332 bp, Sorghum bicolor
caaaaacccttccggcccccgagccgaccggaaaccctacccatccccctgcgccgccgccgccgcccgctccttcacctcctacatcttctccggccgtcttcccgatcccctacgttcgagcttagctgaggcattatgggcaagtcaaacaagaagtccagtgttggggctgcacctgctgctgtcgcagttccagaggggaaatctgtaaagaaggggaagaggaatgcagaagatgagatcgagaaggccgtgagtgccaagaagcaaaagactgcacctgaaaaggccgtgccagttaagaagcagccccctccaaagaaagttgagagcagcgactctgaggaggattcttcagattctgaagtgaaggtgccggttaagaagcagccccctccaaagaaagttgagagcagcagctctgaggattcttcggattctgaagtggaggtgccagttaagaagcagccccctccaaagaaagttgagagcagcagctctgactctgaggaggattcttcagattctgaagtggaggttaaggtgcagccaaaaaaggttattcaaccaaagaaaggtacacaacttgctaaacaggagtccagtgatgacagcagctctgagagctcagatgatgaaccttccaaaaaaccagttgccggttcaaagaagccagctgccagtagtagcgacagtgatgacagcagtgacagtgatgatagcagttctgatgaggaacctgcaaaaaaacccactgtcctttcaaagaagcctgtcacagcagttagtaatggttcaaaacaggttaagcatgatagcagcagctctgacagtagctcagatgaggatgaaaaacctgctgctaacctaaagaagcctccagttgcctctctgcaaaagaagacccaagaatctgatagctctgacagtgattctgatgatgatgaatcagaagatgatattcctgctaaagctccagtagtggccaagaaaaaggaagcatccagtgacagttctgattctgagtctgaggatgaggataataatgctaaaacagtacagcctgtgaaggctgctgctcctaaaaagaaggaagaatctagtgggagctcagaatctgactcagagtcagattctgattctgatgaacctgaaaaacctactgtgcctgggaagaggcctctagcaacaaataagaagaatgaagaatccagcgacgaatctgatggcagctctgatgagagttctgatgaaagtgacgaggagccaccacaaaagaagtctaaggaaactcctgtagacactacgcaaaagtcagcacataatgagcccaaaactcctgccaaaagccaaagtcaggctactggttcgaagactatttttgttgggaatttagcttatagtatagagcgtgaacaagttaaggaattttttgaggaggctggagaagttgtagatattcgtttgtctacttttgatgatgggagtttcaagggttatggacatgttgaatttgctactgctgaagctgctcaaaaggcacttgaatttggtggtcgggacctgatggggcgttctctaaggattgacctggctgtcgagaggggtgcatacactcctaacagcgggaaggacaacggttcattcaggaagtctgctcaaaggtcaggcaacaccgtgtttatcaagggctttgacacgtctgttggagaggaccagatccggagtgctctcgaagaacattttcgctcatgtggagacattacccgtatttcaattccgaaggattatgacactggtgcaagcaaaggaatggcatacatggatttcaaggacccggattccttgaataaagcatatgagatgaatggaacctaccttggtgactacagcttgtatgtcgatgaggcaaagccgagacctgataacaacagggacggtggcttcagtggtgggcgtggtagcagagggaggagtgacagggggcgtggtgacagaggccgtgggcgtggatttggaggccgtggtggaaggggtgacagaggccgtggaggccgtggcacgcctttcagacagactgctggtacccctagtgcaggaaagaagacaacgtttggtgatgacgattgaagatcccatggctggcgattatagtgaaaccaactatattgtacctttcatacttctgctatctgttctccttttggaggctgtagtgttttgtttgcttgataattttgacaattgtattgccatttttaacattcggagctatgaagttatatcgtagacgtgatttatatttataatatatgagatcaagttcgta

SEQ ID NO: 138 - DNA, 2196 bp, Sorghum bicolor
agaaaaaaaaagcgagacctcgcagctgacgcgctcacggcaaaccccaatcggagccgcggaccggatcggagctaggtctcgaggccatggcaagcggaggcgagggcgcagggagcggcgagtcccctcccgctgcctcagtggaggcggcagcgggggaggcgacgctgcacatccggtgcgcgaacggctccaagttcacggtgcagacggacctgggcgccacggtgggcgcgttcaaggaggtcgtagccgggagctgcgacgtgccggcgccgcagcagcgcctgatctacaagggccgcatcctcaaggacgagcaaaccctagaaagctacggtgttgagacagatcacacaattcacttggtgcgtggtgtcgccccaccagctgcatccagtgcacctgctgctgccagccccctagcttcatctactcctagtagtggccctgcaggtggcctgggaggcctatttccaggtcttggtgctccagcaagtggtaggccatcaggtatatttgggccaggatttccagaattagagcaagttgaacagcatttaagccagaatcccaacttgatgagggagataatgaatatgccggcgatgcaaaatctcatgaacaaccctgatttaatacgcaatatgatcatgagcaacccacaaatgcgcgagatcatggatcggaatcctgatcttgcccatgtgctcaatgacccaagtgtcctccgccaaaccctcgaagctgctaggaaccctgaaatcatgagagagatgatgcggaacacagacagagctatgagcaacattgagtcttctcctgaaggttttaatatgctccggcgcatgtatgaaactgtccaggagccacttctaaatgcaacaacaatgggcggggaaggaaacacagcctcaaacccattttcagctcttctcggcaatcaggggtctaaccaacctggacaaggtcaacctgcaacaaatgctcctgctactggctcagagtcgacaactggaaccccagctccaaatactaatccactgccaaatccctggagcaccaatgctgggagtgcacaaggagcaacccggtctagtcctagtggcaacgcaagaactggtgcttctggtggcgttgcaggcactggtgccactggtggactgggagggttgggttcaccagatttgagtagtttgcttggtggtcttgctggcaatccaagaactggtgctgctggcggtttaggaggtttgggttctccagatttggggaatatgcttggtggttcacctgatgtctctctttttaatcagatgttgcaaaaccctgcaatgatgcagatgatgcagagcattatgtctgacccacagaccatgaaccagttgcttaacttcaacccaaatacacgcaacctgatggaatcaaacactcagatgagggaaatgcttcaaaatccagaatttcttcgccagctgacatcacctgacactttgcagcaattactctcatttcagcagtctttattaggacagcttggtcaacttcaacctagccagggtggcaacaatgcaggcagtgccacaggtacgcagggaaaccctagccttgacaccttgatgagcatgctcagcgggcttggttcgggaggtggcctaggtgttccaaatacttccaatgtgccaccggaggagctctatgccacacaacttactcagctccaagaaatgggtttcattgacaccgcggagaacattcaagcactggtcgctaccgctgggaatgtacatgctgcagtggagcgtcttctcgggaaccttggccagtagcttaagcgagcgagccagacactgcccgcaaatcttaaaatgtcacgcatctgcaggagtgtttggcttaacgttcttcaagccccagaatttgaaggcggcggcgtccatagtcccgaaaacaaaataatcaaaaagtcaggcagccattaacttttctcatacatggtggtcatgtctttgtttttacagtgttgtatttgcgatttggattggtgtacatacatatcggtcggatgttacctcatagaatgtctgtagtggtgtcttttcaacagttgattcttgattctcaatatatcaaatcaaactatctgatccaaccggtggtttcctctggaaacatgtgtcagatgctttctcg

SEQ ID NO: 139 - DNA, 1612 bp, Sorghum bicolor
attcacacacacccgttcaccgcccgcaggcaggcaggcagccagccagacaagggtcttcatcgcccctgctctgctcctctcctccctccctccccaatcccgatcccagccccgccgccgcccgccgccaaatccagcccaacccgcgccgcgatgagctggtggtggacgggcgcgataggcgcggtcaagaagcggcaggacgagcaggcggcggccgcggagccctcgtaccagagcgtggccctcgtcgtcggatccaccggcatcgtcggcacctccctcctcgacatcctcccgctcgccgacaccccggccggtccatggaaggtctacgccgtctcgcgccgcccgctcccgccctggtccccggcgccctcccccgccgtcacccacctccacctcgacctcgccgacgccgccgccgtccacgacgccctcacacccctcaccgacgtcacccacgtcttcttcgtcgcgtggaccagccgcgccaccgaggcggagaaccgggaggccaacgccgccatgctccgcaacgtgctctccgtcgtcgtccccaactgccccgcgctcgtccacgtctgcctccagacggggcgcaagcactacgtcgggcccttcgaggccatcggcaaggtcgccaccccggaaccgcccttcaccgaggacatgccccgcctcgactgccccaacttctactacgacatggaggacgtcctcttcgaccacgtctcccgccgcggcggcgccgtcagctggtccgtgcaccgccccaccaccgtcttcggctactccccgcgcagcgccatgaacctcgtcggcagcctctgcgtgtacgcagccatctgccggaaggagggcgccacgctccggtggcccggctccagggtcacctgggaggggttcagcgacgcctccgacgcggaccttattgccgagcacgagatctgggccgccgtcgatccattcgccaagaacgaggccttcaactgcagcaacggggatatcttcaagtggaagcagctgtggccgatcctcgccgatcacttcggggtggaatgggctggctacgaaggggaggagaacaggttcaggctcgaggatgccatggccgggaaggaagccgtctgggcggagattgtcagggagaatgaacttatagcgacggagcttgacgagatcaccaattggtggttcgtcgatgccatgtttgccgtcgagacccagcttctggacagcatgaacaaaagcaaggagcatggcttcctgggcttcaggaacactgtcacctctttcaacacatggatcgagaagatgaaggtcttcaagattgttccttgattcgtccctgcaattcagttctctactgttgctttcacatcctttctgcgcgcgccttattatcttgcccatttatcaacttccaggtctcttgtaatttagttctgtttcatacattttgctatctatgcctggtttgcatgttgtatactgttgtatactaggaacaaataaagatgatcaacacattgcaaatgagttattcttgttcagcttcagtttgattgaattgtgtgtgtgtgtgtgtgtggattgatttgaatca

SEQ ID NO: 140 - DNA, 1340 bp, Sorghum bicolor
aagctttcgtccttgcttgggagcagcctcctgcaaggctgtgttagttaccgtgtggggggcacggaggccgaggccggcccatggcgtccagagacttcctgcgcgtcttcggcgaggggtccgggtccgggtcgccgaaggccgccaacgccggcgccggaggcccgtccgacgacgtcgagctcagcctcggcctctccctgggcggccgcttcggcaccgacgccgccgccaagcgcccgcgcctcgcgcgctcctcctccatcgcctccgtctgctccgtctcctccctccacggcgacggcgacggcgagggagacgccgacgccgacccgtccccggccgcgccgctgccgctgctgcgcaccacctcgctgcccaccgagaccgaggaggagcgctggcgccgacgcgagatgcagagccgccgccgcctcgaggcgcgccggaagcgcgtcgagcggcgcaactcctccatggcctccctggtccccgccggacccaagcccgccgctgcagccgcggacgcgaacgcgaacgccgccgtcggcagcgggaggaggtccaacgcctcgcaggggagcaactctgtaagcaccactgagcaaggtattggtggaagcgcaattaaccagtccacagatgctaggagtccatcaacctctgataacacaaatcaaaatagcatgcttcctccaaccaaagcggctgagaagccactaaatggcactcccacagagcagcctcgcctgcggacgcttgggtccctcacaacacgtacgagcagtaccagtgacatcaggaagctcatgatggaggacatgccaatggtctcatccaaggtagaagggcctaacaccaggaggatcgacggcttcctgtacaggtacaagaaaggcgaggatgtgaggatagtatgcgtctgccatggtagcttcctcactcctgcagagtttgttaagcacgctggcggcggtgatgtgtcgaatccgcttcggcatatagtcgtcaaccctgctccattctcatgaacagggggttacagggttaaactgctgctggtatctactgtgctgtaacatgtaggctccctgtttcggggagttcaacggaaggtctctgtattttacataaattgagtgtgacagcaaattcaagagaaatgtcatctgcaaatgttataggcttgtctacaaattgacaaggattcagttgctgcaataggtgggtcgtagtctggcaccctggaggacatgcaggcttacaacacgagcctgttctttaacattaaatcgctcaaattcactttaatttttgcaaacttactgtttcctttc

SEQ ID NO: 141 - DNA, 973 bp, Sorghum bicolor
caaacgaaacgaaacgcccgccgcgaagcaaaggattaccaggctctgctgctgtggacctgtggtggccgcgaagcaatggaggccgcggtggccacgagtacgagggtgccgcccctccctctgccgcccaccgcggtgaggcccctgctcccgtcgggcctggcgcggtcccgccgcgggttcgcttcaatctccgacgcaggcggaggtggaggccgcgtatctggaggaggaggaggaggaggcggcggcggcggagacgactccggtgccggcgccgcagcgggcgccgcggctgtggcggctctgggtgaggccgagcagcaggcggacggcggcgactccgacgcaatcgtgctccatgtcgggggaatgtcgtgcggcggatgcgcggccaaggtgaagcggattctcgagagccagcctgaggttgctgcagctacagttgatgtcgaaaaggccaccgccattgtatggacaacacctgaagcgaaggctaccaaagattggcaaaagcaattggccgagaagcttgccaatcatctcacctcttgcgggttccagtctcatgtgcaagacgaaggcgaagctgaacaaactgattcttgacctcagcagtgccttatgtatgtatgactatgagtgaccaggaagttttagcatggaggggtccttgaataaagacaatgtctcctattcctactactacttcagaagttgtacacgcggatctactatgtacatttgattgagagttatatagttctatgagtgctcagcaagttttacgccattatattgttgttagggacacctgaagtcctgaactattgaaggcaaactagtgataaaataaaaaggcaaaaaaaaagctttgacagcgttgtaaaatgattccctacatataagtatttggtaaatcttgtcctcagctttcaatatatgtgtgcgatttatgtttgctatcttc

SEQ ID NO: 142 - DNA, 1050 bp, Sorghum bicolor
aacagtcacgcagtttgcacgtgacctcccaaacctaagtggctgtcccttccgggagtaccctgcatagcggcggcgcgtcctgccgagagagagagagagagctccgtagccatggcgtgggaggaggaggcggtggaagaggaggaatacggggatgagatggcggcttcagagtcggaggaggacgttgtggtggggcagatgccgacggtgatggtgccaaagcatatcaataagagggccctgaagaacaaggcgctctctgttacgctcgacaagaaagcgctcagggatttcgtgactgggttccacaagaggaagaagaagagaagaaaagaggcgcagaagattttgcaggagaaggagaggaagaagaaaatacaggaccgcaagaggaggaaagaagagaaggagattgctctatatggtagagtactgtcatcggataacaatgatgatgctggattagaaaatgaagatatcggcgatgatggtgaggatatggaaaatgacgaacctttgtctgaaaccaaaacgtacgaagatgatgggacgagaatcatagtcaccaccagtgaaattactcctgaagacgatgacatgggcccaaaaactgttggccccgtgtcaacgagctacaccaacaagaatcctagctcgtttgccaagaagaacaacagtttaggtgtgaagaagaagccacagaagagaacgttcaagagcaagagtaaagcgaaaaagggtgacaagaagcgcggtgctgcaaagggtaaaaggaagggcaagggaaggaagtagtgttttgtgaaccctctgtagaaagaattgtatgctgtgactggctgtggacctgtggttaatctcgcatcatctgatctgcacttgctttggcgatatatcgatgatcatttggtccgcaaacaaattgtgatgtaacaaatttgttatatcgatgctcagttgttgagttgtgctcatagttctcaataccagctgaaaatcggcgaaaactggtcaatatcggtcctaccggtaccctctggtatt

SEQ ID NO: 143 - DNA, 1535 bp, Sorghum bicolor
aaatatcctagttgcgtgcgtcgccatcctctcttgctcggtcgcctcgatcgcccggtcctggcgtggataaatcgtctttcttgctgttctggattcttcttctcgcttgttttccctcttgttgcttgctttcgttctcgttctcgttctctctccctgaccgaggaagacgaatcagatttggagatcgtgtggagagcctacaagtggcgcttctgggctctgggagaaggacagcctgtgtctctattggcaggaggacgaggaaagggaagacatggaagaggaatccggcgcagcttcaaggtactactgccacatgtgctcgctgatcatacggcccgagctgggcatcgaggagctgaagtgtccccactgccacaccggcttcgtggaggagatggcgggcgaccggcgaggcagcgacggcgcggccatccgaggccgtgctcccgcggatgaggcgagctttaacacctcggacgcggcgctggagcgcgaggtttcgctctgggcgcctgtgctcatggacttcatcgccgcctcgtccggccgccacggcctcgacggcggcggcggaggggacctcgcggctctggcgcgaaggcagtaccgcaacatcgccctcctgcagctgctcaacgcgctccaggaaggagacgccgacggcgggcgcgagcgggtcgtgctcatgagccccgcggacgcgcgcgccatgctcatgggacaagagcgaagggacggcgacgcgcgcgccgccctgggccccggcggcctgacgctcggggacctgttcctcggcccggggctggacctgctgctggagtacctggccgagaccgacccgagccggcagggcacgccgccggccaggaaggaggacgtggccgcgctgccgatggtccgggtgcgcgaggccttcacctgccccgtgtgcctggacgaggtcgcgggcggtggcgaggcgcgcgagatgccgtgcagccaccggttccacgaccagtgcatcctgccgtggctggagatgcacagctcctgcccagtgtgcaggcaccagctgcccacggaggagcctgcggcggaggcaattggcagcggcagaggcgccggtgatgagtccagtggcaacgcgcgcggcggcgacgggggaaatggcggcgggaggaggcattggttctcgtggccctttggcgggctgttctcgcaaagatccaacggcaactcctcctcgtcgtcgtcgtgatcgtgatgctaatgaacacttaaacacagatgatatatatacttatgttggtgtaggtaggggcttgtcttgtactttacgattggagatgggaggggttctttttttttggccagtgtaaagctgcatttgtgttctttggctgtagttttgctaaagctcaggtggatggagattggagattgcatcttctgactgatgctcctatggtttggtttctgttggaatttcattctctcaaatctgttttgttgcaaactacagtaattctacaagctttattgcaaac

SEQ ID NO: 144 - DNA, 1749 bp, Sorghum bicolor
caaagagtcgcttgtttgttactattagttagtttctttagtttcctacgtacaagggactgcttagcttctcggctatgccggtcaggacatggctcgccgacctgcgctcgaagctcgtcgtcggcgttggcccccgggaccacggcgggcttggcatcctcgccttcgaggcagcagccaccatgtcgcggctcgtgtccctccaccggacggtgtcggacgtcgaggtcaggaggctccgcggcgacgtcttgcgcgccgagggcgtcgcgcggctaacgtccgcggaccaggctctcctgctccgtctcgcgtgcggcgagctcctggcggacctggaccgcgccgccgacagcgtggcgcgcctcggtgcgcggtgctgcgccggcgccggcgacacgccggcgccgctcctgcgggacttcgaccggatctacgccgaggcgaagcgtagccgcctcgcgcagctggacgccacggtcgggttctccaggggcgccacgaagcggttcagggagatggagcgccacgtggtcgtggcggcgaagctgtacgcggagatggacgcgctcagcgagctggaagcgtcgcagcggcggatggagcagtggaagcagcacagcgggcccatcccggcgcagtctttggggacgggcaagaggtcgtcagcgggcgagcccggagagaagctgatgagcaagctcagggcgcagcggcacaaggtgcgacggctcaccgagggatcactctggaacgtcgccgccggcaaggcggcgaggctgatggccaagtccgtcctcgccgtgctcgcacgcatctcccttgctttcagcgcgtccgttccaggcctccccccttggacggtaggacgcgcgtgggcgctgggtcactcgtcaggcccgttgcaccggtcggcgacgcccgcggcgctccggcactcggctcccatcttcggccagaaagacgccgcctctccactgttggaatcgatcaaaccatcggtgagcatggtcggcggctcgagcatggagctgcgatacgcgaacgtgatcttgaccgccgagacgttgctcgcggcgctgaggccgccggcggcaggtgacagcgaggaagtgcaggaagggatgatcgacctgtcgacgagagacgcgctgtacaagatgctgcccgtcagcatccgcgaggccatgaacacgaagctgagagagagatggggtaaaggacaacccgtggacgaggtggctgcggcggaatcgagggatgcggtggagcgtctgctgcgatggttgagcccgatggcgcacgacactctgcggtggaacgacgagcggagtatggagcgggcgcagcggttcggcatgcagccgcgcgcgctcatggtgcagacgctgcactttgccgaccggcagaagacggatgctgctattgttgatgtgctcatcgacctcagctgcatatgctggtacgacgatgagcggcgacggctggagtctcatgactgggacgccgagtagcacctacagatttagctgtgattgtatcgtgtgtgaatatcatggtatggagtaactgcaagtcacaggtacatagagcaaggtcttgtttggtttggagagttaaactttaactctcatcatatcaaatgttagactatttacgaaattaaaaacatagctaaagagtaactaggcttagaagattcgtctcgcgatttataggcaaactgagcaactagtttttgttttc

SEQ ID NO: 145 - DNA, 1812 bp, Sorghum bicolor
gccttttatatccccggggcaccacttggaacccaacccctctcgctctcaagccctcaaatcccactaccgaaaggaaaacgagagcagcagcagcagcacccgcggccgcgggctccatttattcttccttgcttgagcactcgcctttgcctgcctgcgcaacgcgtacttgatttcaggagagtttagctagctttggtggcatcggttctttgtttcatggccgagatctgctgcgaggtggcggcgaccgggtcggaccggaagggggagtgcgtcggcggggacgccggcagccgagcggcgcggaagcggaggatggagatccggcggctcagggtggtggccgaggaggcgtccgccaagaggcggaggctggaggcggatgaggaagacgcggtaaggagaccggcgccgaggtacggcgtgacgtcggtctgcgggcggcggagggacatggaggacgcggtgaccacccggcttgggttcatcgacggccaccacttctttggggtgttcgacggccacggctgctcacacgtggcgacgtcgtgcgggcagcggatgcaccagatcgtggccgaggaggcgaccgccgccgcgggctcgtcggcttcggacgacgcggcgcggtggagggatgtcatggagaagagctactcgaggatggacgccgaggccgtcggctccagggacaccgccggcccggcgcccacctgccgttgcgagatgcagcttcccaagtgcgaccacgtgggctccacggccgtcgtcgccgtggtggggccacgccacctcgtcgtcgccaactgcggcgactcccgcgcggtcctctgcagcggaggcgccgcgatccctctctctgatgaccacaagcctgaccgccccgacgagctggaacggatccacgcagcgggagggcgcgtcatcttctgggacggcgcccgcgtcttcggcatgctcgccatgtcccgcgccatcggcgacagctacctgaagccgttcgtgatatcggacccggaggtgcgggtggtggagaggaaggacggcgaggacgagttcctgatcctggccagcgacgggctgtgggatgtggtgagcaacgaggtggcgtgcaaggtcgtgcgcacctgcctccggaacagagcgccgccgcacccgcacggcggggacggggagcgttcgagcccaacctccaacctgagccccaggcagagcagcggcagcggcagcagcagcggggacgaggagggcgctgggcccagcgacggcgcagggtccgagagcgacggcgacggcgagagcagcgaggacagggcgtgctccgaggcggccatcctgctgaccaagctagccctggcgcggcagaccgcggacaacgtcagcgtcgtcgtcgtcaacctcaggcggcgcaggaggtcgtgatcggcggatccaacggactagccgttcttggctgattgatttgctggccgtccgtgaattcaaatcggagccacagttcacatttgcttcggccgtgcaatcattgaacaaatgtcaaagcaaagatcgaacagaacagtgagatccttagcagaattgcatactgcttccttttatatacagtagtgcagcaggattatttcgttagcatttcttttaggctgatctggtcggaaagatcagcccgtctttcttcttccccgagcaaaattctccaaatagaaaagcttgctcgtgcctttccgatgtttgaagaaactttatcaagcgtccgagaagttaattaattgtaatatactagtccagtgcccctttcactagcca

SEQ ID NO: 146 - DNA, 1579 bp, Sorghum bicolor
ctccgtccggtcgtccctggccgccgggtttcttctccgtcgccggctatgcgcgtgaggagggaggaggagccgcagcgcgtggatccaggggcagcagcgtccatcccgcgtgagaagggagaaggagccgtcttagagcaagcctctcaacatgtcgtgggccgcagtcgagaatgatcctggtgtttttacagaaatgttgcagcagatgcaactgaagggtcttcaagttgatgaactctactcacttgacctggatgctctcaatgatcttcagccaatatatgggctaatagtactatacaaatggcgaccttcagaaaaggatgagcgtcctgtcatcaaggatgcaatccaaaaccttttctttgccaaccagataattaacaatgcatgtgcaacccaagctatcctttcggttctcttgaactctcctggcatcacccttagtgatgaacttaaaaagctgaaggaatttgcaaaggatttgccacctgagctcaaaggattggctatagtcaattgtgcaagcattcgcatgctaaacaactcgtttgcaaggtcagaggtttctgaggagcagaaaccacctagcaaggatgatgatgtctaccatttcataagctatgttccagtggatggcgtcctgtatgagcttgatgggttaaaggaaggaccaataagcctgggaaaatgcccaggtggtgttggtgatacagggtggcttgagctagcgcagcctgtgattaaagagcacattgacctgttctctcagaatgagataagattcagtgtgatggcaatcttaaagaaccggaaggagatgtacacggtggagctcaaagacctccagaggaagagggagagtctcttgcaacagatgggcgatccttctgcgattaggcatgtgccatctgttgagctgtcactggcagaggtagcagctcagattgagtctgtgacggagaagatcataatggaggaagagaagatgaagaagtggaagatggagaacttgaggagaaagcataactacgcaccgttcctgttcaatttcctcaagattcttgaggagaagcagcagttgaagcccctgatagagaaggcaaaggcgaagcagaagtctcacggccccagtcctaggtgaaagctgcaatacacctactgtctcttttagttggggattccttgtagagattggccctgtgtcccttgttttcttggccagtgtttgaaacttatgcttacccttagttttaggtagcgcacaaatgtctgctgttacatattcaggtgaatgaatcttgacatggcgaggtccccgtggactgtatgcagtcatactgtatgaaacccatgcatggttcacccagttattttcctggcaaactaaatggtgtcgtttgctgacacatgtcaagccttgtttgtttctgaaacgtagaggatgacacaatcacgaacatgtctactcttccaatttgccctactcttcgacagggacaggatctttacaagctctgtatggcaggatttgttcaagctttcagatacccagttatcgatgagttcctcg

SEQ ID NO: 147 - DNA, 1849 bp, Sorghum bicolor
agctcactcgcctcagccgtcaccacacgcacacatcctccatcttctcctcctccttgcacggctgcacgcgggcagcgacagcgagcgaacgaccagctagctaggcatggaccagctccccaagcgcccggccaactacgtgccgctgagccccgtgggtttcctgccacgcgccaatgccgcctacggcgaccgcgcgtccgtcatctacgggcgcgtccgcttcacctggcgccagacgtaccaccgctgccgccgcctcgcatccgcgctgctgtccctcggcgtccgcaggggcgacgtcgtctccgtgctcgcgcccaacgtgccggccatgtacgagatgcacttcgccgtgcccatggccggcgccgtgctcaacaccatcaacacgcgcctcgacgccggcgccgtcgccaccatcctgcgccactccggcgccaagttattcttcgtggactacgactacgtgcgcctcgccggcgacgcgctccgcctcctcgccgccgacggcacgcccgccgtcccgctcgtcgccgtcatcgacgacattgactcgcccacgggggcccggctcggggagctcgagtacgaggctctcgtcgcgcacgccgaccccgacgcggacctcccgccgctcgaagacgagtgggacgcggtcacgctcaactacacctccggcaccacgtccgcgcccaagggcgtcgtctacagccaccgcggggcgtacctgagcgccaccagcctactgctgcagtggggggtaaccaccgagcccgtctacctctggacgctccctatgttccactgcaacggctggaccttcacctggggcatggcggcgcggggcggcgtcaacgtctgcatccgcgacgcgcgcccagccgacatccaccgcgccatcgcgcgccaccgcgtcacccacatgtgctgcgcgcccgtcgtcttcagcatcctcctcgagggccagggcgccggcgacggcgccgccaggcagctggaggcccccgtccacgtcctcacgggcggcgcgccgccgccggccgctctgctcgagcgcgtcgagcggatcggtttcaaggtcacgcacgcctacggcctcacggaggcgacggggcccgtgctcgcgtgcgagtggcggggccagtgggaccacctcccgctcccggagcgcgcgcgcctcaaggcgcgccagggggtcagcgtcctgtccctcgccgacgccgacgtcaagaacgccgaaaccatggtcagcgtgccgcgcgacggcaagaccgtcggggagatcgtcctccgaggcagcagcgtcatgaagcgctacctcaacaacccggaggcgaacgacaacgccttcaccggggacgtcagcgtcgtgcaccaggatggatacatcgagatcaaggaccggtccaaggacgtcatcatcagcggcggggagaatatatgcagcaaggaggtggaggaggtgctgttccgccacccggccgtggccgacgcggcggtggtggccatgccgcacccccgctggggcgagacgccgtgcgcttttgtcgtgcccaggaacaacgctgccgagctcagtgaggacgacatgctcgcgttctgccgcaagcgcatggcgcgcttcatggttcccaagaaggtgcaggtcgtcggagcgctgcctaggaacgcgctcggaaaggtcgagaaggtgaagctccgggaggcggcacgtaagctggcgccctccgtaccggcgcagaagcccaaggggaagacgacaacctcctcgacgacggtcggcggtcgccgcgaggaccagccggtggcgcacgtcatggcggtgtcaaggctataggtggcc

SEQ ID NO: 148 - DNA, 562 bp, Sorghum bicolor
ctcttcactcggtgcggtgcggacaccacaaataaacaccatatatccagctcgatcgatcgacgataaacaacaacacatggcgaagcagcagcagcaggcgatggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaagccgccaccagccctcatcacggctgctgccagcgccgctctctcgagcgtatctgcgaggaataaaggatgggttattcgtccatgcactttgccgtctgcctggctgctcccatccctgcttatattatatatgctcttgtgtatgcacgtttgtgtaatgtgtgtccatcgatataaatatattatatataataccggtcc

SEQ ID NO: 149 - DNA, 1766 bp, Sorghum bicolor
attgcttcgttcgctctctacacgctagctaccagctggcacgtgtttgcgccatagccaatctattcagttcattgagtgcaggcactcgccactctcatcggattcacacacataatacatacatacatacacatggcaattctcgacgtcgacctggccactcctccctgtcatgctcatgctcgtcagcagcaggcacacgcagacgagcagcaggacgccggagaggaggaggacgagcagctgctgctcctcaagggcgtgcgacacctgtgcgagcgcggcaccattacgaagctccccgctcgctacgtcctgccgccctccgaccgtccatcacccggcgacgacgagcagccaccacgcagcagctgcgtgtcgttccccgtcatcgacctggcccggctgcgcgtgccggcggagcgcgccgccgccctggccgagctggacgcggcctgcagggactacggcatcttccaggtggttggccacggcgtcgacggcggcggcggcggcgcgatgctggacgtggcgcgccgcttcttcgacctgcccttcgaggagcgcgcgcgctacatgtccgccgacatccgtgcccccgtgcgctacggcaccagcttcaaccagctcaacgacggcgtcctctgctggcgagacttcctcaagctcgtctgctccgacgacctcgccggcgtcgtcccgtcgtggccagacgcgcccactgatctcaggaaggtggtgtcggcgtacgcgcggtcgagccggcggctgttcaaggagctcatggaggcgtcgctggaggcgctagggatccggtccggcgccgccgccgagatgctggcggactgcgacgccgggtcgcagatgctcatggtcaactgcttcccggcgtgcccggagccggacctcacgctggggatgccgccgcactcggactacggcttcctcaccgtgctcctgcaggaccaggtgaatggcctcgaggtcaggcacgccgacaggtgggtcctcgtcgaccctctccccggctcagtcgtcgtcaacatcggagaccacttcgagatgtacagcaacgggcggtacaagagcgtgctgcaccgggtccgcgtgaactcgtctcggccgcgcatctcggtggcgtcgctgcacggcctgccgccggagagggtgatcgggccggcgccggagctggtggacgacgacaagaacccgaggatgtacatggacacggacttcgccaccttcctcgaatacctcacctcggccgagggcaagcacaagtccttcctccacaccaggagactcatcaccagctgatgttgataccagctggacgcattcttcttgccagacgccagctgtcggcatcaggaagagaaaagtcaacacgcatgtgaacacgtatgtgcctgtggttgcgggccaacaggttgaccggtcaaacccgtcgcgcgccgtttagcgtcccggactgcgagactggtcgtgctcctctccctcccatcaggattgctgcttttttgtgtaccctacctactagccagttaaataaataaagaaacatgtaaatcaggaagccgcattgaccaaatttaaagctacgaagcctcgtcatctggaactagagagtgttggatcagcagctaaaaagcccgtgcaaggtcaaccaaattgttactgtatagtggagtattacgagtggtatctacaaggtcttggtgagagttttattcgcatttaataaattaccacgaagatatttt

SEQ ID NO: 150 - DNA, 869 bp, Sorghum bicolor
caccaagaaagagtcggacggagccatattcgtgtagcttccgtgcgaccgattcaacggaacctcaatcgtctactcgatcgcttgtgtgtgtgtgttgatatggcgagatcggcgtttgttccgatggcggaggagaaagagcaaggtggtgcgggtgccggaagaggagcaggagcaggagcggccgtcaataacaaggagcagcaggaggtgctgctggtgcacagccaggtgcggcggatcaagaaggaggacgaggaggccagggagcgcctcctcaagctgcgcctgctggagaccaggcccgctgccgccgccggcggggtggcgtggcgagccccgcgctctctgtcgccgctccgccgtgccgggagcgccatcccggtcccggtcccagtcccggtgggggagtagcagcagcgcctcgcagccctctgcttgtatcgtatctaagagcatcagtcagtactcgcggttggttctcgatcggccgcagttgtagatacctacgtaggcgtagcgagcgagatcgtagttcagttcagtcgtggtgcttgtgagcctgcccgtgctctgcagacatgggatcagagcttagtagacgacggtagggtggcagccagcatctatacgccatgtgtggttggtgccttggtggtagcatagcatagcatgctctgttctgtatcagcaagcatagcatgctctgttattctgtatcctgtcttcttaggtgctgtatatatgatgatgagagggagtttacctgctttacctattctgctgttttcttttgttttcatcgtttggttctactatatatgcttgcttgccattttggccttgagttctctcatctcttgttt

SEQ ID NO: 151 - DNA, 1775 bp, Sorghum bicolor
aaatcaacacggccacacccctccctccggcctcttttcttccactgcccccccctgagctccgctgcacacgcgggtcgacgacggccgaactgacatggccggccacgcccagtcgtggaggacgtacctgtgctgcggcgcgggcggcagcgcggcggtcgaggacgacagcgggtcgacgacgcggcggcggaggatcacacggcggaggggcaaggacagccctcgctcgtcgtcgtcgcggatgtcgttcacgagcctcagctcgtcggagatgctgtcccctgaggacctgtcgctcacgctgtccgggtccaacctgcacgccttcacctacgccgagctccgctccgccacggccggcttctcccgcgccaactacctcggctgcggcgggttcggcccggtctacaggggcgccgtcggcgaggcgctccgcccgggcctccgcgcgcaggacgtcgccgtcaagtacctcgacctggaaggcggcacgcaggggcacaaggagtggctggctgaggtgttcttccttgggcaactgaggcacaagaacctggtgaagctcatcggctactgctacgaggccaagcaccggatgctggtgtacgagttcatgagcttcgggagcctcgagaaccacctcttcaaaagtgttaacggcgccctcccatggatgacaaggatgaagatcgccgtcggcgcggccaagggcctcgccttcctccacaacgccgacccgccggtgatctaccgcgacttcaaggcctccaacatcctgctcgactcggactacaacaccaagctgtccgacttcggtctggccaaggacgggcctcagggggacgagacgcacgtgacgacgcgtgtgatggggacgcacgggtacgcggcgcccgagtacatcctgacgggccacctgaccgccaagagcgacgtgtacagcttcggcgtggtgctgctggagctgctcgccggccggcagtcggtggaccgctcgcggcggccgcgcgagcagaacctcgtggactgggccaggccgtacctgaagcaccccgacaggctgtaccgggtcatggacccggccctggagtgccagtactcgtgcaggggcgccgaggtggccgccgtcgtggcgtacaagtgcctgagccagaaccccaagtccaggcccacgatgagggaggtggtcagggccctggagcccgtgctcggcatggacgacttcttccccgccggcccgttcgtgttcaccatcagcgtggaggaggacaaggtggtgggcgtcaaggtggaggtggaggagaagctgccgcagcagcaccagagccaccaggacaggcaccggcagaagtaccccaactcgtcgatccacgccggcggcattgtgctgcacggccgggaagggatggtcggcggcgatgactacaccgccacgctccggcggcagcggagggcggcggcggcgagctaccacaaggagaggggggcttaattaagagcaggagcggggatatgtgtgtgcgtgtacataactacatactagagaggtgacacaatgtcactttggcttggtttagtatttgagattgtgtgattcttgtttcttttcttctagatagtgatagcgatgttactaggtgttaggcgatgatacaggtatgcaaaaatagtgtgatgaaaagtccggatcggacttgcaaggtttgttgcacttgcacaaaggtgttgtgtaaaaggaaatggcttggtaaaatggtcatctaaattct

SEQ ID NO: 152 - DNA, 3052 bp, Sorghum bicolor
agaggctcagaccgtcaggcgcaaacccctcctcgtccgtcgtctctctcgcagtcgccaccggcgcctttttcgcacgccgccaccgaggggacgaaggagccgcgcacgcgtgcgacagaggggtaagatgggaggcgggcggaagcgcgggcgcacgcagcgccgccacttcaagcagggccgcgagaacgtctggaagcacaaccctcagcgtcctcccgccggcgaaggaggcgaggggcgggagggcaatccctcgtggcagcccttcgccaccgagaacccgtccttcgaggagtactacaaggagcagcaaattgttcctgaggaagagtgggatagcttcatgagtatgcttcggaagccattacctgccacttttaggattaatgcgagctgtcagttttatcaagatatctgctcacaattggaaaacgacttcaggaaatcattagagactgaggtgaccgatgaacatgaagaagatgctattaggcctttgccttggtacccgggtaatcttgcatggcatttgaacttttctcgaatgcagctgaggagaaaccaggcacttgagagttttcatgaattcttgaagagagagaacgaagttggcaatataactaggcaagaggctgtcagtatggtcccaccactgtttctgaatgtgcaacctgatcatcatattcttgacatgtgtgctgctccaggatctaaaactttccagttacttgagatgattcaccagtcaacgaagcctggagtgcttccaaatgccttggtggtagctaatgatgttgatgtgcaaagatgcaatcttcttattcaccagaccaagagaatgtgcacagctaacttgattgtgacaaatcatgaagcacaaaactttcctggttgtaatcttgcaaagttctgttcagaagtgtgtatggatgaggcaaaactgcagaggttggagtttgaccgcgttctttgtgatgtgccttgtagtggtgatgggactgtccgtaaggctcctgatatgtggaggaaatggaatgctggtatggggaacggacttcatcgcctgcaagtggaaattgctatgcgtggtatgggtttgctcaaagtgggtgggaggatggtttattcaacatgttcaatgaaccctgttgaaaatgaagctgttgttgctgagattttgcggagatgtggggactctgttgaacttcttgatgtttctaatgagctacctgaattagcccgtcgtcctggacttagcacctggaaggtacgggatagagggtcttggtttggtgttcacgaagatgtacctcgctacaggaagcatgtgatatcaccaagtatgtttccctctgggaaaggcagcaaagatagtcttacggtgagcagcagcgttgaggtcaacacagatgtagctgatgctgacatgaaggattcaacagacattggagagggagaacaagaaacaaatataacaattgatgacagtgataatgctgacaatctgaaaaccaaagagggaaccaaagttgattgtgagtttggtgaggttacagctagtagttataaaaagtcaaattctactcccatccgtacagaacattcagattatccactgcatcgctgtatgagaattgttgctcatgaccagaacagtggggcatttttcattgcagtccttcataaactctccccactgaacgagaaccaggtgatagatggggtaaaaggtgaacagaatatttcaaaagacaaaactgagaaacttgagaaagatttaggatcagataaggcatcatctgaagaaaatatagtgcatcatgaagtgattgataatacaaatgttctggatggagaacaaaatgaagacagggataacaaaagttcaaaagataagagctcagaggattctaaggtgaatgttaatgaggcggaaaagggtcaagcaggaacaagggataggaggaggcagcagaaccaaggcaggtggagaggggttgaccctgtgatattttttaaagatgaagcaacagtcaaaagtattgtatctttctatggtatcatggattcatttccacttgaaggtcatctcgtgactagaaatcctgatgctagtcatgttaagagaatatactatgtgtcaaaatctgttcaagatgctttgcagctcaacataaaagttggcgagcggcttaagatcacctcactaggcctaaagatatttgaaaggcagtcttcaaaggaaggctcaccatgcacatttaggttgtcatcagagggattgccgctcctgcttccatacatcacaaaacagattctatatgcgtctgcaattgacttccagcatcttttacagtacaggactattaagtttcctgattttgtggatgcaaaatttggtgaggaagcttcagctttgcttccaggttgctgtgtcgtagtattacgtgaagggcatcaggatataggatccatagctacagatccctcagctattgccatcgtttgctggaaaggaaagaccaacttgtgtgtcatggtttctccactagatgggaaagaactgcttgagaggatttcattgcgttttgggctgaaaatccccaaaggggataaagagaaacccagcgaggagattgctggatcagacgagctgcttgattgtgccactgaggtggacgatcaagaatgttttcctgaaagcaaagcatcggacatcgaaatatcagatgctaaggatgctgactagcttttgtttttatgccacttactacacctattacacaggaggtagatgtatcctctgagttggctattggttttcagtcacttaagttgctaaaggagagatagtcgcccacatgggaatgatagcacatgatatagaccctaaacacctggtaatcgtgcttggtggcacacgggcaccacatctgtaaacttatagcctgttgttttttcttcttagaggacgtatcacattcgattttaaaattttgcactgaacgcaatccagtaaagtttgagactgagaatactttttgag

SEQ ID NO: 153 - DNA, 1391 bp, Sorghum bicolor
gcaaacgcttgacctcgtccagatcgtgacaagtttatcatccacccccacccagcgcctcgctcgacttcaaccccaagcattccattccttccagtaccttctccccgtccccttcctctccctccctagtcgcccccaagtccccacgaccccgaccccggccgctaagcaaactcacaagtcccagaccgatcgccgcagaagatcccgcgatgcaggccccaagtccgccggcgccgtcctcctccgtcgacctgccgctggcggcggcgccgccgccggtgaaggcgccgacgccgcggcccccgccgccggcgtcgctgcagccggagtccccgggcgtcttcttctccgccgcggccgccgccgcgccgctgggcacctcgcaccgccgcatcgccatcgccgtcgacctctccgacgagtccgcctacgccgtgcgctgggccgtcgccaactacctccgccccggggacgccgtcatcctgctccacgtccgccccacctccgtgctctacggcgccgactggggcgccgtcgacgtctccctccccaaccctagcaacgccgccgctgcctccgaggacgacgacgacgactccgaggccgccgcggccgcgagcaggatggacgacgactacgacgccttcacggcctccaaggccgacgacttcgccaggccgctcaaggacgccggaatcccctacaagatccacatcgtcagggaccatgacatgaaggagcgcctctgcctcgaggtcgagcgcctctcgctcagcgccgtcatcatggggagcaagggcttcggcgccgcaaggaggaccagcaagggcaggctcggcagcgtcagcgactactgcgtccaccactgtgtctgccccgttgtcgtcgtgcgcttccctgatgacggctccgccgaggctggggaggccggtggattttctgccgcggttggtgctgaggatgtgctgcaccctgtgctggaggaggaggccgagtaccatgacgctgctgaggagcacaaggatacttgacctcgatgatgcattgtgaagtgaagccctctcggattcagcatgtaaaggttctagtattggactgttggctgggtgctagctgggatttctgcttgagtgcatgtgatgtttcctgaacttccattacccgtgtgtatccgtgctttcactttgtttgtatcttctgtagttctgttacctttgttcatgtagcttgtctgacttccactgcctcgtgaatatctgtctgaacgtttgtagttaatttgcattgcactgtgtttctgattacaaattaaccacttctgtagaaccaactaatcaagtgtgcaaattcctccccttttttatttgctttattttagtttgatg

SEQ ID NO: 154 - DNA, 1191 bp, Sorghum bicolor
gacgaattccgtttctcgcgtcgattgcttgcacagctcgcttcctcttcctcttccttcccccctttcttcgcctcccggtaaccgccgtagccaaagaacctggcttcgccttctcccgcggcggcgcgggcggccggtgctgctgcgccggcgcgtgagatggaggattgcggcggcgtcacggctggaagcggcaagaagccgttccagctgacgcggtcgctgacgtaccaccaccaccaggggcaccggccggcggcgtcggcggccaggtggcggaggcagcagctcgcggacgagccgcgcgcgcagcggccgcaggcggtggtgctgtacacgacgtcgctgcgcggggtgcggcgcacgttcgcggactgcaccgcggtgcgcgccatcctgcgcggcttccgcgtcgccgtggacgagagggacgtgtccatggacgccgcgctccgccgggagctccaggcgctgctcgccgcgcgggcccgcgccttcgcgctcccgcagctgttcatcggcggccgcctcgtcggcggcgcggacgaggtgcggcagctcaacgagaccggccagctccggcgcctcctcgacggcgcggccgggcaggacccggccttcgtctgcgacgcctgcggcggcgtccggttcgtcccctgcaccggctgcggcggcggccgcaaggtgttcgtcgaggaggaggaccgcgtcgtccgctgcggcgagtgcaacgagaacggattggtacgctgcgctaactgctgttcttgatcgccaacgcccaacgggcggcgatcgttcgccgttccattcgtgctgctaatccaagtggtagaggttgtagtagatatcaacaacaaaagaagagcggcctttcgatttcccattccaggcgtgggattcgtgtgtgtccgatccgatctttttgaggatcggatttgctactcggtggagaagaacagattgttcttgactccttgctgcaaaattgccatatggtgatggcgattggagaataagaaccgggcttgtttgtatatgcatctcatgtatcaaagattgacactgctattagctgaactaatgtaaatacttaagtttggggtgatcaattgcttcatgtctttgtccagttcgtggactcgctctcgtctttctgggtaaactggttagagatctgaagttgta

SEQ ID NO: 155 - DNA, 695 bp, Sorghum bicolor
cagagtaaatataaagtgcagaccatatcaagttactgtgaagagatatcagctaggacaagacctcttcagacttcaagggagattcgcaagatggaggggaagagcaggctgccggaggtgaccatcgtgccggcggcaaggccgttggctggcgacggcaccatcgacgcggcgaaggcagcggcagcgccgggcaaggagcccatcagccctggtactccgtcctcggcggacgccggccgccgcggcaaagagaggcgcgcggtggaggccgtcccgctccctgggtggaagctcgacgccctctgccaggagtcttgcccgtcgccgaccatgagggcgcgcttcccctacttctgaagcttcccgttgcagtcctgcatgagtttcgtttcgagcggcaacattgcatcttgtgctttggacgtctgactgatggcgttcttgggtgtttgcttgctcaggatttttctttcgtgcatcagtgtatccacatgcatgtattatgtatatatatgtattatgagtataaagatctgtgagctttgtgtcagattgcacagcacagatgatgaaccatcagttgatttcttgtatggttgtatctgacataatttgagcagtcccaatctaggaatcagaacctggaactccggcgttcaactgagctcccgagaccagccgcttctcca

SEQ ID NO: 156 - DNA, 933 bp, Sorghum bicolor
ctgaacccagctttaactgatccccgcatcgccccaaccggcaaccgcccctcgccgactccgacgggaagcccgttgccgagtggcgagtggcgacccagtcctcatcctcccctccccttcctccttctataaatcccgttcctcccaggaaggctctgcaacgatccaatccagcctcgccgcctcaccccagcattcccttccacctccacctcgccggaatcccgaatccacctcaacctcccatgggttcgcaggccatcgaggcgcaccgcgcgggcgcggaggtgtacaccggcgcggcgctatgcgccgagaagtcgacggagctactgtcagaggtgcacctcccgctaggcctgctgccgctggcggacatggaggaggtgggctacaaccgcgccacgggcttcgtgtggctgcgccagaagaaggcgctcacgcacacgttccggcagatcggccgccaggtgtcgtacgccgccgaggtcaccgccttcgtcgaggaccggaggatgaaacgcatgacgggcgtcaagaccaaggagctcctcatctgggtcaccctctccgacatgttcctcgacaaggacgaccagtccaagatcaccttcaagacgcccactggactcggtaggaccttccccgtctccgccttcgccaaggaaggtgacgccgcggccaagcccaaggacgcctcctccgccgccaacggtaacaaggaggccgtcgccgccggtaaggctgctgccagcaagtgaggtggcggcggcgtccggactccggagcttttacctgtggttgtactgtagtagccgtaattgctaatacctgttctgtctcctgaataatgatgttgtacccctgctacctgcttgaatttactacactatgttttttatgaatggaaacgagtatccatccatcctt

SEQ ID NO: 157 - DNA, 3103 bp, Sorghum bicolor
gaaaaattcaaaaccctcgtctccggcggcggcgggcggcgccatgagcttgttcgcgggggtcggcggcggcgcggcggacgcggcgtccgggggcggcacaggaagggcgctcctggagctgacgccgcacaagatggcggtgtgccaccttgtgcaggtcttcgcgccaccggcgcaggccgggggcgacgtcgtgccgcccttccccttcgagtccctcgcccaccacaaccgcctcggactcttcctgttcacgctcacgcggtcatgcgaggattttctggagcctccactggaagaatttttgaggcagctgaaggcagtggatgatttggctaatggttggttctgcgagcagctgacaagttctctgtcggcactcatctcacctgatgacttgttcaacttttttgataagctacaaggtgtgctcactgcatcggagggtgcgagtgcagaagacgtatttttggatccaaatagtcaacttggagtttttcttcgttgctgcatacttgccttcaactcaatgacctttgagggtgtatgccatctgttggcagatcttgtcatgtactgtaactccactgatgcttcatatgacttggcggaagacgaggacttcaatagtgaaatgggcaacttgatggatgcagacataggttctcaagttggtatatttgacaaatttcatcagggttatgcctctgagcgtcatatgggggagagttcttcagctctaattcgtgcaccaatgtcaaccaatgattttgatgatgctaatatttttaaagcggatggcaacccaacctgtctgagatcaaggtggcaattagaggcttatcttaaccaacaagctgatattcttgagaaggatcctggctcagtgcctttgaattcatttaatgccactatgacacagcttcaaacattagctcctgagcttcatcgtgtccaattcttgcagtacttgaatgccctttgccatgatgactatgttgcttcactggataatcttcaccgctactttgactacagtgcagggatgcaaggactttttggtcgttctgtggctcaggtgcaagatattgttgttggaaagtatgagagtgctctgctatgcttaggcaacttgcattgttactttggacatcctaagaaagccctagaggcgtttgcagaagcagtccgtgtttctcaaatgaataatgatgattcatgccttgcctatgtattaggagccatttccaatctattatcaaagataggcatctcaaacacagttggaataatcacttctccatattcacttgggaccaatattggactgggcacaccattatccattcagcaacagttacttgttcttttaaaacgatcactcaagagagctgatgcattgaaacttccaagtttactatccttcgatcaccttttgttggcaaaatttgatctgaagcatgtccaaaggccactagtctcttttggccctaatgcatctacaaagcttagaacatgtcctgcagatgtcatcaagaatttaagattaggttcccgtgtgttgactgactttggagcagatgtactatctacttcaaatgataatggtagttttagcacttcgtggctgaggaatctatctgccacttctgattcatggcgtagaagttctatgaacaccaagaaattacatattaatgacttcgacaatttccattatcatgcacaaccaagtccagtacctgcaccaatattacaattagctggctcagcatgtttgctgagagcgaccgcttgggagcactatgggagtgctccaatggtacggatgaatgctctggtttatgcaacctgctttgcggatgctgcaagttcgtcagagttatcgctagcatatgttaagctaattcaacaactggcggtgttcaaaggatattcagctgcattctgtgctctaaagcttgctgaaaagaagttcccatcctcaacaagtttgcacatccagcttctaggaatgcagattctacatgagcgcgcacttcatcgagggcatctaaaagtcgcgcaacaaatctgtgatgagtttggggtgttgtcatcttctgtttctggagtagacattgagctaaagacagaatttagtgtacgacgagctcgcactctccttgctgcaaaacagtttagccaggctgcagctgtggccaattctcttttctctacgtgctacaagtacaacatgcaggttgagaatgcaagtattcttttattacttgctgaaatacataaaaaatctgacaatgcgatccttgggcttccttatgcgttagccagccaatcattctgcaaatcattcaacttggatctgcttgaagcctcagctacacttactcttgctgagttgtggctggctcttggatcaagccatgcaaagaaggcactgagtcttgtctaccagagcctccccatgattcttggccatggtggacttgagctacgtgctcgagctcacattgttttagcaaagtgccatttagccgatccaaaattctcagttcttgaagatcctgaagctgttctggatcctctgaaccaagccactgaagacctgcaagcattggagtaccacgagatggcagcagaggcgtactatctgaaggcaatggcatacaaccatctcggcaagcttgatgagagggaggaagccgcggctcgtttcaaggatcacgtcactgcccttgagaacccgcagaacgaagaggactcgcttgcgtactgagacacaagaccaggtcaccaggctcccagagtcttaggattaccatttgttattagtaggaaggcgcactactgtactcgtgtatgtgcagtggccagtggggtgtcttcaatcgtcttgggaagagatgattgatgtgtatattgtaagatccatgaaaattgtaagatcaacgccatctctgccatgtatgcaagcatgccccactgccagaggctagcgagggcgtggtggcctttttggttttggacccgcatggtggcaggattcaatgctacattgaggcgaatggcagggccttgtttaattcccaaaatagtttgc

SEQ ID NO: 158 - DNA, 1001 bp, Sorghum bicolor
aagagccttcgcgttaatcccgcggccatcatcttgatttggtcccttgcttccgtctcctctctagctagcttgctctatataacaagagccaccctgcaccatctctcttctcacatctgaataaacagaagcagctgtcaggaagacatattttcaacagattcagagaaagagctagcatatagagaggtaaagagcgagagagctacggagaggattatcaacctacagctagagcttccatggagagagttgcatcaagctgtgtcagcctcctagcacaaaggagggcctactctgtggccgcggccatggcgaagggagtcgcacggaggggcgccgacgagaagaaggcggcggcggcggcggtgaccaagcgcgtgatgggcaagaaggaagtgaacaccgcagccgctgctgcggcggaggagaagaaggcgtgggtgccggaccctgtgaccggctactatcgcccagcaggtagcgctgccaaggaggtggacgccgcggagctgcgcgccaagctgctcacggaggctgcggccaactgattaatcacacggttaccttgtcgagctcgagcatgcatgagttggctgtccaccactccacctagcttctcttgctttaagatccgcgctcgttgatcgcggggctccttggcctagagcatgagggtgctctatacctgttctctgcagcatctattagtatagtatcgtcaggaagtgctccgccccgtgtcttctttttaagaaagaagaagaagaaggagaagaaggaaaaagttcccggcttctactacagccatacacgtccaaaccttactatatgtattttatgctcaatcgctgattatctgcacatcatcatcatatcatatatctgaatgatacatatataataagcatttccttcttgtctagccaccaccttcttggctatatagtccagaaggacagaacaaaacattgcaaggttcatgatggttaatttca

SEQ ID NO: 159 - DNA, 1198 bp, Sorghum bicolor
gggtgcggcagcggcagcggcagcgctccccaacaccaacacgccgcgaaataagagccgcggagaacctcttccctccgtcctcctccccctccccttgccatccgccgcccatggcgtccgcccccgcccccgccccagccgtggtggtggtgttcgacttcgaccggaccatcatcgactgggacagcgacgactgggtcatcaccaagctcggcgccgccgacgccttccggcgcctgcgcccaaccatgcgctggaacccactcatggacaggatgatggcggagctgcacgccagggggaagacgccagaggacatccgcgactgcctcaggagcgcgccgctcgacgcgcacgtcgtgtccgcggtcaagacggcggcggcggcgctcgggtgtgacctcaaggtggtgagcgacgccaacaccttcttcatcgagaccgtcctggcgcaccacggcgtgctcggctgcttctccgagatcgtcaccaacccggcgaccgtcgacgccgacggcaggcttaggatctcgccgttccacgactccgccgccgcgccgcacggctgcagcctctgccctgacaacatgtgcaagggcaagataatcgagaggatccaagcaacagccagtgacaagaagcagcacttcatctacatcggtgacggcaagggagattactgcccatccctcaagctgggggaaggggactatgtcatgccaaaggagaactaccccctttggaatctcatctgcaacaacaagcagcttctcaaggctgaggttcacccgtggaatagcggcgaggaactggaaaagacactactgaagttggtcagcaaaatgatcgccgcacctgcacaagcttcccagtttgactacagcaaatgcgagatgagcaacccagcaatccagcatccagccctccgtgtgccacactgattactgatcaactcttagttcgcaagtacaggcttgattgcctggtaatttttatatgcctcgattgataagagtccccattctgcattcagcatgatatgtcctcagtctgtgttcagagcgccacaatttagagatgagtgtctatgctttgtactatgtcattcaataaactgtagcatggcatggaagaacatgaattgtgaattaattgatgccaaagtgggaaactatagtctctaactcttaaggca

SEQ ID NO: 160 - DNA, 1404 bp, Sorghum bicolor
ttcggcgtgttttctatcttctgcttcttttttctttcttttgccttcgctgcgggtggtctagactctagacgaagactcgtcttcctccggttctggccgaacggtcggatctcccccaccaatggccgcctcccacccacccacgctactcctcctcctcctcgtcctcgccgccatcgcgccgaggccctccagcgcgcgccacatcatcaccttcgccccttcccgcgcggtcaacccctcgtccctcgcttgggaccccacggcgcagcacttcgtcgtcgccggcggcggcgatgccgtcctttccgtctccgacgctggggtaaccgagtcgatcgtatccactggcgcctcctccgtcgccatcgacgaccgccgacgccgcctcctcgtcgcttccccggggtccgtctccgccttcgatctccgatccccgcgcccgcacagcctcatcttctccacgccggttccggaccccgcccctccgggtggcatcgctgtggaccctcacaccgggaacgccttcctcaccgtgggcgcccgaatctacaagctgtccgtagaaggcgacctcgccgcgctcgcctccgcgccggcgctcggctccgatcccctagcctcgctcaccgcgcacgtgagccgaggcttcctgctcgtgggccagcccagcacgggccgcatcctccgcgtcgacatggaggacggcgccacgaggaccgtgtcctgccccctcacgccccccacgccgaccgcggtggcggtccggaccgatggggcggtggcggtgggtggggccgcggggctgcgcctcgtcgtgagcaacgacgggtgggtgtcgtgcggggtccgggacgaggctgcgcccgcgcccgacggccccgtggccgcggtggcggtacgggagcggcgacgggtttacgcgctggtggaggcgggggcgacggacgggggcaacaagtggcggatcgaggagacctcgtggaaatcggagtcggagggggagatggtggtggtgcttctcttcgttggtgtcgccctcgccatcttcatgttctggaggttccagatgcgccagctcgccggcaacatgaacaagaagatcagatagtaccaatgcaatgtctccttcactcctttgattttgaagaatctatagtcaattgcctttgttatgccgtagttggtgtagctagatacttgtggattagacacgttacttctgtgatctttttatttgataggaaccaatcttcctagttagccactgtacctgcaaatttccacattgtaatggaaaaggtagatttgtaatgatggtgaattgcacttgtgattcagtaaacggatatcggtttgattatttcattgttctgttcaaacatatgcagttttttattt

SEQ ID NO: 161 - DNA, 2351 bp, Sorghum bicolor
attgtgaattggccagtcgatggatagatactccctttccctgcgaagtgttctacgacgggtggactctctcgcctgctgatgggctaatgtcaaaggcacgtgcagcagcagttgcccgccctggttatgggtgatcgtggcgcacatgaccggagcctcactttggtgtggcgtgagcacgatggacggtgaacatgatgcgttgcgccgatcggattcgccgttcttgtgagagcagctggtggtcaaaagcctggaattgatggaattatccgatcagattgggtgagccggagggagcccaaagtttgcgccgtcacaaatcccaaccaatcgccgagcgaggcctcgagctgagctgcttgtgtcgattgttaaatactagctcgccgcgtacgacacaccaagcgggctgcgggcggcgactctctcatctgctctgcttctccactccgctccgccggcagcgcgggccatggcgacgccagcgccggcgccctccctccgcctcctcctgctgctaccgctgctcaccgtcgccggcgccgcggtgtctcacccagcgcacgagttctgcgcagtcgggggtgacgccgccggctgcggcggcggaggggacggcacgaggatcctgatcaagggcgggacggtggtgaacgcgcaccgcgcggaggaggccgacgtatacatcgaggacggcgtcgtcgtcgccgtccgctcaaacatcccggttggtgctgataatgtccgagtaatcgacgcaacaggaaaatatgtcatgccaggtggaattgaccctcacacgcacctggagatggagttcatgggcaccgtgaccatagatgacttcttcagcggccatgctgcggcgctggctggtgggacgacgatgcatattgactttgtcattcctgtgaacggcaacttgactgcaggcttggagtcctacaagcacaaggcagcaaaagctgccatggattatggctttcacatggccattacaaagtggaatgatgaggttgcaagggaaatggaagtgatggttaaggaacatggaataaattctttcaagtttttcatggcatataaaggctcgttgatggtcaccgatgacctcctcctgcaaggcctacagaaatgcaagtcgcttggtgcccttgctatggttcatgcagagaatggggatgctgttgccgagggacaacagcggatgattgaccttgggataactggtccagaagggcatgctctctcaagacctccaattttagaaggagaagcaactgcacgggcaatccgtttagcaaagttcatcaatacgccactgtacgttgttcatgtgatgagcatagacgcgatggatgagattgccaaagctaaaagagaagggcagagagtcataggtgaacctgtggtttctggactagtgcttgatgattcttggctttgggatcctgacttcacaattgcttcaaagtatgtgatgagtcctccaatccgggaagcagggcatggtaaagcactccaagctgctctttcgtcaggaattttacagcttgtaggtactgatcactgcacattcaactccacacagaaagcttttggttctgatgattttcggaagattcccaatggtgtaaatggtcttgaggaacggatgcatataatttgggacagcatggtggagactggcaaaatttctgtaaccgactatgtcagagtgacaagcacagaatgtgccaagatcttcaacatattccctcggaaaggagcaatcctggaaggatctgacgcagatatcataatcctgaatcctgaaaggagctttgtgatgggtgctcacactcaccattcgaggtccaacactaatgtgtacgagggcaggaaaggaaagggaatggtggaaatcacaatctcaaggggccgagtggtatgggaggatggtgttctgaacattacacctggttcaggaagatacgtcatgatgccacctttcggctacgtctttgatgggattcagaggtccgacgccgcctacagagcttccctccgagcccctgtacagcgtggtaaagctagtgcatagcttatagctatgacagctgttgatgccattgacctggcagtagcccccatctgattcaagaacgagttgctccaaggtgaacaccgtttgttccatgtgtattgtctatacagaacactttatttaagatcagattcaggataggtaaaggccttagcttgcctatgtacatcaaacacatctgtgacttagaaaaattcctagttttggtccatttgtgcaactagcaatttgctatttcaataaatcatattttcacatt

SEQ ID NO: 162 - DNA, 1827 bp, Sorghum bicolor
ccccgaagccttcgtgcccgtttcgcttcgcgtctgcgctgctgctgctatttccatttcctttgcatccatttccggggggacagagcggaggggtcgcctgcgttgcttcgcgtgggtagcgtgcttcgtttagtaggcctctcgccaatttccgaggtcgacggcgacgtgcgctcggcggacgggcagacaaaatctagagagccttgggcttgttgccaggcgcgcctgtacgtaacgtacgcgccgttgtgggagacagccacttgctctcgcctccaatggccgagatctgctgcgaggaagccaagtccacgccggcaaccgccgtggctgcggcttcagtctccgcggcggccgccgccgtggcagtcgcctcctcggcgttggagaggaggcgacgcaggttggagatgaggaggttccgcgtcgcgactgatcccgaggcgccggtcgcggaggacgtccgcgctaccaagcggcagaggctgctggcgcgcacggtgtccggctcctgccccgacgcgggctcggactccgacaggccggccctgccggagcggttgcctaggtacggggtcacctccgtctgcggccgacggcgcgagatggaggacatggtctccatcaggccggacttcctgcccggcaccagcacgcaacacttcttcggcgtcttcgacggccacggctgctcccacgtagcgacgctgtgccaggacatgatgcatgaggtggtcgcggacgagcacaggaaggctggttgtggcgaagagacggcgtggaagggcgtcatggagaggagcttcgcgcgattggacgagcaggccgccagctgggcgaccagccgcagccgcgacgagcccgcctgccggtgcgagcagcagatgcccttgcgttgcgatcacgtggggtccaccgccgtggtcgccgtcgtcagccccacacacgtagtcgtcgccaacgccggcgactcccgtgccgtcctctcccgcgccggcgtcgccgttccgctctctgtcgaccacaagcctgatcgacctgacgagctggcccgcatcgaggcggcgggcggccgcgtcatttactgggatggtgctcgtgttctcggcgtcctcgccatgtctcgagccataggcgatggatacctaaagccgttcgtgtcgtcggagccggaggtaacggtgacggagcgcaccgacgacgacgagtgcctgatcctggccagcgacggcctgtgggacgtcgtgaccaacgagatggcgtgcgaggtcgtccgggcgtgcttccgcagcaacggcccgccgcaggcgccggccgctcggccgaacggcgtggctgccctcccggcagccgacgcggacgacgagaacggacccgcggttgtcaagggcgtgagcaaggaggattccgacagggcgtgctccgacgcggccatgctgctggcgaagctggcgctggcccggcggagcgccgataatgttagcgtggtcgtcgtggatctccgccgaggcatatgatgatccttggagcagagcaaaatcatatgctccatgattgctttcttttagcccttttcgaaatccaacctaatttctcccccatttttcccatccttctgttttgatttagtattaatagtagttactaatcagatgaatatagacgcttctcaaacgaggtactaaagctaatcaggaacaaggaacaaaaaaacagcgaattgttggatcctggcctagcatgaacagatgcacaatgtagcgccaatctttaatcacaacttttgggccgttgattaataacatgctaaaaagtgttgat

SEQ ID NO: 163 - DNA, 2246 bp, Sorghum bicolor
ctcccagccccagaccgcttcgcgccgcgccgcctccccactcgcgcaacgccgccgagccgcaggcgcagcagcggccagcgcgaggagcgagcgcacccgctttccggccgccggcgacgagcctacgcgccgtgctgcgtaggacgcacgtgtcgcctaagggaggtggtatttgttttgagcgggggactcgttctgggaggagatgttggtgctcttcgagacccccgcgggtttcgccctattcaaggtgctcgacgaggggaagctcgacaaggtcgaggatctatggaaggagttcacgacgtcggactcagcgagaaaggtggttgagctgaaggctttcaacaagtttgagaacacatctgacgccctatctgcggcaaccctgattattgacagcaagcctagcaagggtctgcgcaagtttttgcagaaacattgtgagggtgaaacattagctgttgccgattccaagcttggaaattctatcaaagaaaagctgaaaatcgactgccttcacaatagtgctgtgatggagctgatgagagggctgagaaatcagctcactgagcttataactgggttgggtgcacaagaccttggtccaatgagcttgggattgtcgcacagcttgtcaagatataagctcaagttcagtcccgagaaggttgatacaatgattattcaggccattggcttattggatgatcttgacaaggagcttaacacttatgccatgagagttcgtgaatggtatggttggcactttccagagctcaccaaaatagttacagataatatacagtatgctaaagttgtgaagatgatgggcgacagagctaatgcagtcaaccttgacttctctgagatattgtcagatgaagagctagaaacacagctaaaggaggctgcagtaatatccatgggaacagaagttagtgaccttgacttgttaaatatcaaagagctatgtgatcaagtgttggccctttctgagtacagagcccagctgtatgagtatttaagaagcaggatgaacactatcgcgccaaatctgacagcactggtgggtgaattagttggtgctcgccttattgcgcatggtggaagtttgctaaacttggccaagcaacctggtagcacaattcagatacttggtgcagagaaggctttattcagagctctaaagacgaagcattctacacctaagtatgggctcatctaccatgcatccttaattggtaaagcttctcaaaagcacaagggaaaaatctctcgttctcttgctgcaaaaactgctcttgctatccgctatgatgcccttggtgatggcgaggacaactccattggcactgagagtcgactcaagcttgagacacggcttcaagttcttgaaggtagagaacttgggaaatctgctggttctacaaaaggaaagcccaagatagaagtgtatgaaaaggaccggaaaaagggtgctggggctttaacgactcctgctaagacatacaacccagcagctgatctggtgcttggacattctaccgaagaaacgccaaagaagtcagaactggcttcaaagaagaggaaacatcatgaggctgaaactgcaccatcagcagagcctgaagaggaggcaatccaggaggatggtgaccaggagggtcggaagaagaagaagaagaagaacaaggaaaccgaggagactcctgctgttgaagctgatggtgagaagaaaaagaaaaagaagtccaaggaggacggggagcctgtggctgccttggaaggtgagaagaagaaaaagaagaagatatctgatgcggatggtgagaatgttgcaatgcaaactgaagcgtctgctaagaaagataagaagaaaaagaagaaaaggcatgctgatgatgagtgagggctgtccggaaaatggtatcacagggttagaaaccatgttgagtttagtttccctttttttcgacctgggttgtattcaagtacttacactttctggattgatggatttaaattttgctgctgcgatctcataaataaattatgatgattgctcatggtaactgtgctgttggcgacctgaacgtgttggtagtataatgctatggaggcaacatgcaaattctctattgcctggcatccctcagcctcacggctcctgctacttcatgacagtaattcgccagcattcttgttatagttgatctggtccttcatcagacgaccttgtg

SEQ ID NO: 164 - DNA, 1920 bp, Sorghum bicolor
gttcgttcccctctctccctcctcctcatcgattctttcacacccccaccagccgcagcagcaatcgcgctaatcgcccccgttaatccccttccaaatccgcgatattcccaagcatcttctcttcccctccccctcccgcgctatatctctcctcccattgcgccgcactgctcccacacgctcggattcctgctcgctttctccgcctccgcctcggattccatcgccgccccttttccttccttcttccgttgcccgcccgcccaggactctccttcgcgcttcttagccagctccccgcccgcccaggactctccttcgcgcttcttagccagctccgtccttcgcaattcttcgccagccgtcggcgagagagagggaagggatcgctcgtgacttcgctcactcgggactcgggatcgcgcggcgccaccgtaccccgcctggacatgtgcgtggaggagctggacgacgcagcagggaggctcggcttcggagaccaggagatcgacaggcgcgcaggtgccgcgatggagagagtttgtgagaacacggtgtctgttgagttcaagcagactaagctgaacaactttgttccgttcatccggtcaggggattggtctgatattggaagtcgcgattacatggaagatgcccatgtgtgcatctctgatctggcaaagaattttggctataactcggtggatgatgaagtaatttccttctatggggtgtttgatggccataatggcaaagatgctgcccattatgtccgtgataacttgccacgggtcatcgttgaagatgctgattttcctcttgagcttgaaaaggttgtcaagaggtcatttgtgcaaactgatagtaagtttgcagagaaattctctcatcagaagggactttcttctggaacgacagcacttacagcaatgatttttggaagatcccttctggtggccaatgccggtgactgcagagcggtgctctcacggcgtggcactgccatggaaatgtccaaggaccacaggccttgctgcatcaatgaaaggaagcgtgtcgagtcacttggtggctatgttgatgatggttatctaaatggtcagctggctgtcaccagagcacttggcgactggcatctcgagggcatgaaagagatgggtgagccaggagggcccttgagcgctgaaccagagctcaagatggtcacgctgacaaaggacgacgagttcttgatcatcggcagcgacggcatctgggacttcttctcgagccagaacgctgtggacttcgcgcggcggaagctccaagaccacaacgacctgaggctgtgctgcagggagattgtcgaagaggcgatacggcggggcgccagggacaacctgacggcagtgatggtctcgttccaccaggatgcccctccccagagcagatggaacaggactagggaaggcagcgtcgcacggagcatatccgccgaagggcttcacaacctcagagtgctcctggaaggccaatgacgcacggtggtgccattgctgccgttcattcctgatgtgtgctacgttgctgagtgttaactgtaagtagcgatttccggtatcttggagctgttatttcttccacggtcagtcgacatgccagggtgggtcactattcttgtccttcagaataaaccaacgagcctgagatctcactaactgattgtgagatgctgtaaataatatgaatgttggagctagttattaaggacgagttagcagtgtgcatccagggggcttttgtggctcagtatgtgatgttttttcccctgattttctgtaaataaaaacaatgattggaattatcgatgtaatcgaactggtgttctattatgtgtgctccccaccgattcagatctacagatccatgttcagacgc

SEQ ID NO: 165 - DNA, 937 bp, Sorghum bicolor
gtcgcgcactcagagcttgtccggcggctgtcccatcccagctaaagcaaaaccaccctcgatcgagcccgagctgatcatcattcctttcacgacgcaaagaaggcaccaagaagaatcccctccatcgacgacgaaggggcgatgacgatgaggccgctgccgcagaccgtcgtccacctcctcccccccgtcgccgccgtgctcgcgttcgcgctcattggctgcctcgtgggcggcgccagcgcgacggtggtgacgacgtgcagggcggcggcggacagcgacgcgcgcgtggactacggcttctgcgtggcggagctgggcatgcaccgcgagagccccgacgccgacgtctggggcctcgccaaggtggccgcgctgacgggcgtcaacaacgccgacaacgccgtgtacgacatcaaggccctgctgctgctcgccgccgacgacggcgccaagagcaggtcgccgccgccggacggcccgacgcgcgcggcgctggagaagtgcgggaggctgtacgactccgtcgggttcgcgttcgccgaggcggacgacgagatcaacaaccgccgctacgccgccgggaagggcaaggtcgcggaggcggtgtccctcgcgcgccagtgcgacgacgccctcgccaaggccgccgccgtcccgtcgccgctggcgcagcacagctcgtacaacgtgaggattgctaatatctgcaccgccatcaccaacctcatcaagtgaatatactgctgtagtatatagtactgtaattacaggaacaggagcactcactttggtgcatccagaataaataacgtggtcgatcggcctgacaggtgacaggactttaaagtttgtataccttttgaaaactttgtacaaataatgaaaaaaaaggagttctgcgtcgagtaaagttctccactctccccaa

SEQ ID NO: 166 - DNA, 914 bp, Sorghum bicolor
cggaggaagtgataatggcgtcgtcgtgccaccacgtggatgtccccggcaagccgacggagacgggcacggcgctgctggagacggcgacgggcacgatccaggggttcgcgccgctgagccagatccaccagcacctgtgcgcgttccacttctacgcggacgacatggggcggcaggtggaggcgcaccacttctgcgcgcacctcaacgaggacgtgcggcagtgcctcatcttcgacgggcccggcgccggcgcgcggctcatcggcgtggagtacatcgtctccgaggcggtgttcctgacgctgcccgacggcgagaagccgctgtggcacacgcacgagttcgaggtgaagggcgggtttctgttcatgccgggggtgcccggcgtggtggagcgccgggacctggagaaggtgtgcaagacctacggcaagaccatccacttctggcaggtggaccgcggcgacgcgctcccgctcggcatcccgcagatcatgatggcgctcacccgcgaggggcagctccagcaggacctcgctgattgtgtggagaagaagttcggtgtgtccttccagaaggagagggagaaccgggcgtacatgagcgggccggagcacggcatccaccccctggcgaacgccgccggcaagggcctcaggaccgagatccgtgaagtcgatattccggcgagtactaccgccggtgccgggagggtcttcacttgatcgccttgtggatcgccgcggcggtgggtatgggaaatgtagtagggtgtatatagttagttagacggtgcttgctttggtccgtggttcgtcactagagtcgtttgtgttctttccgagacacagactactgtcctatgtgaactttgaattctcgcataataagagatggcacgttactaa

SEQ ID NO: 167 - DNA, 1382 bp, Sorghum bicolor
ccttctccatccgaaagccaaaggcatagaaaccagtcaagactcaagagcgagttccagtagctatagccgcgcctgttgggaaagccatctgtgtcgtcggcgatcatggaggatgagaggagcacccagcagcaccagggcggtgaggtccaggagaacgccgccgaggtgaaggacaggggactcctcgacagcctcctcggcaggaagaagcacgaggaccaggacaagaagcaggaggaggagctggccactggcatggagaaggtcacggtggccgagcccgagaagaaggaggaggagcacgaggccgccggcgagaagaaggagagccttctcgccaagctgcaccgctccagctccagctccagctcgtcgagcgacgaggaagaggaggtgatcgatgagaacggagagatcgtcaagaggaagaagaagaagggccttaaggagaagatcaaggagaagctgccgggccaccacaaggaccacgacggcgaccaccacacggccgccgtaccggcccccgcgcccgtggtggacgcgcacgctcaccaccaccaggaggaagagcacaagccgcagcacttcccggccccggcgccacccccgcacgtggagacgcacgtccaccagcatgaccacggcgtcgtcgtccagaaggtcgaggacgacgtgaagaccgagaccccacccccagcgccggaggaggagaagaaaggcctgctggacaagatcaaggagaagctccccggtggccacaagaagcccgaagacgctgccgctgccgcaccggccgtccacgcgccggcgccggcgccgcacgccgaggaggtgagcagcccggatggcaaggagaagaagggcttgctgggcaagatcatggacaagatacccggttaccacaagggcgaagaccacaaggacgccgccggcgagcacaagaccagctcctaaggtcgcccgcagcgtgtgtcctcctggccgggccatgatcgatcagaagcgttggcgtgcgttttgagttctggtttgcttttagcaagttaatttgtttcaaggtggatcgcgtggtcaaggtccgtgtgtgtgctttaagcccgaccggtggtactagcagtgaccagtgagtgttgatgcttgtgttggctttgggacgggctttagtttggttccaagtcagggtctggaactctggatgttgtgtacttgggtttgttgaattattatgagcagtttcgtattgtaattgggctgggttacctggacattggtatttgcattaataattgctttggttcctgcccagcacatatatattattgtcccgttgtgacgcttgtcaattatcatttggatgttggcattgtagaaacttg

SEQ ID NO: 168 - DNA, 1249 bp, Sorghum bicolor
actccactgctactagcctactacgcatacacagccacctgccagctttggcgatcgagcaacgacgacggacggccggccggacggacggtggacatggagcgcggcgacgactgccagttcatggtggtgcaccagtacgacgaggcggcacagctcatgcaccagctgatggtggcggccgcgggggaccagcaggaccccaacgcgggcgcggcggggcggggagccggcggcggcggcggggagaggaagcggcggttcacggaggagcaggtgcgttcgctggagacgacgttccacgcgcggcgcgccaagctggagccccgggagaaggcggagctggcgcgggagctgggcctgcagccccggcaggtggccatctggttccagaacaagcgcgcgcggtggcgatccaagcagctcgagcacgactacgccgcgctccgggcgcggtacgacgcgctccacgcccgcgtcgactcgctcagggaggagaagctcgcgctcgccaagcaggtggatgagctgagggggaggctgcagagcgtcagcgagcggcaagaccagagcggcagctgcgaggtcaacgacgccgcggacgacggcaagaggaacctaaatagcaccaccaccacctgcctggtgctggtgcaggaggacgatggtgccacgccgccggccgcagtagacgcctccggctccgaggactcggcggcgaccgagtacggctacggctacgactacgaccacgtcgtcgcgtacggcgagggcctgcacgatcccttgtgcgccactccggacctgtgggatacatggccgctgctggagtggaacgcggtggcatgaacccacgaccacgagcgaggaagaagcagcagtcgtgtactcgatcatctctcatgtctcttcttctgtatcgtcacagtgtacgtgtacgtgtacgtgtggtggattcatggtgattcagttgatccgtggagagattgactgacgggaaacagatagagatagagctagctgtgtattgatcaggaatcagctggagggggatcgatggatggaccatgaaagcttcatcacgcattgtacaccagggctcgagcgaggggacgatcgatccgtcgtcggcctctcgatcggccgccgtgcatcttaggatccatgtccgtgagaggtgtgattcgatcagagccgaggcaatggtgtcgcacgcacgtggttaatttacgcatgctgttgtgttgct

SEQ ID NO: 169 - DNA, 880 bp, Sorghum bicolor
ttatacccccatccccttccttttcgcctcgccacatcgcagagctcacagcaagggaagccaccgcagatctcaccaccactccaacacagttggatcaagcgaagccgcgtagtgttttagtccgatagagcggtgaagggagccatgacggagctgttcgacacggccgtgaccagcctcctccacctgccggaggtgctcgaccgcctcgccgccgcggacggcgaccggcgctcgggtggccaccacgctgcgcaccaccacgggcacgcacgcgtccacgggctcggtggcggcggcggcggcggcgcgccggtggacatcgtagagacccctggcgagtacacgttcgtgctcgacgtgcctggcctctccaagtccgacatccaggtgacgctggaggaggaccgtgtgctggtgatgaagggcggcagcgggaagcggaagcgcgaggaggaggaggaggaaggggagggggaagggtgccggtacatccggctggagcgcggcgcgacgccgcggtcgttcgtgcgcaagttccggctgcctgaggacgcggacacgggcggcgtcgcggcgcgctgcgagaacggcgtgctcaccgtcaccgtcaagaagctgcccccgccggagaagaagaccaagtccgtgcaggtcaccatcgcctagaagtcggtcggcgctggcagtgtagcagagtagcagtagaatcgtacgtagtggcatggcatgttgggtggggtgctcttttgttcacgtttgtgctgatctgatggtgaaggtgagctcgggggtgtgtgaccgtgcttggaatgaaatggaatcgtcgtctccaagtgaacctgcccaagaatccagttttatctgtttcgtcccg

SEQ ID NO: 170 - DNA, 2396 bp, Sorghum bicolor
tgcctgatcgcttcctttggaaaaatttgcaccaccagctcttcccttggaccgccgccaatccggacctatcctctccttgcagatgtttgcattcaattattttcgtccctgccatggcgagctctcttccagttcacgatcgacttgctgccgccatgcacggccgccgtttgttcaccgtcgtcgtgctcatcttcgcgctggtcacgccgccggccgatgcggtcaccgcggcctgcaacagcaccggcggcacctacacgagcggtagcgcatacgacatcaatctcagtcgagtcgtcggcggtctccccaccaacgcctccgcctcccctgagctcttcgccaccgccacggtcggcaccggcggcggcgacaaccagaccgtgtacgccatcgggctctgccgcggcgacatggccgccgactcctgtctcctgtgcctccagtcgagcttcagtgacgcccagggcttctgcccttccgacatggacgtgagcatggactacgactcctgccacatgcgctactccggcgccgacttcctggcggcgtccacaaacaactcggtgcagcaggccgtgttcagcagcttccccgccgtgaccccctcctccgccgccgccgcgttcaacggcctcgtggcccggctcctcaacgcgacggcggagtacgcggcggccaactcgagccggaggttcgccacgggggtgatggaggtggacagcggctactcccaggggaagttctccaacatcttcgcgacggcgcagtgcacgccggacctgacgccggcgcagtgccgtgggtgcctggcggcggccatggcggacatgcccagtcaggtgtacgctcggaactcgacgggggcgagccttgttggagagcgctgcggcttccgtttcgccccgtatcagttctacaacggcgacatcatggtgcagctgcgagttggtgagcctccagcaggaaaaaagacagcaacgactctagttctagcaatagtacttgcagtactgggtggactatgttcactcacattaattatattttgccattggaggaagataaggtcaccaagaaaatcgtcactcttcataaatgtagaagacatagaaagttttgagtccatctttatcagtctgtccgtacttcggtcagcaacaagcaactttgatgaaaagaacaaacttggtgagggaggattcggtgttgtttataagggtgccctgccagatggccaagaagtagcagtgaagagactctctgagaccacaacgcaaggactaggacagatgacgaatgagctagctttgctagctaagctgcagcacaggaatcttgttaggatcgtgggtgtttgcttggaggaaggcgagcatttgcttgtgtatgattacatgcccaacaaaagccttgatacattaatctttgatcctgataaaagcaggcagcttgactggggggcgcgattcaaaataataaatggaattgcccgaggcatgcagtacctgcacgagcattcccagctgaagatagtccaccgtgatttaaaagcgagtaatgttttactcgatgcagacatgagacccaagatttcagattttggtctggcaaagatttttgaggacgatcaaaccagacatgtcacaagccgcatcattggaacacgaggttacatgtccccagaatatgccatgcgtggacagtactcggccaagctagacatatttagcttcggtgttctagtcctggagatagtgacaggccgaagaaacaactacgcagtgaactctgagcattctccaaacctcttctgtcttgtgtggaagcactgggtggagggaacaatcgcacagatagcagaccctagtctgggcaggcactaccccatggccgaggttctcaaatgcatcaatattgggctgctttgtgtccagcagagccctacggaccggccatcgatgtcggcgatcgtagtcatgctcagcagcgacaccgttgccgtggaagctccctacaggccagcttatgtcgacaggagcaggagctacacggagatgacagtagagcttatcaaggaaaaggaagagctgtgttcgcctcagtcgtccatcacagagctcatgccaaggtagacagagaatttcccagagtaaatatccatctgcaggaacatatataagcagcccagcaggcataactatatttatttcataaattccaatcaaacaattgcacgatcggcataggcgtatactgtattcagtgtgtaactgtgtatactgcataaatacttaggtgatgtaattggactgtatactgctcaaatgcttacataatgatgttcttacaataaaattgaagacaggcacgctggcacaaattttcca

SEQ ID NO: 171 - DNA, 1291 bp, Sorghum bicolor
ctcctcgtagcataaaaccagcaaccgcaccaaacaaacaagcaaagctgctcaaaaccaagcggcagaaaaatgtggaaccccaaacccttcctcgtcctcatctcactctgcatctcggcgtcgtcgtcaccatgcacggcagccagtgccgccgccgccggcggcaagccccttgtcaccgccgtcaccaaggacgcgtccacctccctctacacggcgccgctcaaggacggccacccgctgctcctcgacctcaccagcccggtcatctcgctgacgacgtgcacctccaagaacggcacggtgaccacgctctccgcgaacgccaccgacggccagaacccgctgttcccggtctccttctccgccgtggcctcctgcacgccacaggcaaaggtccctgccggtgccgtcggcgtcgcgggtctcgcgccgtcgacgagccagtcgttcccggcgcaggtggcgcgcacgcagaaggtcgccaacaagatcgcgctctgcctcccgagcgacggcaagtcgacgaccggcgacagcgtcggcgtggccatcttcggcggaggtcccttggtcttccctgaccgtggcgacttcaccacgatgctggccggcacggcgtcgctgcaagggttcaacggctcccctgggtacttcgtctccgccaccggcatcgccgtggagcagagtcgcgtcggcacctcctcggccggcggctcctcgctggtcgtggcgctgagctccacgacgccctacacatctctccggcccgacgtgtacgtgcccttcgtgaacgcgttcgacgcggcggcgaccgggccaaacttcccgtggatgtcgagggtggccgccgtcgcgccgttcgagcggtgctacgactcgacgaagctgccgccgacgcggctgggctacgccgtgccgcagatcgacgtgatgctgcagggtgggcagaactactcggtgctcggcggcaactccatggtgcaggtgaacggcaacacggcctgcctcgggttcgtcaaggcggcggccggacaagcgccggcggcggtcatcggtgggttccagctcgagaaccatctgctggtgctggatgtggagaagaagcagctcggattcaccacgttcctcaatgccgtcgggctttcgtgcagcaacttcaatttcactcttgctggctagtgttgaagcagcaaggtgctgagttgtactcgtatagtgtaataagaacttgtgctgcagtgtattaccactagaataaaaataaatgaatgaaatgggaattaat

SEQ ID NO: 172 - DNA, 1351 bp, Sorghum bicolor
ctcactcattaggcaccccaggctttacactttatgcttccggctcgtatgttgtgtggaattgtgagcggataacaatttcacacaggaaacagctatgaccatgattacgccaagcttgcatgcctgcaggtcgactcccgggtggatccttacgcttgggttggcagcatgcacttaaaaagcagcaccacaccacacgccaagaaattaaaaagcaaccggccaacgagtcacagcatagagatgacgctcccgcgccgccgccaccttgtcctgctcgccggcctcctggtcctcgtcgtcgtcgcggccaccgccaccgcgtcgacggattcctcttccaccacggcggtggcggtggacttcgtgcggcggtcgtgccggtcgacggagtacccacgggtgtgcgagaccacgctggtcccctgcgcggcgagcgtgggtcggagcccgcggcggctggcgcgggcggcgctggtggtgggcgccgaccgcgcgcgcaactgctccgcctacatccacggcagccgcagcggcagcggcggggcgatgaaggactgcgcggagctggcgcgcgacgcggaggaccggctgcggcagtccgcggcggagatggagcggatgggccgcgccggcaccccgcgcttcgcttggtccctcagcaacgtccagacctgggctagcgccgcgctcaccgacacctccacctgcctcgactccctcgcgcagcacaaggaccgcggccgcggtggcaagggcagcgacggcgacgacgatgccgtcagggtgaagaggagggtggtcgccgtcgcgcaggccaccagcaacgcgctcgcgctcgtcaacaggctccagccggcgacgcaccggcagaggctcctcctgtgactctctctctctctcgtagctgcagcttgctatggaagtcggtgctgctgattcctcatcgatcctcctcgctccatgtccgattcctcacttcccctgcatctccttcgccaatcccatgtatgtatgtatgaatgaatgtatggactatggatatggttcgatcagcttgctcgatttcgtagttggtaccattgagctcaaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagtt

SEQ ID NO: 173 - DNA, 1376 bp, Sorghum bicolor
agtcagtcagtcagtgagtgtcctgctcctgcttctgccttcgttcgtcgtccttcttaaaggcgcaggcgcaggcgcgcacgcacggcgacaccacgcctgcgttgcgttggctgatcatggcggcgagagctcatcatctgctcctgcgactcgcgctgctgtgcgcgtgcgcgtgcgccgccgccctcggctcggccaatgcggcggggaggaagatggtcggcgtgtacgagctcaaggcgggcgatttctccgtcagcgtcaccaactggggcgccaccatcacctccgtcgtcctcccggattccaaagggaatttggctgacgttgtgcttggctatgacaccattggaggatatgtgagtggtaaaagctactttggagcccttgttggacgagtagccaacagaattgcctatgcacgcttcgtgcttgatggaaaagcttatcatctttttaaaaacgatggcaacaacacacttcatggtggccataggggtttcagtcaggttatatggacggttaaagaatttgtcgccggcggtgactcgccctacatcacactgtactaccatagtttcgatggagaacaaggtttcccaggcgacctggacgtgtacgtgacgtacgagctggcgtccccgtacgagctgcgcgtgcacatgaacgcgacggccgcgaacaaggcgacgccggtgaacctggcgcagcacacgtactggaacctgggcggggagggcagcggcgacgtcctccacaacacggtgcagctgttcgcgtcgcggtacacgcccgtggacagcgcgctcatcccgacgggcgtcgtggcgcccgtggccggcacgccctacgacttcctggccccgacgcccgtgggcgcgcgcatccgccaggtctccggcggcaaggccggcatctacggctacgacaccaactacgccgtggacggggacgacgccggcgccggggcggcgctgcggaaggtggccgtcgtccgggacggcaagtcggggcgggcgatggagctgtgggcgaaccagcctggggtgcagttctacacgggcaacttcctccaggacgtcgaggggaagggcggcaaggtgtatggccagtacggcgcgctgtgcctcgagacgcagggcttcccggacgccgtgaaccaccccagctttccctcccagatcgtcaggccggggcaggtgtacaagcacgacatggtgttcaagttctccttttagctagcaagtcacaataatttccatcagtttcgcaaagctgaatcgtttgcgttgttcaaaactgctgtcgtttctttgccttgttcgtttggctgataagccataacaaaagatactattgactaatttgttgtg

SEQ ID NO: 174 - DNA, 2710 bp, Sorghum bicolor
aaaccaaacccgaggctgcgctgcgccgagccgcgccgcgccgcatccaacacctaaacccctcgccgccggccgctccgattccggcgatgtcgtcgtcgtcgccgcctcgcaggccgcagcgccgcgcggcgtcgacgcgccctccgtcgtacgacgagtccctcctcgacgccgagctggagggcttgctcggcgacgccgcctcgcgccgcgtgcggcggctgcgccggctgtccgcggaggagcggcagcgggagacggagacggaggcgctcatcgcgctctctctgggtttccccatcgacgagctgctcccggaggagcggcccctcctcccgccccacatcgccaacgcgcccaacgactacatcgtcgtccgcaaccacatcctcgcgtcctggcgcgccgacccgcgcgcgccgctgccgctcggctgcgtcctcgagaccgtcgcctcctcctacgaccgcctcgtcgccgcggcttacgggtacctcgcccgcgcgggccacatcaacttcggcgtctccgccgccttccccgccgcgccgcccccggacgccgccacccagggcgccgcggccgtcctcgtcgtcggcgcggggctcgcgggtctcgccgccgcgcgccagctcctccgcttcggtctccgggtgctcgtccttgagggccgctcgcgccccggcggccgcgtctacacggcccggctaggtgaggataaggccgccgtcgagctcggcggcagcgttatcactggtatccacgccaacccgcttggcgtgctcgcgcggcagcttggtcttccgctgcataaggtgcgggaccgctgcccgctctactacccagatggccggattgtagagactaggctggataggaccattgatttggtgttcaacacgcttctcgaccacgccaccaaggttcgggagtctcttaatgaagctgcagagaggatttcgttggaagaagccatagagaaactcaggagactctaccatgtggccagaacggatgaggagcagatggttttgaattggcattttgcaaatttggaattctccaatgccggctgcctatcagagctttcactcgcgcactgggaccaggacgatccttatgagatggggggagatcattgtttcttagctggaggcaattctagactcatacatgcattgtgtgatggggtgccggtactctatgagaagaaagtgtcgcgaatcgagtatggagtggatggggttagtgtcacagtggaagaagggcagatttttcaagctgatatggttctctgcaccgtgcccctcggggtgcttaagagtggaagcatcgtgtttgacccagagttgcctcaggagaagcttggggcaatacagaggttgggatttgggttgttggacaaggttgccatggtgtttccccatgtgttttgggatgagaatattgacacgtttgggtgtttgaataaggatagcagcaagcgtggggagttcttcctcttctacagctaccacactgtctctggtggagcggttcttatcgcacttgtggcaggagaggctgctttggagtttgaaaaggttgatcccatcgtttcacttcatcgagtacttggcattctaaaaggtatctatggcccaaaaggtgttactgttcctgatcccattcaatctgtttgcacgagatggggcagtgatcctttttgctcaggttcatactcacacgtcagagttgggtcttctggtgctgactacgacattcttgctgagagtgtgaatgaccgactctttttcgctggagaagctacgaatcgcgcataccctgcaaccatgcatggggccttattgagtgggttaagagaagcttccaaaattcatcgtgcctcagaaagcttagtgaattctgaccagaagaagaattcattgcctaaaaggctcaaaccacccaatggtgcccttttggatctgttcttggagccagacctagaattcgggagattctcattcgtgttctcctcattgacacctgatgatccagaggctacagggatacttcggttttcacttgacaagcgtttctttctgcagcccaataatccggagttagatggggatcaaaaggactacagctctgcatctggggccttccatttgtatgccactgtctctcgagagcaggcagatcagctacagaagtcaagcgaagatgatagaactaggctaggagtgttatgcaaggattttagtgtaaagctaatgggttatgataatacatgcgatgtaggtagcgatctgatttcgagcatcttgagtgcacggaaagccaggaaactgctgcagcacccaaagaacttcaagatctcacgttgatgtgtaccagttcgtgttttcttttgtagaacagaatgcgttattttgttatgttcaagacaggctggtggagcttggaatttgctatgacgtgtacagattacaaactgtgtctcgctttagcaggaactgggaatctggaatgctccatgttctgttcttcacttgtaaaaattgctggtcatgtgacttcagactttagttggttataggctttgtttagttccaaaaactttttagttttagatactgtagtatttttgtttttatttagtaattattgttcaattatggattaattagatttaaaagatttatctcgtgatttatagata

SEQ ID NO: 175 - DNA, 2516 bp, Sorghum bicolor
acgtatcacctgtttctccacctctctccaattcgctgcgcccaacgatcatgtggaggctcaaggtcgccgaggggggcgggccatggctgaagtcgtgcaacaacttccgcgggcgggtggtgtgggagttcgacccggagctcggcacgccagaggagcgcgccgaggtggagagggtgcgccgggagttcacggagcgccgcttcgagaagagggagtcctctgatctcttattgcgtatgcagtatgcaaagcataaacatcttcaggtggatcctccacccaccaagctcgcagaaaatgtagaagtcacagaggagatcatattagcggcattgaggcgagccctcgatcaacattcaagtctgcaagcagaagatgggtgctggccagccgactatagtggcattttgttcattatgcctctcctggtattcgctctatataccactgggtcactcgataccgtcctatctaaagaacatcgacgtgagatatgtcgctatatttacaatcatcagaatgaagatggtggctggggtaaacaagtgttgggaccaagcaccatgttcggctcatgcttgaactatgttgccttaagacttattggtgaaaagcccacgaatgctgcattgaccaaaggacgtcagtggattttatcccatggaagtgcagctgcaattccacagtggggaaagatatggttctcggtgatgggtttgtatgattggtctggaaataatccaatagttcctgaattatggcttgtcccacactttcttccaattcatccaggacgattttgggtattttgtcgtatggtgtatctgcctatggcttatctctttggtagaaaattcatcggaacgattactccaactatattggaattaagggatgagctctattccgtaccatacagtgaggttgattgggaaaaagctcgtgatacttgtgccaaggtggaccttatatatcctcgaacaatggcacaaaatcttgtatggacctgccttaataaggttatagagccaatgctgaattgttggccagtaaataagttaagagatatagcattgaaaaacatcatgaaacatatccactacgaagatgaaactagtaaatacatctgtacatgtccgataaacaaggcgctagatatgatttgttgttgggcagagaatccaaattcagattcattcaaaaaacatcttccaaggatatatgatatgttatggattgcggaagatggcatgaaggcacaggtctatgatggtaatccaacatgggagacttctttcattgtccaagcctattgctccacaggtcttgttaatgagattggttcaacactccgtaaagctcatgaatttattaagagttcacagatttgtgagaaccaccccgactacaaaacttactaccgtcataaatcaaaaggttcatggacactttcaacagcagataatggatggtcagtatctgactgtactgctgaagcagtgaaggcattgatgttgttatcaaagatttccccagatcttgtgggggaacccatagaaggacaaagtttgtacaatgcagtggattgcctactttcttatgtgaacaatgatggcaccttctcaacatatgagtgtaagagaaccacacctttattggaggttctcaacccttcagagagctttataaatattgttgttgattatccatctgttgaatgcacatcatcagtgctacaagctctgattatgttcagagacctagatcatgggtatcgcaaagaagagataggaaattgcattgaaagcgcaactaagtttattgagaaagaacaacgaaaagatggctcctggtttggcagttggggtgtatgtttcacatatgggtcgttctttgcgataaaagggttagctgcttctggaagaacttacaaaaatagtgataccatcaggaaagcatgtaactttttgttgtcgaagcaactacatacaggtggatggggagaaagttatctttctagtgaaactgaggaatatgtggatgctagtagacctcatgctgtgaacactgcttgggcaatgttagccttagtttatggtgggcaggtggaacgtgatccaacaccattatataaagctgcaaaagtgttgatcaatatgcaactagaatctggtgactttccacaacaagaacatgttgggtgctttaatagttctttgtacttcaactacgggaactaccgcaacttgtatcctatatgggctcttggggaatttcgtcaacggctccttgcaagaaagaagtgaaaccaaaatccatgaaatctaggctattttactttattacaaagaatatacaaaatgttcagaattactgttatatgttagtaattgtgcttacggtccggttatgatagtggaaaactaatggctgtcgtacataatatattgatgtgaccttccgaatctaaggacagagctgtcgctctttcttgtttttatgatttcttg

SEQ ID NO: 176 - DNA, 1028 bp, Sorghum bicolor
caccttcgcgtacgggccacacaaacctcgtctccgatctgaaaaatcccccctgccattccattccaccagtctatctatctcattcccaaattttcctcatcggcttcgcttcccccaaatcgaatccccatcgctctgctccatccatggcaactctcaccatgcagccgatcggtcccacccccgccccggctgcgcaggaagaccagaggaacggggagaatcttcctaccgtggatgctaccgatttgagtgacatcgactcgggttgggttatcctcaagaactcggatattgtttccgcggatttggcagccgccgccgtcagtggaggtcagcgtctaggctcttcaacgattcctagctgggcacggtgggttctgggaggtgtggtgtacacggtcgtgccgttctacaacagagttaggcatctcgaagacgagaccgtggggttcgtggagaatgctgtggaggttgtggagcatatagctgaagtaacagagaagctagctgcgaatgtggctaagcaacttcctgaagatgggtctctgcagaaagcagcagaggatgttgagcacattgctgaggtggtggatgatgatgcagagaagtttgaagcagtcgctgaaaagatcgacaaggtctgtgatgagattgatgctgctgtggagccagtcatcgaggagcttgaaaaggaacttgatcagagtacaacgtctgagaaaggagttgacacaaagaattgatcaacatcatgttaggggtactcctcattgtatatagcgtctgtactattgtttttcttctctcctctttggaaaaactgcttgtacatatgtatggtgttgtatgaactgcacttgcaagatgcaacccaccatgatcatagtaaggcatggagattgtgtgcttgggtgctcgtagatgaagaaccgaagactgtttgatgttgaaagaattatttgtactctatcaagtcattatgcataaataaatacatattggttcgcatttgtttctctgta

SEQ ID NO: 177 - DNA, 891 bp, Sorghum bicolor
gcagaggcagagctagctagtagaaatttcgaaaatcgacacaggagaggtcgacgacgacgtcgtatttttttttttaaaaaaaaggcttggagtatttttcggatttgtatatatacaaccgacatcgaagaggaagagaggctgctgcggcggcatccatggcggcgctggcggtaacgacgacggcgacgacgagcagcaggcaggtggaggaggcgccggcggggcggatgtcgtccatagagtgggagcccaagacgctgaccctcgaccagatcaagttcgcaagggaggcggcgctgtacgtggtgagcaccaagacggaggaggaggcgatccgcatcttcaccgagggcctcaagcccgtgcagatgacgacggcgaccgtccgcaagtccagctccatcgactcctcgtccgacgacgacgtcgagctcggctgctgctgctgctgctcctccgccggctccaacaaaggctgttgcggcggcgggagcaaaggcggccgccgtggtcgacggcggcgctccatggacgacgacagggacgtcgctacggcgccattctagtagctacctagttgttcttttttttccacttcttattatagacgtaagtaaagctattagctgcgtgcgtactaggaatagtctagagtctacctgtgtgtgtgtgtgtttttttttacctcgcctgtttttacttggttatcctttggctggcctctggttcgtttgaaggagcagccggccagccggcgagtttggcccagccttttagcgcggcgaatttttgtggcacagggctctcttaattagtactcgtagcttaggtacaagagatatgtagatacctgcagaaagcttagtgtacattacagctttttat

SEQ ID NO: 178 - DNA, 2161 bp, Sorghum bicolor
caaaccggacaccatgacaaccgaaccctacaaatctcactcactcaccacccgccgccactcagttggttctctccctcctcaatcgggaccgagagctaaaacctagcccgcgccggccatgtcccgccgtgcgccgttctccaacctggaccccgcgacggcggccgacacgcggcgccagcgctacgaccagcacgagcaggacgggtacatggagcatctcctgccgtacatccacagctgcgtccccgacccgcccgtctccaccaccgcccgcctcgtcgcccgccgcactggcccttccgacggcgtcgaccgcatcagcagcctctccgacacgctcctccgcgacatcgtctcccgcctccccttcaaggacgccgcgcgcaccgccgtgctcgccacgcgctggcgcgggctctggctcgccgcgccgctcgtcgtcgccgacgcgcacctcctgaaccactggcccccgacgcccgccgacgcggcgcccgtcaccgccgccgtgtcgcacgccctcgccacgcacccggggcccttccgctgcgtccacctcgtctccacccgcatggacgcgtaccagccccagctcaagcgctggctccgtctgctcgccgccaagggcgtccaggagctcgtcctcgtcaaccgcccgtgcccgcgggaggtgcccctccccgacacgctcttccggatcgccaccctcacccgcctctacatcggcgtctggaagttcccagacgcggcccacctccaaggcgcctcctttgccaacctacgcgaactcggcatcttcagcgtcgtcgtggaggacggggacatcgactctgtcgtcgccaggagccccgtactggagatcctcaacatccaagggaccattaaggggttgcgtctcgtcggcaacagccttcggtgcgtgcagatctgcgcttccgtggtggagaacattgccgtggtgcacaccccttgtctcgagcggctcatcctgtgggacgtacggggatctcccaaccctgccagtggcttgtgcaccaggatcaagattggaaaagcccccaagctgcgcattttgggatatctggagccaggaaaacacgtgctagagattggaggcaccaccatcatggctggcattaaaccaagcgcaagcacaatgctcaggacggtcaaggtcctgagcatcaaatcgtgttttggatccaatgacaccaagatgttgcctgacttcctgaaatgctttcccaacgttgaggctcttcacgttatttctgtcaaatgtaatgaacctggtgacaagctcaacaccaagttctggcaagaggctggtcccattgtaagtgtgcttatgcgcatcaaggtgatgacagtccgtgagttccgaggggagcaacatgagcttgccttcctccagtatttctacgagaatgcacgggtgttgaagtatgcatcagtcgtggcagccaatgcaagggtcactggaatatcagacaaacagatgttttccattctgcagaatatgaatgatgcaagatgggctagtaaatttggactggctatcatgggaagcaatggtcccgaaggaggtagaccctggatgtttgaacgaggatcaaatttttctgatgatgacccttttgcaccagttaaatttcttgaacatggccctgcctctgcgccaagatagaacaagactgcttgtggtggcacacgctgcatctgagatcttcaacctatgaagcatgcatgtgttctggttctgtaatgagtaactactcttgaagattccctcccgttcttagttctgccagcacggttagcttgagtgttgcagttagcagtaccattttgatgcaagtgaccacctttctgtggtaaatgcttttagactgggtattacagaccactgaaatctgcatttcatgtggtttcgttagctagctgtatcatcatacattgatgttgcattgtgtagtttctgctaaacatatggctttgatgctaatgataattagtgataactaagctaattcatgtttcatgcactgtataattttcctgtcgacttggcgtgaaatgtttgttccaccaagtagttcgggagcacgaactttcagcaacaaaatttgaaggtgagccaagttcgctgcatgaa

SEQ ID NO: 179 - DNA, 2112 bp, Sorghum bicolor
gcgaagcgcctcgaagccaaagcttccacattccactagagcacgagatcgtagcagtcaccacgccaacaaaagcagcaaagcaaaagctaccgtcaccgacccgacgttccaagaaacgaaacggccatgatgatgatgggagagggagcttacgcgccgccgtggcagcagtcaccggcggccagcatggacgcggatgaggcggcgtcgccgtacgccctcctggcggcgctgcagcattacctgccgtccaacgaggtgtcggcggcggcggcgccgtacgacgaggacgacgaggaggcggccctggcggccggggtggacgcgtacgcctgcgacgagttccggatgtacgagttcaaggtgcggcggtgctcccgcgggcggagccacgactggacggactgcccctacgcgcacccgggggagaaagcccggcgccgcgacccgcggcggtaccactactccggcgcggcgtgcccggacttccgcaagggcgggtgcaagcgcggcgacgcgtgcgagtacgcgcacggggtgttcgagtgctggctccacccgtcccgctaccgcacgcagccctgcaaggacggcaccggctgccgccgccgcgtctgcttcttcgcgcacacgccggaccagctccgcgtcctgccgcagcagcagcagtccagcccgaggggcgcgtcggcggcgtcgccgctggccgagtcgtacgacggctcgccgctccgacggcaggcgttcgagagctacctcaccaagagcggcatgatcatgtcgtcgtcgccgaccagcacgctcgtctcgccgccgaggtcgccgccgtcggagtcgtccccgccaatgtcgccggacgctctccgccgcgggtcgtggccgggcgtcggctcgcccgtcaacgaggtgctcgcctcgctgcgccagctccgcctcggcgcgggcggaggctcgccgaggtcagccccatccagcgggtcgtcgttcttggccggcggcagcggcggcggctacccgttcgggtccccaaagtcaccggcggctgggctgtacagtctcccgtccacgccgacctgtaggccgtccccggtgacggtgaccaccgcctccggcgccaccatcatgaccgtggaccgcctcaacctcggactcatcggcgacgaggaagagccggtcatggagagggtcgagtccggcagagccctccgcgagaaggtgttcgagcggctcagcaaagaagccaccgtgcccaacgacaccgccgcctccgccaacgttgagggagcagctccggatgtcggctgggtctccgacctcatcaactgatgagggaaactcatgaaactatcagcatcaaccgtgcctcctctgaaactgtgcttagccatggtaagtgggaagcttggaggcatcactgcacaacaggagaagaaatttcaggggaaaaaacaaaaacaaaaaagatttttttcttagatttctactaagattctcctgatctttctacatatgttcctctctgtgtgaatattcttggatggatggttgttcaagggagggcagggaggtaagaggcaggaagacgggcatgtcagtgaagtgtgaaggtagaagaagcctaggaggagacaagaggtggcagcaaaacatggtgtggggaaaatggatcaagaagacatggcaggcgaccatgcatgtatatgagttatctagatgtacatagcgtatgtgttcgtgtgtgcgtgtgcgtgtgtggaggtgtagcgtggagggaggcgatcatggcggcgatccaagaccggagaagaagaagactgggatttatgtcaccgccggcgcctccggtgaggttatccgggaagcaggcctggaacttctaatttccgcaagcgattccagaaaaagcgtcgtcttttgagttgatgtttactcgcattccagcgttcattctgccttctatttgatgtttaagatcgacgagttgttattactgctctgtaagtttctcaatgtattctccttattgatctactgcttcagcttatggggagcatgtaccttgtaccatgtaatatttttgctgataaggaattaattaagttaaaaaac

SEQ ID NO: 180 - DNA, 2295 bp, Sorghum bicolor
agagagagcgagagaccctctcctccccgccggtccgcccccacgaccaaactccgcgagcgcgatccgagcacggacaccgcagcgcagcgcggcaccgagccgctgcgactgcgaacgagaccgcaccgcagccacagggagggagagacccgccccgcctccctcccggagaaaaggcagacgcggcgggcggcggcccaatccggagggcgcgaccggtccggtcctgtccttccttccttcctccgttcgttcgttcgttggcctcctcctcctcctgttccgttcctcttcttggcgcggcggcaaataagaggaatatagaagaaatagcaagagccccgagccagagggggcaacgaccaacggcacgccgccgccgccgccgcggacgctcgtgctgaggtcggtcgccgctgccacgacacaaggcgatggcgcggttcatcctgagcctgatggagctcggggtcagcgccaccgtgcacatgctcttcggcctctacgtcttcagcacggccgtcgccgccgacatctcgcaggccgccgcggcgtcggggtgcctcctgctgcgccgcccatgggcgcctcccgagggagcgccgctcgtcgacgtcgccgccgcgggggagagcgacgaccgcaggggcgccgcgcccgtcatcctccacgcctcgccgccgcccatcgtcctcgtccacggcatcttcggattcggcaaagggaggctcggtggcctctcctacttcgccggcgccgagaagaaggacgaccgcgtgctcgtcccggatttggggtcgctcaccagcatccatgacagggcgcgcgagctgttctactaccttaagggcgggcaggtggactacggcgaggagcacagcaaggcttgcggccacagcaggtttgggagaatatatcacacagggcactatcctgcgtgggacgagcacaacccggtgcattttgtcgggcactctgctggcgcacaggttgtgagggtgttgcatcagatgcttgccgacaaggctttccctggtcatgatacttctgaagattgggttctgagcctgacttccttgtcgggcgcacttaatggaaccacaagaacttactacgatggcatgctggttgaagatggtaggtccatgaaatatatctgtcttcttcagctctgccggctcggagttattgtgtacgattggctagatattccttggctgaagaattactacaattttggttttgaccactatgagatgtcacggaggaaagtaggcttttcaggtctaattaatctgcttgtggggcacacaggcccatttgccagcggagattggattctacctgaccttacaatccaaggatccatgaaactaaactctagacttaggacctttcccaatacattctacttcagttatgctacaaagaaaacaagaaaattatttggaattacagtgccttcaagtgttcttggagtgcaccccatgctctttctgagagtcctccagatgtgtatgtggcggcaccctcaaagtgcacctctgccttacaaaggatacagggatgaagattgggaagacaatgatggggctttgaacacaatctctatgacacacccccgcattcccattgagcatccacaccgtctggtagtggacgattctgactgccatcctttgcaacctgggatatggtattacaagattattgaagctgaccacattctattcattgtgaatcgcgaaagagctggagtgcagtttgatttgctgtacgatggcatttttcagcgttgcagaaagcatgcctttaggaagagcccacctactgtaccaaacgaaacaagtcaatagcagaacgaagacaaagtatttgtaggtagtacataggaagaagagaaacaaggtgccacagcatttttattaactgtaaattatattgttgattgaacgggaatagcatatttgcttctccaattcttggaatggggttcaaggagactgggatcaaattaatgctccgccatacagtctaatgcaaggagatttgccttgcagtgttgatttaccatgaatgaacaggagacgatggatccgcagttgcctatggcctgactgtagctatgataagtctacatacgttcaaaaagtgatatgtagacatatagatggttctacggatggtgtaacattgtagacttgcagtagtagcagggtttagtgaaaagaagtggttctaaattatgatttccattcggtggcagttataaggattggatatctttgtttg

SEQ ID NO: 181 - DNA, 1457 bp, Sorghum bicolor
gctgaggacagtccgacagtgtaaaaatggtacagtcccgcgaagaaaagcaaacccctcgccgccgtctcctagttggagtccgatattgctggaggtcgccgcgttccaaaatccgttaggcaatggcgccccctctcctctcgccgccggtgctcgccgacgcactagcgacgccgccacggtctttcccctgctccctccccacgcggcgactgcctaccgtcgggttcgccggagccgtacggagcgacctgcagcagagctggagtgcgcggaggagggatctcagggtctgtgccactgcgacggaagcggatcatgaaagggaggaggatgtcgccgacgattactactccgttctgggtgtgatgccagacgcaacccctgaggaaattaagaaggcatactacggttgcatgaaagagtgccaccccgaccttagtgggaacgaccctgacgtgactaatttctgcatgttcattaacgaggtttactcggtgttgagtgatcctgcacaacgtgcagtgtatgatgagatccatgggtacacagcaacagcaatcaaccctttctttgatgacagtgcacccaaggatcatgtgttcgttgatgagtttacctgcattggatgtaaaaactgtgccaatatctgccctggcgtctttgagattgaggaagattttgggaggtcaagagtctactcccagtcaggtagcacagagctaattcaggatgccattgatagttgcccagttgattgtattcactggacttctgctgcacaactgtcactcctcgagaatgagatgcgtagagtagagagggtgaatgttggtttgatgcttgctggtatgggagcttcagtcgatgttttccggatggcaagtgctcgctgggaaaagaggcaagcaaaagtcttgggaaaagtcagaacacggatggtgaaacaagagaattcagacacgagaagctcttggagtgacatttggggatccccaccacaagatcaaagcaacgaggaggaagtatcagagagggccaagagagcggcagctgcagctagacggtggcgagagttctccagacgaggcgcagacaggcctccgacacacaagctcccggagtcagtgggcagcaaagattaattagtccgtggaacagagaaacatctggcatcattaatttgaccatatctggcatattggctaaaatgtacagtgtcgttgtttgatacgtacggaggattgcagtgccttcccagattgcactcggctccatttgtaaacctaaatctaggtaagtagatatagtggtgctgatcaacctgtatagaagtcaagcaccaagtgtagaacataggtcaaacatgtacgtattacaaaataaaacaagtatatacacattattcgccataccatcggagtatgtagtgcattgtaacctttcgcttttgt

SEQ ID NO: 182 - DNA, 706 bp, Sorghum bicolor
acggcacccaacacacaacacagacacaccaaaacgtacgcgtgcttctcgatcgatcgatcgaacctgcagcaggtgtccaagcgtcatggcggcagcgagcagggcgtctctggtgctgttcctggtggtggcgacgagcgcggtggtggcgagcatgctggccgtggccccgggcgcgggcgcggcgacgacggcgtgcgtcccgacgcagctgaccccgtgcgcgccggccatcgtggggaacgcggcgcccaccgcggcgtgctgcgcgaggctcaaggcgcacccggccagctgcttctgccagtacaagaagaaccccaacatgcagcgctacgtcaactcccccaacggcaagaaggtcttcgccgcctgcaaggtgcccctgcccaagtgctgaatcaagtgcatgcagctagagtagtgcctagtctgttccttgtcgatgtcgaccttgacctctcgcgggcacgcacgcactctcgtgtatggtacttatgaatacttggctgagttagtattttgcttgagaataaacggagacgtagtaattcagtactacttcgtagttggtacagtgtgagtcctctgctctgtgcagacttggtatgtcatgtatttatacgtgtcacacgtatactatgtatgatgttacaaaatgaataaaagtgttgccacttctgagttgactttggacagacta

SEQ ID NO: 183 - DNA, 1519 bp, Sorghum bicolor
ggcctcgtttcttctccgtcgctttgcaagcgaggacagatggacggatacatgagggagacaagcgccgccagggatgagggcggccccgccgtgtgcaaggctgtggcgggcgggaacgtggaccggaagggcggcgcgtccgcaaggcgccgccgccgcctcgagctccgccggctcgggcgggccacggaggggtcacccgtgccggcgaagaggatccggtcgggttcgcacagatcgtcgtcctccgactcgtcgctggagactgcggcggcgggctgctggccgccgcgcctgtcgcacggcgccgtgtcggtgatcggccggcggagggagatggaggacgcgttcgccatcgcgctctcgttcctggcctcggacccgtcgtcgccgggcgccaaggacgagcaggagcaggacttcttcgcggtgtacgacggccacggcggcgcgcgggtggcggaggcgtgccgggagcggatgcacgtggtgctggcggaggagctcggcctgcggcgcggcgtcggcagcgacgacctgcgctgggaggaggccatggcggccagcttcgcccgggtggacggcgaggtgaccggcggcttctcgcccccgcccaagccgccgccgcagcagacggccgcggacgccgccgacaccaacgccggagcaggcaacctgccctaccgcaccgtgggatccaccgccgtggtcgcggtcgtgggccaacgccgcatcgtcgtcgccaactgcggcgactcccgcgccgtgctctcccgcggcggcgtcgccgtgccgctctccaccgatcacaagccggatcgtccggacgagatgcagagggtggaagcagctggcggcagagtcatcaactggaacggctatcgcgtccttggagtcctggcaacttctaggtccattggcgactactacctgaagccgtacgtgagcgcggagccggaggtgacggtggtggagcggacggagcaggacgagttcctcatactggcgagcgatgggctgtgggacgtggtctccaacgagatggcgtgcaagatcgctcggaactgcctcaacgggcgggcggcctccaagttcccggggtccgtcgccggccgcaccgcagcggacgccgccgcgctgctcacggagctggccatgtcacgcggcagcagggacaacatcagcgtcgtcgtggtcgagctgcagcggctcaagacgagccctggcgcggcctagtgcaagttgttggtttttgctgagactgaactgagagcatgtagctgtagcgtgtagtagatgataaaatttaaatatttgagcgtgtgctgagaggctggggattattaagagactctccggcccgctatcatcagggttctaattgaacggcatgttgatgcagtgtgtacatagggagcgttagttgtaaaatgttcatttatctcggtgttctaattactagcaatatgcaatttctattctcttattattcgtgtttatcagaatgtattgcctt

SEQ ID NO: 184 - DNA, 1735 bp, Sorghum bicolor
aacttggaagttggaagcagaggatgcagtaatagtaagtgcagatagcaagatacacagccatggttgttttgccaatattgtttctcttgttgggttgtccaacttcccgtgcagctgatgaagaactcgagctcactgtcgtggacgtgagcttgctgcaggaaccgcgtgccagctgctccggacacagggtgatgccaccccacccctacaacaacagctgggtgccgctgtttcgtcctctcggcccgtgctcgccgtcgttcaagggtgcggcggcggcggcggcgaggacgaagccgtcgctggccgacgtgctccggcaggaccggctccgcgtccaccacatccatagaagggtgtccggctcctcccgcggtgcgcgcgcgagcaagggctccttcaaggagcccgtgtctgtcgaggaaacccagctccaccaccaggccgccatttccgtcgaggttggcacttcacagacgagctccgagcctagtagcggcattcatccggcggcggccaccgacggcagctcaagcccgccggtgacggtggtgctggacacggccggcgacgtgccgtggatgcggtgcgtgccgtgcaccttcgcgcagtgcgccgactacgacccgacgaggtcgagcacctactccgccttcccctgcaactcctccgcgtgcaagcagctcggccgctacgccaacggctgcgacgccaacgggcagtgccagtacatggtcgtcaccgctggcgactcgttcaccacgtcggggacgtacagctccgacgtgctcaccatcaactccggcgaccgcgtcgagggcttccggttcgggtgcagccagaacgagcagggcagcttcgagaaccaggcggacgggatcatggcgctcggccgcggcgtgcagtcgctgatggcgcagacgtcgtccacctacggcgacgccttctcctactgcctcccgccgacggagaccaccaaggggttcttccaaatcggcgtgcccatcggcgcgtcctacaggttcgtgacgacgccgatgctcaaggagcgtggtggggcgtcggcggcggcggcgacgctgtaccgcgcgctgctgctggccatcaccgtcgacgggaaggagctgaacgtgcccgcggaggtgttcgcggcggggacggtgatggactcccgcaccatcatcaccaggctgcccgtgacggcgtacggggcgctgcgagcggcgttcaggaacaggatgaggtaccgcgtggcgccgccgcaggaggagctggacacctgctacgacctcaccggcgtccgctacccgaggctgccgaggatcgcgctcgtgttcgatgggaacgccgtcgtggagatggaccggtcggggatcctgctcaatggctgcctcgccttcgcgtccaacgacgacgacagctcgccgtccatccttggcaacgtgcagcagcagacgatccaagtgctccatgacgtcggcggcgggaggatagggttccgcagcgccgcctgctgatcggaatcttagcttaattggttccttttgcatgttaattgtagtgcacgcctatgcacaaaactgatgagcatgttctgttagtgccagtattgaccttgcgtaatacgtattgttaggcaataatggaaattctatttcgtcgagcacatagagagtgtcggaaattaaactcggaaccatgcatgttgtgaattcattgtggtcgtcgc

SEQ ID NO: 185 - DNA, 1646 bp, Sorghum bicolor
atctcatcgcatcggcatcgcatcgcatcgcattgcgcgcgcagccgacgccacgccacgccacgccaagcctcgccgaagcaaagacgatggcgcccgccgcgtcatccccgccgccgcacgtggcagtggttgccttccccttcagctcccacgcggcggtgatgctctccttcgcgcgcgccctggccgccgccgccgcgccgttcggggccacgctctcgttcctctccaccgcgtcctccctcgcgcacctccgcaaggccagcggcggcgccggcggctccgcggggaacgggctcccgatgaacctgcgcttcgttgaggtccccgacggcgcgcccgtggccgcggccggggaaaccgtgccggtgccgcggcagatgcagctgttcatggcggccgcggaggccggcggggtgaaggccggcctggaggcggcccgcgtcgcggcgggcggcgccagggtgagctgcgtggtgggcgacgcgttcgtgtggccggcggctgacgcggccgcctcggccggggcgccgtgggtgcctgtgtggacggccgcgtcgtgcgcgctcctggcgcacctccgcaccgacgcgctccgagaggacgtcggcgatcaggccgcgaaaatggcggacgagctgctgatctcccacccgggcctcgccaggtaccgcgtccgtgacctccccgacggcgtcgtctccggcgacttcaactacgtcatcaacctcctcctgcaccgcatggggcagcgcctcccgcgctccgccgccgccgtcgcgctcaacgccttcccgggcctggacccgcccgaagtcaccgcggcgctcgcggagatcctgccgaactgcctcccgttcggcccctaccacctgctcctccccaaggacgacggcgtcgacaccgccgacccgcacggctgcctggcctggctggaccgccaccccgcgcgcggcgtcgcgtacgtgagcttcggcacggtggcgtccccgcggcccgacgagctccgcgagctggcggccgggctggagtcctcgggctcgccgttcctgtggtcgctgcgcgaggactcgtggccgctcctcccgccggggttcctggaccgcatcgccagcgccgggtccgggctcgtggtgccctgggcgccgcaggtggccgtgctgcgccacccttccgtgggcgcgttcgtgacgcacgccgggtgggcgtcggtgctggagggcgtgtccagcggggtacccatggcgtgccgcccgttcttcggcgaccagcggatgaacgcgcggtccgtggcgcacgtgtgggggttcggcgccgcgttcgaggcgggcatgacgcgcgacggggtggccgccgccgtggaggagctgctgcgcggggaggaaggcgcgcggatgagggccagggcgcaggagctgcaggccgcggtggccgacgcgttcggccccggcggcgcgtgcaggaagaacttcgacaagttcgtccagatagtttgtcgcgcgtgaatgtcgtcgtcttgctgttagatacccctacccattcgttcagaggtttcagtgttttaccaaaagaagaatggactacttccgctctccttgtgaaatgaacatttgaggtcttgtttagttggttaattttttttt

SEQ ID NO: 186 - DNA, 12545 bp, Sorghum bicolor
tgcctgcaggtcgacatccccaatcacatgctagttcacaaatggcttcatcacagcatgctagttcacaaatggcttcatcgcagcatgttgagatggaggccgcaaaacttctacataaacttattcaggagtcgaaggatgagcctgctaaactagcaacaaaactttacgtgatatgtcagcatatgaaactaagtggaaaggagcagtcactgccatatcaagtcatatcgagggctatggagacagttgtgaaccaacatggaattgatatggatgcattgcgatcatcgcgaattccatttgctggtggtcctcaggcaggggattctagtggtgccatgtcaaaggacaaggaggtcattggtaaccagtctccgatggttggaagtgatgcatcccaaactagtggacaagctggactgtggcagcttccatcaggttcaactgatatgacaaggcatgggacatctatttcgggtaggctacctacagggccaaataggggagatttctcagcagctgaaattcatcaagcctccatgtcacaaaagagcggtagatcctctggcattgaaagccctgcaagcctgcagatggaggataccagatctatgaattcacacgattctttgaaatctgatgagaaaacaagcaagaaaacctcttccaagagaaaaaggatggattcaaaaggagctggggatttgcattctgaagacaactcaaagtcagatgctatgtccactggaccgaataccagaaaggggaaacaggttggtaaggctggtagacaaggtcaaccttccatgggaattgagcatgagcaaccgcatatactgcaaggtggtactgctcaggtgccaccgatacatggtggtgcaccttttctcaggactcacccagaaggtccttctgggaggacaatggacaagacgaaaccatcaaatccattctcaatggctcaaattccaagttttcctgaaggactggcttctagtggtgccaccatcgagttgcaaaaaagtatacagggtggagcaaatttatttaatcctagttttggttggaaccaaaacccacaagttccaaccttgaagaattctcaaggttctattcccaatttagtgaggtctggagttactatcgaaggcaaaattaatgtaggggcacaaggagcttttaactctacctcggcaccacaaatggaatttcccacaattcctccttacaacccctcttcctttggagttagctcacagtttctggacaaaggcaaggagttggcttccagcagtactggcgctgaacttcattccacgtctaaagttgcatctcagcctggaattcctcatggaagtcccatgcaagaaaggcaaggtattatcagggtgccacagagagctgatccatcttcacttccgagcagaagtaccgggccaagtccaatgtctcacacttcttccaacacaccatttaaagaacaacagctgaagcagctcagagcacagtgcttagtatttcttgcatttaggaataatttgcagcccaggagggtacatcttgaaattgctttgggcagagggcctcctgcagaaagtgacagtgcaggtcagaggggcagcgagggcagagtgtctgatgctttgggaaaggaaaatggtagcagtcgggagaattctggtgtcttttgtaggcaaactgatatctctagacttccatccacatctgcaggaagtattgcagaggttgattccttactgaaggacccagaaaatgctacaaaaaagatcaaggttgctgaacaggagaagtcattgatggaagtagaaaatatccagcaagcttcagctagttctggaatgcgttcccaagaaactgcatctcaaaatccatctgggccacaacagtcatactttcagggagatacaagaagaattgcctctgatatccataggactgatgctgaaaatttgagccggaatttaagttggggaggccagggatctactgttttgggtggtactagacagcatctgaatcaggaaactaaagaatcacttccaccttcaaagtcacaccatatgcctggtgatggtttcaactccaatataccaggaatagatcggactccagagacagccggagctggtaatgatgttgaaaattgtagccatgttgtggatattgtgcctgagcaggctgctgatgatggagatgaggaccttccagagcatgaggatttattgtcatctcctccaaagcacacaatgacagaaaaatggatcttggattaccagaagagaatttacaatgagagacaaaagagggcatcggagcagcataaattacacagcagaatgtcagcatcatatgagaagctaaaggagagtgtcaattcttctgaagatctttccgcaaagacaaagagtgtcattgaattgaaaaagcttcagcttctgccacttcaacgtcgtgtacgcagtgaatttttgctggactttttcaagcctaatacaaccgacttagagcgcataaaatcactgaagaaacataggcatggccggcgggtgaaacagcttgaaaaaattgaacagaaaatgaaggaagaaaggcaaaagagaattcgtgagagacagaaggagttctttgctgatatagaggctcacagagagaaacttgaggataacttcaaggctaagagagagcgcttgaagggattcaatcgatatgcaaaagaatttcacaaaaggaaagaaagaattcatcgggagaaactggataggatccaacgggagaaaatcaatctgcttaagaacaatgatgttgagggttatcttagaatggtccaggatgcaaaatctgaccgtgtcaagcaactattgcgtgaaactgagaaatatctacagaaacttgggaataaattacagaatgcaaagtccacagatggccgctcatcttttgttactgataagagtgacgctgcaaacgacattgaagatgagagctaccagccacagcattatctggaaagtaatgagaagtactatcaactggcacacagtgtgaaggaaactgtaaatgatcagccgtcttatcttcagggtggcaaattgcgagagtaccagatgaacggtttgcgttggctggtttcattgtacaataataatttgaatggtattttagcagatgagatgggtcttggtaaaacagtgcaagtaatctctttgttatgctaccttatggaaacaaaaaatgaccgtggaccttttctcgtggttgtaccatcgtctgttcttcctggatgggaatctgaactcagcttctgggcacctagtataaataaaattgcttattctggtcctccagaagaaaggcgcaagatgttcaaagagatgatcgttcatcagaagttcaatgttcttttgacaacatacgagtacttgatgaacaagcatgataggccaaaactaagcaaaatacaatggcactatataataattgatgaagggcaccgtattaaaaatgcttcttgtaagcttaatgctgatttgaagctttatcggagctctcatcggctattattgacaggaacacctcttcagaataatcttgaggagctgtgggcacttttgaattttctattgcccaatatatttaattcatcagaggacttctctcagtggtttaacaaaccatttgaaagtaatggtgataattcacctgatgaggccttactttcggaggaggaaaacttgctgatcataaatcgtcttcaccaggttcttcggccctttgtactccgaagacttaagcataaggtcgaaaatgagctgcctgagaaaattgaaagacttgtgagatgtgagccatctgcttatcagaaacttctcatgacaagggtggaagaaaatcttggtgggattggagccgttaaggttcgctctgtgcacaactctgtcatggaattgaggaacatatgcaaccatccttacctgagccagcttcatgttgaagagattgagggctatctgcctaaacatttcctgccatctattgtgaggctctgcggaaaacttgagatgttggacagattgctgcccaaactcaaagcaactggccatagggttctacttttttctacaatgacaagattgcttgatgtaatggaggattacctggtttggaaaaagtataaataccttcgattggatgggcacacttctggtcaggaaagaggagctcttatcgataaatttaatgatcctaattctcaagcattcatttttcttcttagtatacgagctggaggtgttggggtcaatcttcaagcagccgatacagttatcatatttgatactgattggaatcctcaggttgacctgcaagcacaggctagggcccacaggattggtcaaaagaaggaggttcttgttttacgtttagaaacggtccgaactgttgaagaacaagtcagggcttcagcagaacacaaattaggtgttgctaatcagagtataacagcgggtttttttgacaataacacaagtgctgaagatcgaagagagtatcttgaatcactcctacgtgagtgtaagaaggaagaagcagctccagtgttagacgacgatgctctgaatgatattctagctcggagtgaagctgagattgacatatttgagtctattgacaagcaaaggagagaagaagaaatggcaatttggcaaaaggtggttcaggatggttcaactagtgggctagaccctgcagtattgccttctcgtcttgtgactgatgatgatctcaagcccttctgccatgctatgaaactttacgagccatcatcaaatgtgaaaacagtaaaggtgaatgtgaggaagaagggtgaacttggggggcttgatacacaacattatggaaggggtaaacgagctcgtgaggttcgctcttatgaggaccaatggactgaagaagaatttgaaaaactttgtcaagttgattctcctgaatcaccccaacctggtggcatgtcaaaggatttggatattcctaataaaggcattaagactgaaattgctgtggagagttcaaaagaaccagaacaaatgaggatggaggcatccccaactgttggggactccccaccagccaaacgacggagaggcagacctaaaaggtcagatgttttcttatctcctactgcagatctgactgatgctgtcaaacaagacacaggaaccacacaggatggtagtttggccacaccagcaagtaccttccattctgatacaccagctactccaatccattctgctgcttcagatgttaatatacattctatttcaccagctgatatcaagaaacaagagttcagtactgatactaagccttccagttctgtctctgttttggaaggatccacggcgaatgaaattggtacaccattacagagtgttcataatgtagcagctcctgcaccaccgcatcaatcagctagggggagaaaatcccaagcaggagaaacacctcgcaggcgaggccgaaaaccaaaatctctatcttcatctggtgtagatgatgttagtcttaacccaactgtttcaactggtagtggggtagcagacactagttatgtttcttcatattctcatgtgaatatgccctcatcacaaggcactgctgtggcactggcaggaatccagaaggatttggtcacagttaaattggatacattgttgccagatagtggtaagaatatttctcctgttaatgaagataaaggtgctactgttacaacacctgtggcaaaagatatctgtgctggaactgtgacaacatcagacaacactatcaccctgacaccgaatactcttaaggaaaacattggattagttcaagtagcatctgcacctactatgcctatgcctgtggcttcagaagaattattgaaaacagcagcacatgttgtggtggcagataagcctgttgagaagcaaactgcttcacgtcgccgcagaaagaaaacatctagtagcgaggatactggagtcagcactagacaaagatcagctatgaaaaaatcttattacagtacttctgttgccattgatgaagttggttctgccatgaccccaaatgagaaatcaggtatagagaaggaaagagatgtcagttcaattcaagatactcccaatcagctgccaaatattaactcaccactgtatgagaagtctggatatgattctcaaccaagcacacctatagctgtccccatcaatgaagctactcttcctagtggctttgatacccgcactactcattctaagataactctagcaacatctgccaatcctgctgatcatgataaaccggttgatttgcaccttaatgcgcctgtttcggttgattcccaaaatcatgaacaactcaagacaggaaaggaccatttggcagtgagttctggaatcttttctactcaattgcaaacagttactgcaaatcctactagtgataataaaccaggaactacccagtttgaaccatctgcttcctctgttcagaattcaggtaaggatgccactgcactgacttcttctgaggttgacagtgctgctccaaataaggcaccaagcaggaggaggaaagggtcaacgcgggaaccacgcaccagaagaacttctgcagcagctgcaagtgaacgccgtgcccgacttactggatcgaagcaggcagaggacacaaagaagttaaagatgtctgcaacgccaactacaacagtgtgtgttttagcggtagagcaacagggagctgcctctttaagagctgaggttaccaatgcttctgtttgtgaagagcagaagaatcctgggagtcacgtgtcttctgacatttcaattcctgtggggagtcatgtgctgggcgcaataagtactgaagaaacaactgccactgtgataactcagactcctgcagtggctaaatcagaagaaagaaaacttccagtaggggatcaacaaggtattcagtttgatagtacagtaccacaaacgaagatggtatcaaatgatgaaagcatgcaaggtactgaagttaataattcggaacagacaaaaatagtttctgctgctgaaccagcacctgcaaatgatgaacacatgcaaggtactgaagttagtaattcggaacaaacaaaaatggtttctgctgctgaaccagcacctgcaaatgatgaacacacgcaagctatagaggttggtagttcagagcaaccaacaagtatggtttcagctgtggaatcagcaccttcaaatgatgaagaacacacaacgcatgaagtgtatcttgagactgctgctgatgatatgcttacctctagtgcagcaacagatatattgcgggatacagttgagcatgcagctcgccaggccaatgcagcatgtacagatggaaccacaaggcagtctgaagcatcacaacttgatagcaaagcctctcatgatgcctcgtataaagacactactactactgtctccaccaaagatgatagcaaagcctctcgcgatgcttcttacatcttgcccagtgaaggcactgctgttgatgttactggttctaagcaagatgatgtgaacattgttggcacacaaactgctgatgcttccaggggttcttctagtcattttcaagctactttacaatcaactgagtcagattggcatccaggtcaagaggagaatttggagagtaggaaggagcaggtgaaaacggaagaagctttggataacagttctggtggcaatcaaactcacagtttgggcgatgaaccttctcatgatacatcattagcaagaaattctcctttggaatactcgaatgagcgttgttctgctcaagtaattggtgaaactttcaaaagtaaagaaaatattgttgaagtccattctgccatgaatactgatggccctgatgaagctctggatgcattgtatgtccaatctaaggaggccagcataacagatagtggtgtagctaccgatgttgataaatttgaaggtaaagagactagtgtcgaggtccgtgatgacatgaatactgatgggcctgaggatgctcaggatgctttgtccacccaatctgataaagaggccagcatggtagaatttggtgtgtctaacgatggtagtcccacagtttgcaaagcacacaatgatctcgagggtcatgtatcttgtgaagataggactggtggtgatatccataccaatgcaaattatggttctaataataaaagtgaggacaccattgttaatcctgttaaaaccacacgagaaccgttggaagaaagcaccgttattgtatcagagaattctgatttgaataagcaaagccacacattgcatactggaaatgatcctcctgcaagtaccctgttgatagttgagtctaacaaagttacttgtgatgctgaaattgtttgtgctagcagattagagtcttcttgtattgaggctgaaacagtggctatccaagagtcagctgttactgattttgagggaacaaaaggaactggggatttgggtcacaaaactggcagtccgctgtgtgatgatgttcatgatacatcatgttctgtgattggtcttgtgtgtgagaaagaacctactgaagatcttactgatggtagccattcagaagcacctaatttacttgctgctgtagtacaaactcgagaaactactgttgcaaaccaagaggaaatcatagatgcagtagtgtttattgatgcctgcaaggcagaacctgatggtgattgtactgttgctaaaggagctgaagagactgtagaaatggttcattctgttgaaaagcaatctgctgtattagaacatgttgagagacagacgaaacaaactacgatttgtggttctgtgctaaatgagtcccctcaggctgcagggttggaagaggactgctctgtactgaagcatggcggtcctactgcctcatctgagcttcttgctgtagcacccaatccaatcagtgaaacttctgttattcaagccgaaccagaggcaacaaactcggatggatactgcacaacagaggttggcagtgctttatctgaaactgtcaggggactggagccaaataaagaaactgctgttccaatgcaagaggatattgaagaagctaatgatacttctaataattgtgaagcacacaataattcggggattcatgcatttggtgaagtgttgatggaaatgcagtcatcagaggtcaaggaagtatcttttattcagtctggtgcagcaaatttgagcacacagactcctgtactgcctgatgaaacaggacaaaccaatgtggcttcgactgcagaactagtacctacaaatgatgatgaacacatgcaaggcactgatgttaattctgagcaacaaacaaagatggtttcacctgctgaatcagcacctggtaatgatgaacacatgcaagacatcacggttctaagttcagaactgcaaacaaagatggtttcagctgcagagattgatgcattatgtgtccaggagactgcaattgttgatcttgggggaactagaggaacagttgatctgaatgacattagtacacaggttcctgcattacctggaagtgatgtgctaggtgtggaggcacataattcagaaccaaaaaaagcatcctcaccaggtgatgaaattattagttcagaacaacaagcagaaattgaaacgattgcagagacagaaacagtgagcgttaaggagaatgccattgctgatcatgaggaaacaggtgaccagagtggcgtaagtatacatgctcctctattagctgaatctggagaaaagggatcacatggagttgaattgtgtggtattgagattgaggctaataattcggaacaaggaaagatggtttcaactgtggaagcagcctctacaccagacgatctagggcgtcacacacatgaagtgcatgtaactggtgatggtgctatattatctagtgcggaacaggacacattgcaagataacataagcagtggtgctgatgtggacctaacaaccagccaaaggaaaacagactctgaaggtatcaaggatccttctattgggactaacatagaggagatccaaggcccttatgaaacctcgaacaaggaccattttactgatcctcctgcgactaccctggtgatagctgaatctgataaggatacctgtgatgcagaagttgtttgtgctggcaagttagaatcttctggtgctgatgctgttggaacggttgctgtccaggaggttcctgctgttgctggcgatagagcaggagggataggtgttgaaggtcattgttcagaacaagtaaagatggcttcggttgcagaagcagcgtctagcctggctttagtaggatattcttcttcagaagactcaatggtggatgctgctgcccgagtagctgatggtgattttgcggatagtaaaggggctggtgttgattgccaagaaactatgcctactcaagccacctctaccctcccagagaacatggattggcagaatgattctcttgcagctgctgcggtgacggttgaaccaatgtttgcttcctcatctgagcacgctgcagaatccaagccaattgatgaaacttctgttatgcaagtggaactggcaaccagtacaggggatgaatgtgcagcagagggtgacaatgttgtttcatctgaaactgttgtggaatcagagcctgttcaagaaactgttgttcctagtcaaggaggtagcatagaagctaataatacttctaccatcagcgaagtaaacaaagataccgagtctcgtgcatctggtgaagtatgcaaagatgctcagtctcatggcggtgaatcttacactgaactgcaattggcaccttcctctggtgaggaggccatgatattgtgtagtgagctgcccagccaggaggtgaaggaggctccaagcagtgaacctttggggtataatgaaaatgtgaaaacagaaaatgattcttcttctcaagaaccagtcaatgaggaatctgctcctggtgctgaaaatgcaaagattgatgaagctgacacagaacagcaactgcctcctgggcagcaggtgaaggaggctccaagcaaccctttggggaataatgaaaatgtgaaaatggaaaatgaagcttctgctcagggaccagtaaatgaggaatctgctcctcgtgctgaaaatgtaaagattgatgaagctgacacagaacaactgcctccatctggtgaggccatggtagacatatctagcgagctactcagccatgacgaaaaggtggctccaagcacagtccctttaggaaatgatgaagatgcacatatggaagaggcttctgctgcacagagagagctaagcactgaagttgctcatggtagtgaaaatgcgaaacttagtgaagctggcacgtctggtgaggccatggtagacgtatctagcgagctactcagccaagatgaaaaggtggctccaagcactggccctctaggaaatgatgaagatgcacagatggaagaggctgctgctgcacagagagagctaagcactgaagttgatcatggtagtgaaaatgtgaaacttggtgaagctggcacggagctgcagttgccaccaccttcatctggtgaggcactggtagacatatctagggagcaactcagccaagaggtgcaggaggttgcaagctctgggccctcaggaactgatgaaaatactgagatggaacggctaaacaccaaacattcacctggtggtgaaacctcaaaacttgttggagctgatccgggaatacaattgccaccgtctggtgaggctgtggtagatatatctaatgagccacccagctgccaagaggtaaaggaggccccgagcagtgacagtttgggaaatgatgaaaattcagacaccgagaagactgctgctgccttacagggacggctaaacaccgagcttgctcctagtggcgaaaatacagaatctaatgaagctgacactgggaaacaagagacacccgtgtctgctgatgctatggtagaatcatccagcgagcctcccagcgatgaggcaaaggaagctccaaccactgacctgtctggggatgatgaaaaagcaaagtcggcaagggctgctgttgttgcggaactttttggagatgcaacagaaggtggttcggatcagccattgccgtctccaagagaacaaggcaaggaagcagaggctgatggtgacttgtagagtaaattatgcaaatattgtattaagagctactagaatctgtgtaagtaagaaatgatattagtgctttagttgtaactgttggaagcttttactcagaatcaaaagcaacgtgctgaggtaccattgagctcaaattcactggccgtcgttttacaacgtcgtgactgggaaaaccctggcgttacccaacttaatcgccttgcagcacatccccctttc

SEQ ID NO: 187 - DNA, 2091 bp, Sorghum bicolor
attccattccacctgtactgtaccccgccaccaccacccacggccacgctgcccgcccaagcaaacgaaacgaaagagcgcggccgaccgaccgaccagagctgatcgaccgaccgatcgcctccctcttgctcagttggtccccatggggcggcggctgagcgcctccaccgcggcggtggcgtcggcggagccgctgctcccgcgggcgctgaagcgcggggtgctactcgagcggtgcgcgtcgcgcgccgacgacgagctgcagtggttccgctcctgcctgcggtgggtgtgcatggaccactcgtcgggcccagcgcaggccgcgctctcctggctcctcttcctcgtcctcgccatcatcgtcccggccgccgcgcacttcctcctcgccttccgggcctcccgccggcccttctccgccgtcgtgcagctctcgctctcggccgcctcggcggcggggttcctctgcctctcctcctccttccgccgcgtcgggctccgccgcctgctccacctcgacaagctccggggcaagagcgaccgcgtcaggctcaactacaccgcgcgcctcgccttctccttccgcctcctggcctccctcgtcgcgccctgcttcgccgccgaggccgcctacaaggcctggtggtacgccacctccgccgaccgcgtccccttcttcgccaacgacgtcctcagcgacgtcctcgcgtgctccctcgagatggcgtcttggatgtaccgcagcgccgtctacctcctcacctgcgtcctcttccggctcatctgccacctccaggggctcaggctcgaggacttcgccggatcgctgctcgaggaggtcgaggaaggacgggctggggtggagaccgtgctcagagagcacctcgacatccgcaagcagctcaaggtcatcagccatcgcttccgcaagttcatcgtcgctgctctgctcatcgccaccgccagccagttcgcatccgtgcttctcaccacgcgacgcgactccgtcgacgacctcctcaacaccggcgagctcgcgctatgttcagttgtgctcatgtccgggctcatcataatcctgagcagcgccgccaagatcacccaccaggcgcaggccctcaccggccacaccaccaagtggcacgcctgttgcaccatcgagcccgtcctggaggacggggagcccgggtccaaccagaactccatgatcgagcaagaacccgagagcgacagcgacacagagtacagcgaggagaccggcgacgaagatctcctggagaacaccaagattcatatgccgcatgcgcatgtcatctccttccaaaagaggcaggcacttgtgacatacttggagaacaacagagccgggatcaccgtgttcgggttcacgctggaccggtcgtacctgcataccatcttcatgctcgagtggacgctgttcctgtggctgctcggtaagaccatcggcttctcgtgaaaaaaaaaaagaaagacaatgtaaaaggagaggtgtgtcctgtgtccaacgtccgggactccgggtggtcgtttctgagagttgacgcatgtcgtggttgccttttttggggatggatttggatgtgctttgtctttcggccatttgtagaagggggttaggggggaggctttttcgcgtgaaccgggctgctggcacgggagcgttcagcttgagcatgtacgcctcaacgcctgtgcatgatagcgattttgtatgacgtgtgtaaattgtgatctgtgaatctgtgattgcccgtgtcaacagcccttttgtaactgtgtgttgtacagtctcgttagtgggcgtgcatataggctccgtgtgcgtcatacagcgtggtgtactggtattgcaggttttcgtaacctcttgttgtaagccaacaacatgctgtagagagaattttatacatttgtaaaggttcttggtttcttttttctttatctttgggagttatgaaattagttcaagatttgctagtctcgtatattttctcttgagtaaaattcagaaccggtctctgtataattggcaagaggtgttatatgagtctatctatatactct

SEQ ID NO: 188 - DNA, 987 bp, Sorghum bicolor
aaatccagaagcacccctcctccggcagctcatttgctccgtcgtgtgcgtcaatcaaagacgccatttccttcgtgctccttcctgttcattcctttccttgaaacccttttccccgtaaagctctccgctgcgcgtacttcgaatggccgtcggaggaggcgtgtgcgtggcgtcgccctcgtcctcgccgtcgtcgtcggttgaggcgccgtgggggacgaggaggacgaggacgacgacgacgacgagcggggcgcgacgcggcgccgcggcggcggcgaccagcgtcaggtgcagcatcgtgggcgaggccggcgggccgggcgcctccggcagactggcggaggacccttaccggacgctgcggctgcgcccgggcgccacccgcggcgaggtcaagaaggccttccgccgcctcgcgctcatgtaccatccggacgttcgcaaggagaagggaagggaaagcgacggcgtcagcgacgtccaattccagaggattaacgtggcgtatcagatggtgatgagcagcatgagggaggccgacgagcggctggagtactggcggctcaagtacggcctcaccgacgaggatctcgacaggtacaggcaccacctcaaccaagaacacggtgacgacgactggttcgacatgtgaagcagccaatcggtagacaaggattttatgtacataataaccctgtttatccgcattgacccgattaaattcttgttgccattgcggaggcaccaacggtaatttggtcggcgttgtgtatattgaatacctctccccatgttttatagcgggtgaagggatacagttagactaaaagtgtagtgtcatttgtgtttcagaaacatgggagaaaccccacttcttgtttatatactgtacaaagatttagttgatcttaatcatgtctgcaagtgctatgttcatgcttggcgatttttatgaacctgtatggctgtattgttttgtgt

SEQ ID NO: 189 - DNA, 1673 bp, Sorghum bicolor
atgcaccacaccaccaactagctataacgaacaagatcgtactccgtgcacacgtgagtgacacgcctctgcctctgccgtgcacgtgtgctcgcatttccatcagtcgtcgcgctctccgatagatggcgtcgtcactgcctccgttcacggtgcgccgcggggagccggtgctggtgcggccgtcggcgccgacgccacgggagacgaagccgctgtcggacatcgacgacgccgagggcatgcggttctacagctccggcatccacctgtaccgcgccaacccatccaaggccagccaggacccggccagggtcgtccgcgaggcgctggccacggcgctcgtcccgtactacccgctcgccggccgcctccgcgaggagccagggaggaagctcgtcgtcgactgcgccgcgcagggcgtcctgttcgccgaggccgacgctgacctcaccgccgacgacttcggggacgtcaagtgcccgccgttcccgtgcttcgagcggttcatcctcgagagcaccaccgtcgccggcgtcgagcccgtcgtcgaccgccccttgttgtacgtccaggtgacgaggctcaagtgcggaggcttcatcttcgggcagcggatctgccactgcgtggtggacgcgccgggcgccatgcagttcgagaaggccatctgcgagttcgcgcgcggcgccaccgaggcgccgtcggtgacgccggcgtggggcagggagatgttcatggcgcgtcagccgccgcggccgtcgtacccgcacctcgagtaccgcgagccggcgtgcggggccgagcccgacaggatgatgacgactcccccgggcgacatggcgcgtgtgcctttcttcttcgggccccgggagatcgcggggctgcgccagcgcgcgccgcccggcatgcgctgctcccggttcgagctcgtcgccgcgtgcatctggcgcagccgagcggcggcgctcgagtacgcgccggaagaggaggttcgcctgtccttcatcgtgaacgcgcgcggtcggcgcgagatcccgctccccgagggcttctacgggaacgccttcgcctactccgtcgcggcgatcaccgccggggagctctgcggcggggacctcgggttcgcgctggacctagtgaagaaggccaagtcggcggtgacctacgactacctggtgtcggtggcggacctgatggtgctcacgggccggccgctgttcgcgctgtccaggacgtacatcgtgtcggacgtcagccacgccgggttcaagagcgtcgacttcggctggggcgaggccgtctacggcgggccggcgaaaggcggcgaagggccgcttcccggcgtcaccaactacttctcacgggccaagaacggcaagggggaggagtgcatcgtcgtgcccatctgcctgcccaaggacgccatggagaagtttctgctcgaggtggaaggcctcactgcggagctctaggcttctcgatggggtgccttcgttccggtgtgtgtgcatggcattggcataatagcctacgcacaactaagttgatgttgatcttcttttttcgagaacgtgtccgttgacacgttttttcattatcatcattttattcaattctatgtatatttatcatcatcattttattcaattctatggagacaatgcaagcaa

SEQ ID NO: 190 - DNA, 1206 bp, Helianthus annuus
aaaaaaatcagtagaagaaactaaaacaaatggctagagttccaagagtgaaactgggttcacagggtttagaggtctcagctcagggtttaggctgcatgagcatgtccgctttctacggacctcccaaacctgaacctgacatgatcaatctcatccaccacgccgttaactccggtgttacctttctcgacacctccgattactacggccccaaaaccaacgaaatccttcttggcaaggctttgaaaggggggatgagggacaaagtggagctcgctaccaaatatgggatcaaactcagcggttcgtgggaggtaaaaggcgatcccgcctacgttagggctgcttgtgaagctagcctcaagcgacttgacgtcgattgcattgatctctattatcagcacaggatagacacccgtgtgcccattgaaatcacgatgggtgaactaaagaagctggtggaagaaggaaaaattaaatatgtcggattatccgaggcatcagcatcgaccatcagaagagctcatagtgtccatccaataactgccatacaactagaatggtccttgtggtcaagggatgttgaagaagatattatacctacttgcagagaacttgggatagggattgttgcatatagtcctctaggacgagggtttttcgcatctggttcaaagatgatggagaagctcgaagatggtgactatcgtccgaactttccgaggttccaacctgaaaatcttgaacacaacaagatcctgtatgagagggttagtgaaattgcgtcaaagaaggggtgcacaacttcacaactagcattggcctgggttcaccaccagggaaatgatgttgtgcctattccaggaaccaccaagatagaaaatcttgaacaaaatattggagctttatctgttaagataacgccagaagagatggctgaacttgaatccacaactcatttagtaaagggggctcgatgtaatgccggtactccaacatatctagactctgaaactcttccattgtcatcatggaaatcttaatttatcaatgatatgagtcttttgtttatcctgtgttgctatacccaacatatcatattcaatttccagtaacgtgcttaagtttttaaaacttggttatactttatctacatatggtttcatgatgtatgtaactcgaagaagatgaaataaaaggttg

SEQ ID NO: 191 - DNA, 663 bp, Helianthus annuus
acttcaaaagtctctcttaatttcctcaacatttcactccacctgcttccatatctccatcaacatgcctgaaagcaagaaagttgttatcaaagtggatatccatgacaatgaatgcaaaaggaaggctttaaaggcggtttcgggtctttcagggatcgagtccgtagctatggacaacgacaacaaaatgactatcgttggaggcgttgatcccgtatgtgttgtcaagaaacttaaaaagtggcacgccgttatacttaacgttggacccgcgaaagaagataagaagaaagaaccagagaagaagaaggaaaatgaagatgatgcggcgaagaagaagaaggaggaggaagaagaagctattaaaagatggatagaatttcatagttataggggattcactccgttaccaccacaacgaatatgtcttcatcctgtagaagatcccaatggttgtgttataatgtaaagaaaatatgcattaggtgcatgtatacggggttgactttggatgggtgattattattattaccgttttggaaaagataaattgataaaggatttgtagagagtattaaacaatcccctagtgtgatgtagtttctagtcttgtgataaactttcataatataaatataagagtgaattacaagttttgct

SEQ ID NO: 192 - DNA, 737 bp, Helianthus annuus
ctttttcatccaaataaatccgccattcaaacaccactttcctcatcatcctgttatacaacaactacatctcaattgttaatccaaattcttcaatcgctttctacaacaatcgaaatggaattcagtctgatgggattagacactccgttcttccgcaacctccaacacatcctcgaatccaccgatgacaacacaaccggcaacaagtccaacaacggcggtccatctcgggcttacgtccgcgatgcaagggcaatggcggcaacccctgctgacgtcaaggagtatcctaactcctacgcgtttattgtggatatgccggggctgaagtcgggggatataaaggtgcaggtggaagacgacaacgttctggtgataagcggagagaggaaccgagaggaagagaaggaaggagcgaagtatgtgaggatggagaggaggattgggaagttcatgaggaagtttgcattgccagagaatgcgaatacggataagatatcggccgtttgtcaggacggagtgcttacggtgactgtggagaagctgcctccgcctgagccgaagaagccgaagacgatccaggtgcaggtggcttgaagaatgcgtatgcggtagtatcggatgtttgatctgtaatgggaatgttatgagtgatggggtttaaagaatgttagtggatatatggtttgttgtttggctctgtttgctaccataatcgacgtgctgtttgttta

SEQ ID NO: 193 - DNA, 512 bp, Helianthus annuus
cgcggggacactagaacaaacaaacagctttgatactttccataacttaaaactccgagatctcgatcactccttcaagaaacgatgtcgtcttcttgctgtggtggaaactgcggttgcggctctggttgcaagtgcggtaacggctgtggtgggtgcaagatgtaccaagaaatggtctccggtgagagtactaacaatgagacacttattcttggtgttgcacctactgaaactggaatagagaccaccggaggcgtggcaacagcggctgagaacgaaggatgcaaatgcaacccttgcacatgtaatccatgcacctgcaaatgagttatgggcatgccaactatggagtgtcatcggtcatatgtaactcaactaaaactagctaaacatccttggataccatgactatggagtttcatcagttatgaagtttcatcaatcatggcagtgtcttgtttttatctttttgaactttgtttttgtgtaataacaataaaagcaaggga

SEQ ID NO: 194 - DNA, 614 bp, Helianthus annuus
atcttcttctcgtcggcgaaaatgcagatcttcgtgaaaaccctaacgggtaagacgatcacgttggaggtcgaatcctccgacacgatcgacaacgtgaaggcaaagatccaggacaaggaaggcattccaccggaccagcaacggctaattttcgccggaaaacagctcgaagacggcagaaccctagcggattacaacatccagaaggagtcgactctgcatctggtgttgcggcttcgtggtggggcgaagaagaggaagaagaagacgtacacgaagccgaagaagattaagcacaagcataagaaggtgaagttgagtgtgttgcagttttataaggtggatgatgctggaaaggtgcagaggttgaggaaagagtgtccgaatgctgagtgtggggcggggactttcatggcgaatcattttgatcggcattattgtggtaagtgtgggctcacctatgtttaccagaaggcttgaggttatgtttctttaagttttgttatgtgtttttgtcaaactgttgttgaattggatactttttatgttttgatttagtgatacattttgatctattggctatttagatagttgtggttgctggttttgat

SEQ ID NO: 195 - DNA, 1615 bp, Solanum lycopersicum
gtatcatcaatattttctacattcttctctattataataatttatttactatacatacactacaaaaatatttttattttcaaacgaaaaaaatggcaaaatcatttgaaaatgaacatccaattaaggcatttggatgggcaactagagacacttctggagttctttctcctttcaatttttcaagaagagtgacaggtgaaaaagatgtgcaatttaaagttatgtattgtggaatttgtcattctgatcttcatcaactcaagaatgaatggggaaatagcaagtaccccatggtgcctgggcatgaggttgttggtgttgtcactgaggttggaagcaaggtggagaagtttaaggttggagacaaagtaggtgttggatgtatggtaggatcatgtcgaaaatgtgagaattgtagcgttgatctcgagaattactgtcctcgtcagattcctacttacaacggctatagcttagacggaaccctcacgtttggaggttactccgatgtgatggtatccgatgagcattttgtagtacgttggcctgaaaacttgtcgatggacgctgctcccctgttatgtgctggaattacgacttatagtcctttgaaatattttggactcgataagcctggaatgcacattggtgttgttggtcttggagggcttggacatatggctgttaagtttgctaaggcattcggaaccaaagtgactgtcatcagtacatctgctaataagaagaaagaagcaattgagcgtttgggtgcagactctttcttgatcagtcgcgatcctgagcagatgaaggctgcaatgaacacattggatgggattatcgacactgtatctgtcgtgcaccctattcttccattacttatgttgatgaaatctcatggtaagcttgttatggttggtgcaccagaaaaaccggtggagttgcccgtgtttcctctacttatgggaaggaagctagtggctggaagttgcataggagggatgaaagagactcaagaaatgttggactttgcggcaaagcataacataacaccagatattgaagtggtgccaatggagtacgttaacaccgcgttggaacgtcttttgaaatcggacgtgaaatatcgttttgtgctagacattggtaatacattgaacaagaaatgagaatagggaggggatcaattatgtagctagcagtgtttcctccatcatctatttatactgcagtaactgagatttagtgaataccttacagaataacaaccctttgcctttactctattaactaagtgaaatccgtatatctctgatacatcttttcacatgaaaatcatacaacaaagtcaaattctgaacttagtactcaagaagacagcttgcactaatgaattatgacggaacaccaagatatgatgcaagttgcaagatgacactgtactttttcctcaaaaaaatgacacagagtactccacaagctgtcactttgattttaaaaaatacatctatttcttttctttccaacttgtttatctcataaaatgttgttttgcaagtaaaatgatgaacatcagtttctgatggatagcataagagagtaagttcttttg

SEQ ID NO: 196 - DNA, 1898 bp, Gossypium hirsutum
ccatgtgcatatgtgtgagatgcgactgctgcaaagctaaatgtaattgcaaggccggagatgccaattgcaccgacttgatcttagccatggtcatgcctcccattggagttctcagaaaaagaggacctaagagacggagagggagtatcgacggtgatggagatgcgagacatcgacgaccttccaaagaacgccgttaactacatggctttgacgccgttgtggttcttggaacgagccgccacggttcatcccaccagaaaagcggtgatccatggatctcgaacgtacacgtggctccaaacttaccagcgttgccgtcgcttggcttcagctctttccaaaagctccatcggcgttggtagctcggtagccataattgcaccaaacattcctgctttgtatgaagctcattttgggattccaatgtctggtgctgttgtaaacaccatcaatattcgcctaaatgcatcaaccattgctttccttttgggtcattcacaatccaccgtcgtcattgtggaccaagagtttttcaatttggcagaggatgctttgagaatcatgaaggagaaaagccaaggcaatttcacacctccgcttgttattgtcattgctgacgaaagctgcaacccggaaacacttaagtatgctttggggcaaggagccattgagtatgagaagttcttagaaagtggtgaccctgactttgcttggaagcctcctcaagatgagtggcaaagcattgctttgggctatacttccggcacgacagccagcccaaaaggggtggtattacatcaccgaggggcatatctaatggctttgagtaatcctattatatgggaaatgaatgaaggagctgtatatttatggactctgcccatgttccattgtaatggttggtgttttccttggacacttgcagctgtttgtggaactaacatatgcctccgacaggtaacagcgaagggcgtatactcggccatcgcgaagtacagggtgactcacttctgtgctgcacctgtggttctcaattccatagttaatgccccgcctgaggaaaccattctgcccctcccccatgttgttcgtgtaatgacagctggtgcagccccacctccttctgtccttgctggaatgtcccagaaaggtttccgagtcacccacacttacggtctctccgaaacctatggtccttctacagtgtgtgcatggaagcctgaatgggactccctaccacctgaaactcaagctcgtctaaatgcacgtcaaggtgtccgatacgttggtttagagtgcctagatgtcattagtactcaaactggtcagcccgtacctgctgatggaaaaaccattggagaaatagtgtttcgcggtaacattgtgatgaaaggctacttaaagaacccgaaagcaaatgaggaaacattcgcaaatggctggtttcactccggggatctgggtgtgaaaaatccagatggatacattgaaataaaagataggtcgaaggacataatcatatcgggaggcgaaaacatcagcagcgtggaagtggaaaacagtctctatttgcaccctgcagtaatggaggcatcggtggtggcaagggcggacgagcggtggggagagtcaccttgtgctttcgtgaccttgaagcctggggtggacaaatccgatgaacaacggttagctgaagacataatgaagttctgcaggtccaagatgcctgcatactgggttccaaaatcagtgatatttggtccactgccaaagacggccacaggtaagattcagaagcatgtgctaagagcgaaggcaaaagagttgggacccgtcaggatgagtaagttataacttggaagttccaaaactaaattattaggcatctaaat

SEQ ID NO: 197 - DNA, 1051 bp, Hordeum vulgare
gcggcggcggcggagatggcgcggtgcagcaacgggctgctgggcctgctgaacgcgggggtgctggtcctggccctggcggtgctgggcggcggaatctggctgagccaccgggcggccaccacggactgcgagcggttcctggagcggccggtcatcgcgctgggggcgctgctcctggcgctgtccctcgcggggctggcgggctccctctgcggcgcctcctgcctcctctggctctacctcgtcgcgctcttcatcctcatcgcgctcctcctcgtcttcaccgccttcgccttcgtcgtcaccaaccgcggcgccggctccgtcgtctccggccgcggctacaaggagtaccgcctcggggagtactccacctggctgcagcgccgggtcgaggactcggagaactgggccaggatccgcagctgcctccgcgacggcagcgtctgccagaggttcggcgccaggggggagtcgctccagcagttcgtcaccaacaacctctccccgatccagtctggatgctgcaagcccccaactgggtgcaacttcacttaccagagcgagaccatgtgggtcaaaccttctggcttcaacgctaccaatgaccctgactgcaacacgtggtcgaatgatcagagggccctctgctacgactgccagtcatgcaaggccggcgtgctcgcaaacctgaagaacgactggaagaagatcgccaccgtcaacatcgtattcctcatcttcctcatcatcgtctactctgttgggtgctgcgctttcaggaacaacaggcgggacaactcgtacccagcctggaagtgagtgagatgcctggcgaggcttaggtaattaggccggtgttcagcgttaacgactggctcattgtcctgtgttaagcgacgctatcatctgtctgtcctatagctctgatgatgtctgaaccgtcgatagttggtacatgcttgctgtgttgacctcaaatatatcaacatatggaggctcctattaccatgaatccatgatatgttcagatgctgcctgtgttctt

SEQ ID NO: 198 - DNA, 966 bp, Oryza sativa
ctcaaacacacttgtcaccttctctccccgcatcgcaacgataagcccgtgaacccgaccccgcgcgccacccgtccttcccacccccgagcgagctagagaggaagacgatgcagctcatggcggccaggaagcttctagagcagccgggcaccgccgcgccgccggtgctgggcggctccatcgccgacgacagggacatcgtcatcatcctcgcgtcgctcctctgcgcgctcatctgcgtgctcggcatcggcctcgtcgcgcgctgcgcgtgctcccgccgcggcggcggcggccccgacgcggccgccgccaacaagggcgtcaagaagtccgtgctccgcgcgatccccaccgtcgagtacgtctcccccggaggcggcggcaaggggaaggaggaggaggaggcggcggcggaggagggggagcagtccgagtgcgccatctgcctctccgacttcgagcacggcgacgccatgcgcgtgctcccccagtgcggccacgcgttccacgccgcctgcatcgacaagtggctgcgcgggcactcctcctgcccctcctgccgccggatcctcgtcctccagcttccccaaggcgagcggtgccagcgctgcggcgcgcggccagagccagccgccgcctccgcggtctggaagccgacacactacagcgaggtcccgcccttcttgccgtagaaggcgcagccgcatcgcgcgctccggagattccggggggctagagctagaagaggaacagagaaaccgaccaaaccataagcctgagatggttaaatttctcgtttgcttgctagattttagtgccctagctagctggaaatggatagcatttgggaaaaaattccgagtcagagatcctggtttgcaacttgcaagtggatggctgcagctttttcgctttgtacattttgtaaagtgatgagaataagatctgcaatttagctcc

SEQ ID NO: 199 - DNA, 1631 bp, Sorghum bicolor
cacacccaacacggtcgcacgactgtataattgtgctcgctcgccggccccagggacgtgacacatcgcacggccgaagcagctcggtgcttttgcctccgcctgccgtgccgcccgtgaggccggcagctttgcatgaggaggaggaggatgggggcactgcacgtcgtcggtgagcccagggtcgtcagcttccagcagcagcctgcagccgtcgtcgccaagaacggccacggccccgtcgtcgaggagatccacggcctgatccgcgtctacaaggacggacacgtcgagcgcctcccggcgatcccgaccgtgccctgcacgtggggcggcaccggagcggacgcgcctggtggcgtcgtcgcgagggacgtggtggtcgaccccgccacgggggtgtgggcgcgtctgtacgcgccgatgacgacgacgacgtccgcgggaggcggaaccggaggcagcaggccccccgtcgtggtgtacttccacggcggcgggttctgcgtcgggtccgcggcctggagctgctaccacgagttcctcgcgcagctctccgcgcgcgcgggctgcgccgtgatgtccgtggactaccgcctggcgcccgagcaccgcctgcccgccgcgttcgacgacggtctggccgccgtgcggtggctgcggcaccaggccagccgcgccgcggcgtgcgacgacctctcgtggtggcgggcccgctgcggctttgaccgcgtgttcctcatgggcgacagcgcgggcgccagcatcgccttccacgtcgccgcgaggctcgggcagggccacctcggcgcgctgtcccccttgaccgtcaggggcgccgtcctgatacagcctttcttcggcggcgaggcgcgcaccgtgtccgagaagagcatggcgcagccgccacggtcggcgctgacgctcgccacctccgactgctactggcggctggcgctgccggccggagccagcagccgcgaccacccctggtgcaacccgctgtcccgcgccgcgccgcgcctggagaccgtcccgctgccgccggtcctggtgtgcgtctcggagacggacatcctgcgggaccgcaacctggagctgtgcagggcgatgcgcaaggcgggcaagtgcgtggagcaggccatgtacggcggcgtcgggcacgcgttccaggtgctacacaactgccacctgtcccagccgcggacgcaggagatgctcgcgcacatcaaggccttcgtcagcgccaggtagcagccgccgccgccgccgtcgttcgtcttcgttggactggacccctagctagctaacacactcgccgtcgccgtgttaatcaatccaccatgcatccaccacctaatcctaatcctaatccaatcgaagagtagatgccgtgtaagcaaccagccttgtgcagtactgtattacgtatcacagtagtatgtgacttcgagtcagctacgacgtgtatttgcagcaaaaaagcgtccaatgcccagcccgggttgttgtagcggtgtcggaaagcaaaagcttatcactaccatatatatatgttatgtatgatgatctgctgttcatttcctctcttgtcaagaaaggctcaatgcctgatgctgtttttaagtcgg

SEQ ID NO: 200 - DNA, 2465 bp, Zea mays
ctagaaatcctaatgattcagcagcacacctgtccgcctagccgcctacgcgtacacagaaaacaatttttttgtccacacacgcgcgcgctccgagccgcagatccgagctagcgcggcgcatccgacggccacgacagcgcagtgccgtcctccgccgccaccgcttggcgattgtccgcaccccaccagtccaccacctcccccacgagcgaaaaccacggtccacggaccacggctatgttccactccaggtggaggctgcagccccggtttcgcaagccgcgccgtggtttgcttgcccacaggcggccaaaccgcaccctccttcccgtcgtttcccatctcttcctcctttagagctaccactatataaatcagggctcattttctcgctcctcacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtattcatgtgtttgtttgcttatgtgtttgtttgcttgtatttgctggtgcttgtatcgcgggatgcaatgagttgttgtttggttgttgtcaaccaggctctatgtgtgtgtgcgaggtgtgtgtttggttatctgtgtgcagatatggagtcaggctcgcacgatacttaaagcactctgggctaggacgttaggctctgcaggcgcgagtaaattaatcgcatctttgaagttaggctcccgccgacctggctcatatagctgggctaccgggagaagccgacctggctcatacagctgggctaccgggagaagccaaccaaacatgcgcatgtatctctctcgacggatgacacaagatcgaagaagcaaataattaactacacctcgctcctatatccgaagtgaaactaaaaggagaaggaaaagaaggtaacagaataggaaccgtaagaagcaaataattaactacacctcgctcctatatccgaagtgaaactaaaaggagaaggaaaagaaggtaacagaataggaaccgtttggtgaga

SEQ ID NO: 201 - DNA, 2228 bp, Sorghum bicolor
aaaagaaaaaacaaatgctgcgcctccgataatgattatttattcactggggtaaagtgcagtggaggtggagagcacacgcccgcccctccaaaatttatgggacgcgagcacaccagcaagccccacaccaaaagctgaggatcggagcagcgcacgcaacgggcagcaggagacggagatcgcggaatccttatctgctcgccgcgccatggccgccgccgccgccgccgcggtagcccacctctccgtccacggccgcctccgccgctctccggagcatcgcccgtccacctcctcttcctccgcacccgcgcaccggccgtccctgctgcggtgccgcgcgttcaagcaggagaccgacggcggcggtggcgaccgcgacagcgacccgtccgagcccgacgcgcggaagcgcaggaagggcccgctgtacaagctcaaggcggcgatccagggcctcgcgggctcccgctccgccgccgcggaggtctacgggggagagcaccagtaccagcgcgccgtcgagaaggcggaggagatcttcttctcggttgctactcagctaggcagatatgctatcactatgatgagcagtggtgttgtacttggggttggatttcagctgtcaggtggagacagccaaatgaacgaactaatttggtatagctggcttggtggggtgattatcggtacaatgataggtgcaaacagtgtcctggaggaacactgcaaagctggacctcgcaatgtcgtcataactggaagcacaagagggttaggaaaagcacttgctcgtgagtttcttctttctggagaccatgttgtaattacttcacgaagtcctgaatctgtccttcagactataacagaacttgaagagaacatacaggaagggttatcagttgccaaaaagaaagagaggaaaattttatcccatgccaaggttgttggtacagcttgtgatgtctgtaaacctgaagatgtgaagaaattagtgaattttgctattaatgagcttggctcagttgacatttggataaataatgctggcacaaataaaggttttaggccactggtaaccttttcagatgatgacattactcagatcgtctcaacaaacctagttggctctctactgtgcactagagaagccatgaatgtcatgcaataccaagagaaaggaggccatatatttaacatggatggagcaggttctggaggatcaagcacaccactgacagctgtctatggttcaactaaatgtggactaaggcagttccaaggatcacttctgaaggaaagcagaagatcaaaagttggagtgcacactgcctcacctggtatggtcctcacagaccttcttttaagtggttcatccatcagaaataaacaaatgttcaatttaatatgtgagcttccagaaacagtagccagaacattggttccaaggatgagagttgtaaaaggaagtggaaaggcaatcaactacttaacaccaccgaggatcttgcttgctttggttactgcatgggttcgacggggccgatggtttgatgatgaggggagagcggtgtatgcagctgaagctgacagaattcgcaactgggctgaaagtcgagcacggttctctttcaccgatgccatggagatgtacacggaaaacacatgggtttctgtattctcactctccgtggtttgtgcgttcataattctttccagctcaggtggacctcttccaggcacatgatttccagagttgccaaactagtagatggtcatacatatactcaattttgtcaacaccaaaggcattctactatgggaaggtatatgacacaacacttatgaatggggaagaagagaacccccacaaatgtagataggtgcaagggagattagctgctgcttcctcgcaccatttaaggtttggctaaccatgtgctcagagaagggtaaatagaatttgttgcgtgggcatccactgccgtaagttagactatgatctgtgactttttttaagaacatgtatgcaaagttaactgagcaggatcagattgcctcgtgtacatgcatgtagtaatgataatcactgtaacttctggtctcggttgtacccttcaaaactctaaatagcgctacattatatgtgagtcgaagaagcgaagtagcatgcaccatatatgtatactgttcatcataagaaacctgggggtgttatgtggtat

SEQ ID NO: 202 - DNA, 1765 bp, Sorghum bicolor
cccccacatgcacttgctgcagcaaccgtagtacacaagcacacaccacctcgtctccacctcccctgttctcagcgtgcttgccctgtttcgacctcctctgctcatccgcctccctcgcccgccacgccccaccgtagtacaggccggcagacagccatggtggtgctcgccaacccgcctgtcgtcgaccagatcccgctgctgcggtccccggggcccagggacaccttctcgggcgtgccggtcgtcgacctgtccagccccgccgcggcgcgcgcgatcgtcgacgcctgcgagcgcttcggcttcttcaaggtcgtcaaccacggcgtgcccgcggccaccatgggcagggccgagtccgaggccgtcaggttcttcgcgcaggcgcaggccgacaaggaccgcgccggcccggcgtacccgttcggctacggcagcaagcggatcgggctcaatggcgacatggggtggctcgagtacctcctcctcgccgtcgactccgcgtcgctctccgacgcctgccccgtcccctccaccgccgccttccggagcgcgctgaacgagtacgtcgcggcggtgcggaaggtggcggtgcgcgtgctggaggcgatggcggaaggcctgggcattgcggacgcggccgcgctgagctcgatggtgaccggcgccggcggcgaccaggtgttccgcgtgaaccactacccgccgtgcccggcgctgcagggcctgggctgcagcgccacgggcttcggcgagcacaccgacccgcagctcatctccgtgctccgctccaacggcacgtccggcctgcagatcgcgctccgcgacggcgcgcagtgggtgtccgtgccctccgaccgcgacgccttcttcgttaacgtcggcgactcgttgcaggtgctgacgaacgggaggttcaagagcgtgaagcaccgggtggtgaccaacagcctcaagtctagggtttccttcatctacttcgcgggaccggcgctggagcagcggatcgtgccgctgccggagctgctggcggagggcgaggagagcctgtacaaggagttcacgtggggcgagtacaagaaggccgcgtacaagacgaggctcggggacaacaggctggcccagtttgagaagcgtagcatctagctggcctagccatgcaggccggcccggccggtcaagcacaacacatgctttacaggacgacacacaggcaaccatgacgaacgaacgaacgaacgaacgaacgaacgaagacgagcgagttttaatgatggcgaagaagaaggaggaggtaaagacgatgatgacatgatgtgtacagctggggaacggcgactactccggtagctagatttttgtggtgggtgcagggtttccgcaagttgctctaatggcctgttttggggcgtgcggtggggctccttgcctatttcggtatgctggagctggaccggcgaccgctgagccgccgccgccgccgccgccggtagttagcgttaaccaaaatagcatggcagcgaagggacgatccttcctctctggctcgctagcttcccacgttagcttgcttctgctttgctttcctagttttctttttgtgtgtgtgttttttaagcatcaattcgcgtgtatgtattgtcgtgtaaaaggagagaggtttgtgtgtgtgcgcgcgcctatgtggacctcctgtttacctcttacctcttgacgtgccaataatgttccatccactgatccacgggccacggccatt

SEQ ID NO: 203 - DNA, 730 bp, Gossypium hirsutum
aaaacagagttgagaaaaaaaaacagagcagatcaatggattctttcctgcttgagtccccaaattccatttcctcatcggaatcatcattcgggtcgccggaattttctccgttcaaccacaactctcttcctttcaacgaaaacgactccgaggagatgcttttatatggcctactcaccgaggtcaaaacggaaacatcaagctcaacggaaaagggtagtccgacgaaagaaaagtgttaccgaggagtaagaaggcggccgtggggaaagttcgcggcggagataagggactcaaccagacatgggacaagggtatggcttggaacatttgagagtgcagaggcagcagctctggcttatgatcaagccgcttttgctatgagaggcagcgccgccatactcaactttccggtggaaagagtgagggagtcactggaggaaatgaagtgtaaccaagaagaagggtgttcgccggtggtggctttaaagagaacacattctatgagaaggaaaaggaccagtagaagtaagaaggaaagagatgcgaggataaacaatgtgatggtgattgaggatttaggtgcagattacttggaacaacttttgactcaaactgctacaccttactaattcacaccaacatatactattgttcatctctatttattcttaatattttagtatgcaaaagtatatttttagattttatatgaaaatacaaaatt

SEQ ID NO: 204 - DNA, 1316 bp, Hordeum vulgare
ctcgcctcgccgccgctaggtaagatagcttcgcgccatgccgtcgccgcgtccgccgtgctccagccgagcagcagctcgggcccggagttgatctccgtcgctccctcgccctctggtgcacgggaagggatcctccccgtgctcctctccgtcttcgacggctcgcggggtcccaaggagtcgcctcgacgtcgtctgcttcctcttcttcttcaggcagaaccggttcggatgcgcgccagacttcagcagctcgccgtcgccttctgaagcctcgttccacatcgttttcatgccctagttaccggggccggaaacgagtacgaggagtccggagagttcgtccaggaagaacaaaagcagttccagaccgaagaaaccacatgcaagatgaccgtgaccttgacaccgtttctagctttgttatgcttagaatcacgtttccttcgttacatgctcgctgcctaccacttgatatagatgctacatgtctttgccatgaaccccaaacacttccctgtcctagcaaatattgtctggctaagtaggcttgctcaacccctaacggatagctttgctagttgcaggtgccagctgtcccatgtgacaacatgggtattttgatatcattatgtttaaactgttatttaattaatgcacctatatacttggtaaataacggaaggcctagccatttgtcgggtgatttgttctgttgttgccgccttagtttcggttactgatgtttgattccataactgagtgctcctaccacgttcggggttgttatggggacccccttgataaattgtgtagtgttaaggcttgtctgtcaggacccaacattgatttcaatttgctaataacctaataattattttcatagggaatagctaccctaaggaattaatcaacaacctgggccagtgctcctcacgagtgttggtccaacctgtcaaccgccggtggctaccaggggcaactctgtgactggcctaccggaagtttggataatccgccgtgtcctgagaacgagatacgcggctcctatcgggttcgtcaacacgtcgggagatcttgccagatctgtcttatcttagcgatatatcttacgcattgggattccggtgaaactttgggtctcctcaaagttgatgttttcctctaacgaattcaacgatatcacaagtttcgtgatcgaggatcactttggggcctgtggcagtttgtgatggactagttggagcacccctgcagggttaaatctttcgggaagtcgtgcccgcggttatgtggcaaatatggatattttg

SEQ ID NO: 205 - DNA, 1119 bp, Hordeum vulgare
tctccccactccactgatcgtccccgtcccctccccggagctttggctcctctccttgcctccaatcgccgccatggccgccgcccctccattgctaaattcgcgtggtgcaggccccttctcttccttctgacctcgcccttgtcctcccctctgcggcgtggacctctccgacccctctcctagccctctgacagccggtagtcgccgcaccattcggcgcctgagccccgcccgccatggctaggggcaacctcgcccgggttctccccaggctccgccacctacggggatggatgcagcttggtcccctgagcttgttggtggccagggagcgacgaatgatggccggagcaaccggcagccgtctccggcgtcgagcccctccctgtcccctgtcctgtcgggaggaagaagatgagcgaggggagggaggagagagagagagagaggaaggagatgccattggccccattcgtcagcctgtgaggcgttgatcagccccgggcccccgcgcttaagtgaaaatgtattctccggaatgcgctttctcttttgaaaagcgtactcggcccggaggcgcgttctgtttccagtcagggacctgtttgtaggaatttatttttatggataggtccctaaacttcatcgggtcttatctttttgctcgggactccgattgaggtgattccaaaaccctcggcttcgtctcgtcgatcccgtcatgttgatagcattttcacaaggtggtgagactgtgaaaatgacccttttgcccttgtctccaatcagcccccttcgagagagagcgatgtctggcgatcctttccgcggactctcagcacctcttccgggagtattcttcaaccccaggttcacataaggatccgtcgttcgtcgctaaggagacagagcatttgcggtctaggagcgtaaccgagtcagatccctgtggattggagctgcatcaagaccatgctgccttagatagagcttttttcgctgccattaaccttgtagctcatcgtgtaaaactcttatattcattaatagaaatgcctatgttcatgaaaaaaaaaaaaaaaaaaaaaaaaacactgtcatgccgttacgtagcga

SEQ ID NO: 206 - DNA, 853 bp, Gossypium hirsutum
aaccacagtttgccaaatttttgcttgtctcctacaacgtgccattttcctagctctcaactactagtctatgtactatacttttgccttctacattcttctaccatttgtttataaacaagtgcagccccaaacattcatctactcaacacttggcacaccacaatggctcaccacgggcatcctccacctccaccagacccttttgcacccccaccgccagggcatccggcaccacctccgccagacccctttgctccaccaccgccagggcatccggcaccacctccacctgacccttttgctccaccaccgccagggcatccggcaccacctccaccagacccctttgcaccacctatgtttgggcagcctccaccgccagcaccacctattccgcacaatccgccaccacctcaatttgggcagcctccacctcctcaaggtccaggaggacctcctccaccacccccatattagcctatagcataaaaatttgattagattcttatagaattgtaacaataaataagagagtagatattgttatgttgaatgttggaagtggatggtaataatctttatgttacaataaatgagttagtggttgttgctcacaaatttctcacacccaaattcaaaatataagaaataatgacaaccagcttatcattttgtattggtttctagacttagctttatatcatgtgttgtttggaacataaccaaccctgatggaagtccgtttttaagtgaattttttaatttcctgcctatttaaactattaattggaatacttaattcacttgtgtaacctatccaaatatcaagaaattattaaaacctgcgcgg

SEQ ID NO: 207 - DNA, 636 bp, Hordeum vulgare
ctttggccatgttggagcatttgctggagtgtgatcatcatattatcaatctaaacttacaggtacgttttgccttcgagttggaatccatgattggagatgcaaaggctatttcattgttcaagtcacgtatagagaacttgaaaagggcgagtgaagatttgttggctgataatggtgatgatgcatcatttactgaagttggctcagaaaaatcctttccagccaaggaaatacggttccttactgacacattattgggtgcattggagcacaagcttgaagacctggagcaagcaaatatcaaccccagtttcagaggcaaatgctggagccgaccttgagcgcggctgcagggtgaagcgtcggacgagctaagctcaagcaaatctctgtagaagatgatagcaacgacagcttagatgttgacagagaaagctctgtatcagagtagagtacggttccgttacccctatttgttagcagcttattcctggagccttttagcttgcgatgtggtcccgttttagttagacgtaaacagccgcatgcccccttttgttctgcttaatgccgactaagctcttcagtttcggcatgtatgactggtttcagtagtcaaatttggtttagctc

SEQ ID NO: 208 - DNA, 918 bp, Hordeum vulgare
ccggagtcatcattgaggcctgttataggaagaaactctcatatcctaaagcagcaaaagataaatttgcttgatatagatgcagcgttgcctgaggaagcttggagagcctcaaagtctcaacaaataagaaggcgttcatggcgtgcttttgtgaaacatgcagaatcaatatccgagatggtactggcgaccagtgtgttggagagtatgataaaatctgagttcctgaagaatgattggtggtactggtcctccttcacagtagctatgaagacctcaactgtatcctcgctcgctctcaggatctacacccttgacgactgtatcatgtacaccaaggagcctaacaccatgccggctgacagtacaaaggttgtaaacaaggggaagaggaggaaagagccagaaccatcagggtcgtaaccaaacttagaagttccgcagacggtgcaacaatgtgacgctgtggtgatagagatggtatagacagagtctttggttatgtggtcccttgagcttttagggctattctggtgttcctgcaagggtgcaaccttgaccgttcattctaataagccatatttaccagactatagttgtgcaccttagatatgttagggccagagaagaagcaaaatgcgttgtttcgaggatggcagcggcaagagctggcatttaattttaaagccaggagcagcttgcatgcgagcgtagtttttcctttgggacaaacctgttttggctttcagggttacatatcatatatgtcaggtgccatttgtacccaccttcacatgattgatagcatgtggcgggtagtggtcgttaccctttctgttaaacgatacatgttttaggttttcacagcatacaaatttgaaccgagaatttcactagaacaagctggcaatttaa

SEQ ID NO: 209 - DNA, 390 bp, Sorghum bicolor
ctctgatcctgaaagtggagtggatgtggagaggctccagcaagcgactccgcgcgagcgtattgaaaacgcggcgcagggcgcactcacccttctggttctgggtcagtttcacgagccagatgcgcatttctcacgcggatatgcggcaattgtacgccgtgtcaagttgcagaggcaggcagcaaggctcatggaacctgcgggaaggaatatcccatcccaacaagaagccttcgtggtcgctgaagaggctttggctttggttttattggtgaccacggattgatggcaaaaatcgacaagccggtgggcttttgtctactgtagatcctgttcgtttatgtttataatcaccggataatagttattacgattcttgattttgct

SEQ ID NO: 210 - DNA, 1148 bp, Hordeum vulgare
ggagaaatcctgtgctgtgtcattctgggtggatagccaagcacgagaaaatgctgctgctgatgatggcgcggtgccgctgtacgatcgagaatttacattgggttcaactcctatgggtgattcatcaaatgctgaaggcaagaaagacaaggatgattctcgctgtttcaactgtggttcgtatagtcatgccctgaaggattgcccaaagcctcgtgaccatgttgcaattagcaatgcccgcaagcagcacaacttgaaaaggaacctatctaatgctagtaatcgtggacaaaatcggtactaccagaagacgccaggcaaatttgacgatctgaaggcaggagtcctaggatctgagactagagaatgcttgggcctcagggaaaatgacccgccgccgtggctgcacaggatgcgtgaattgggttatcctccaggttacctagatgaggtggaagatgaagacaaaccatctggcatcaccatatttggcggggaaggggaggcgaatgcagagcagcagcagcagcagcacgaggagggagagcttccggagaaggacgaaccgtctccgcctcgcaagaggatgacggtggagttccctggaataaacgcgcccgtcccagagaacggcgacccttggctatggggcagcgctccgcctcctcctcttcagtcctcctcctcgggccgtcaccagcatccatcgtcggattctcagagggatagaggccctcctccccctccgggcgtcgagcaatactcgtcatcgaggtaccactcgtatgactatggaccggcgacccccggcaccggaagaagaagctcctctggttatgatgacggcggtgcctttacccctcactccgcgtattcaagcaggcagcactcggggtcgggctcgagggagagggaaagggaaagggaaagggaaagagagagggagagggagagggagaggcatgacaggcactactacagcagcaacaggaggtgaatgttacatatgtgtctgtagctgaagaaagacgtgaattttgtgatgatatcaaatttgctcagaatatcatataagtcagcacttgcaatatcagtcgctgttgaaacttgtgtaagtagatgttattttgaaacacttattt

SEQ ID NO: 211 - DNA, 541 bp, Hordeum vulgare
cagtaggctcccgcagaacggctggcccgtctccagccccaggagcgagcaggtgaaggtcgactgatggagctggctgatggcgaatcattcaagaacagcggcagttggaagcaaccgaagtgtctgcggtttgtgatgtgcagtcccacttccaggtattgatgctgctgctgctgcaacgaacagcagcttgccaggtccactctccactgtgtgagagttaacacaagctggtccactgatttgttgtggctgagcagggtccctggattgagtagtgaagtagtagaataaagtggtgaggatgcagtgtagtgtagctccgacctcacttgagtaggtaagtaaagtgtaccactagcagcagcagcatctagagcatgtagtaggaatgaaactggatcatgtgccagccgatgtggcagcttttgttctccagtaatatctaccccagctttgtatatagtcctggtgagctatttatttgtctgtaagagtgcaattagagtactggtcatatgaatgcatggcagtttct

SEQ ID NO: 212 - DNA, 337 bp, Hordeum vulgare
caccaccacaagcacggcgtcggcatcgtggccgcgcccccgccggctactggggccggggggtactaccctcctcctgccgccggtggccactactactaatcagctaagcagctcgatcgctagctagatggatacatgcgctgcgtgtgtgatgtgattccgatagctaataagtctctactttgtactgtttgtctttgacttacacatgcgtgctttttaatttcgcacttggctggagatgaggtctgtatgtatgtatgttgtattcctatgtatggatgcatgcgaccttgttggttgcttttgattaatcaatcaatcaatacctata

SEQ ID NO: 213 - DNA, 392 bp, Helianthus annuus
tatatatttcagcttttaggtactccttctgaatctgatcttgggtttatcaagaacgaggatgcgataagatttatcggtctgcttccccgacaccctaggaaatcattacaagatacgtttccacatgttcatccgttagcgattgatctagttgagaaaatgttaacattcgatccagccaaacgtatcacagtcgaagaggcgttggcgcacccttatcttgaacgattgcacgacgttgaagatgaaccaatatgtccaaacccgttttcatttgattttgagcaacaagttttaggagaagaacaaatcaaagacttgatctaccaggaggcattagcacacaatccagagtatgcttaaaaaaacacaaccataaatcttaactt

SEQ ID NO: 214 - DNA, 1479 bp, Hordeum vulgare
ccggggccgcctcctccgcgcgcgctccggccacgccgccgccgtgaggtgccagagggtcgatcctgtgaggctgagggcggtgaatggatcgcccccctgcgttcccctgtccgacaggtcgccgtggacccctgtgacgacgccgattttcggggacgcaagcatcaggaaggacgacacgaggctgcgcatcttctcaggaaccgccaacccctcgctcgcccaggaaatagcaagctacatgggtctagaacttgggaagatcaacataaaaaggtttgctgatggagaaatatatgttcagttacaagaaagtgtaaggggctgcgatgtgttccttgtgcaaccatcatgtcctccagcaaacgagaatctcatggagctactcatcatgattgatgcgtgtagaagagcatctgctaagaatattactgcagtcatcccttatttcggttatgccagggctgacaggaagtctcaaggtcgcgaatctatagctgcaaaacttgtagctaatatgattactgaagctggtgcaaaccgtgtccttgtttgtgatcttcattcaagtcaggccatgggatattttgacatcccagtagatcatgtttatggccagccggtgattcttgattacctcgccagcaagacaatttgttcaaatgacttggtggtggtgtcgcccgatgttggaggtgttgccagggcacgcgcttttgccaaaaaactatcagatgcacctctagcaattgtagataaaagaaggcatggacacaacgttgccgaggtaatgaatcttattggagatgttagaggaaaagtggctgttatgatggatgatatgattgatacggcaggaactattgccaaaggagctgagctgctgcatcaagaaggagcaagagaagtatatgcatgctgtacacatgctgtttttagcccaccagccatcgaaagattatcaagtggtttgtttcaagaagtgatcatcacgaacactatccctttgaaggaggagaagaatttcccgcagctgaccatcctttcagtcgcgaaccttctaggcgagacaatctggcgtgtccatgacgattgctctgttggccatgcgccatactccaccttggatatcgattgagaacgggtgccatagagggtcgacctgccgtggtgtcgacaacaacaaatacagttgatagatgagatgtctaggtgataatgagcagaatgtactctttcttaatgcaggaatagttgtacaagtgccccttttttttggatgttgtccactttgttttgtggaataagctatgttagcagaaaaaaacgttgactatgcgtccgagtgtgataagtacattagatggaagtttgaactgtgtatataggcccgcttaatcccagccgttccttttttttgaccattttagatgaaagttggcccaccttttaagtgtatgatggggctgttctcac

SEQ ID NO: 215 - DNA, 1769 bp, Hordeum vulgare
gatgctttcaaatggtcagcttaattcacctgtatgtggaacagttggtgatgaagcccatgatatgcttttgactgcagtattaagaaaacagaaaatggatccgtcctgcataaataatgctgtccagaaaccacaggaaagcccgcttgatgtccagccactccaggtaaagaaatttagtgtcagacaaaaaggtggggaaacacaccctattcaagcacttgagggaaatagtgacacatttgataatattcagttgaaaggtaaaagcaatagctcttgtaaggaaattatttgtgctttgactgcttcgacgtgcaatgccccttcaccgctggataagcaggcaagagcaactgatgcggtgtcaagaggggctgatagtagctcaaacacaaaggtttttgcctctaagaaatcagctgaaaagaaaggcgtcaaaggtttgtctggcccacatagctcagtgcatggaactaggactgtccagaagagaagtgcaaagaaagtggcagggcgacagaaagaatgcttcatggaaagacaagtggacagcagaggacctcatactcagcagcagctcaacatggaggaaaaagttggcgtaaatgacggaacaaatcacgaactgtttcctttaatacccccaggcttcaaattaatatgtaacgggcaaggtttacttcatggggaaaaagtggatgagagaccaattcaactacatattcaggatgctgggagctcacagtgcaccatggagaacactgcattaaggagctgctcagctgttgggacttctctgcacccaccttttctttcatgtcagatctctggtgagcgttttccgttcatcaagacctcatccatatggcatcacattgaaccaatggaagtgtttcggaaggtaccacaggaaccccatttccttccacttcagcaatttatgccagaactgcgtgaaggaatggctataggtctaatggtgacatatgacagcttagttgaaagtgtgaagagatcatgcatagaagatagtattgagttatttgaaagaaagatcaatgcacttgctcatttagaggaacatggatttgatgttaagttgctgcagcacagtctaatgaaattactcgaggccaaatgggagcacaccaagcatcttggacatctggacgagttgaaagaattagtaccgcggaaggagtctgccatgtcccaaaagcatgcattacttgttgaaaaagaaggagctatatttcagcttgagcagaaacttgagtaccttcgcggtgaagcagagcagattgcaagggagacaaaagatgaagatgcagagctcttgaggttgaaagtgggagttaacatggctcaggaagcatgtgttaatgttgaagtgcggtttcacgacattctagccgatatgagttcgagactgcagctttccgagtgatacaatattcagaaatcatttcaatctcccaactttatttgttcctgtagcttatgctcccatgtgttgcacctttatgttatctaggatcatcaccgaacttggattaaggttccaattgtcattcgacaccttttgtgcatgtagcagatgtatgaatcttcaattctgtcaagtttagacccatgtttctatgctagttggatggtatttatcgttgtgtaaactggttgtcttgtgttgtcagtttgtcactcaattcccctaatcatgtgatgactgttatgcagtggttaatctcaaaacttgctgtcgg

SEQ ID NO: 216 - DNA, 1942 bp, Hordeum vulgare
ctcgtgccttgcatatatattaggagccatttccaatctattatcaaagataggtatatcaagcacagttggattaattggttctcgatattcacttggaaacaatattggactgggcacaccattgtccattcagcagcagttgcttgttcttttgaagcgatcccttaagagagctgatatgctgaaacttacaagcttactatcctttgatcacatctctcttgcaaaatttgatttgaagcatgtccaaaggccgttggtgtcctttggccctaatggttctacaaagcttagaacctgtcctgcagatgtctgcaagaatttaagattaagttcccatgtgctgtccgacttcggcacagatagcttatcaatttcgaatgataatggtagtttcagtacctcatggcttaggaatctgtctgatgcttccagatcttggtctaatagctcagcaaagactagaaaacttattgcaaatgactttgacaatttccactttcatgcacaaccaagtccaatacctacatcagtattgcaattagccggctcagcacatttgatgagggccactgcctgggagcactatggaagtgctcagatggttcgaatgaatacgctggtctatgcaacctgctttgctgatgctgcaagttcatcggagctgtcactggcatatgtcaagctaattgaacagttagcagtcttcaaaggatgttcagcggcattctgtgcgctcaagcttgccgaagagaagttcccatcctcgatgaattcacagatccaccttctcaaaatgcaattgctacatgagcgtgccttgcatcgaggacacctgagaattgcgcaacaaatctgtgatgaatttggggtgctctcatcttctgtcagtggagtagacattgagctaaagactgaagctagtctacggcgtgcccgcacgttactcgctgcaaaagagtttagccaggcagcagctgtggcgaattcccttttcactacatgccacaagtacaacatgcaagtagagaatgcaagtgtccttttgttacttgccgaaatacatagaaagtccgacaacgcggtccttggtctcccttacgcattagccagccaatcgttttgcaaatcgtttaatttggatctgcttgaagcttcggccacacttactctcgctgaactgtggctagctcttggatcaaaccacgcgaagagggccctaagtcttgtttatcaaagccttcctatgattctcggccatggcggtcttgagctgcgtgctcggtctcagttagtcttagcaaaatgccatttaactgatccagaattttcagtttctgaagatccctgtgctgttctggaccctctaaatcaagcagctgaagatctgcatgttttggagtaccacgagatggcgacagaggtgtactatctgaaggccatggcgtataaccacctgggcaagttagacgagagggaggaagccgcggctcgtttcaaggagcacgttaccacccttgagaacccgcgcgacgaggaggattcacttgcttactgacattgcacagttaatcaaccgctctggtaggacggggccatgtattgcagcgaggtagcagcaggagcacaaacagaagtgcctgctttgtccacctgatctcaagactccttccatgacttcctctgcaaagtcgcctcatcggttgggcgtgcgaggaccttggcatgcacactggctgaatttcagcactgttcgagggagctttgtacgaggaagaacaactgggtggtctcaccagctactcatggcctgatgcattctattgctgaatgaatgtatatcagtccatctcaactttcggcacagttcgagagagctttgtatgagttgtaaaatcaattgaattttgttcctgcgccgtctcagctttctatcccc

SEQ ID NO: 217 - DNA, 1042 bp, Hordeum vulgare
cgataagcttgatatcgaatagccagaggacgagacaaggaagattcagaaactgccttccagacctgaacgcctcttattttattcgaggagtttggaactaataggagttactccagagaagtttgagaataataaccagttctggcgggaccaggttcgcaagtactggtcatttcttggtgttgaaaagactagcatacggaatatcatggacatgaatgctaattatggtggatttgctatggcactaagcactgatcctgtctggattatgaatatagtacccaatacaacgatcaacacactacctgttatctatgaccgggggttaattggttcttaccatgactggtgtcagccattctcaacatatcctaggtcatatgatttgctacatgctttccacctcttttcacactatcaaggtcatgcaggaggttgcttattggaagatatcatgctagaaatagatcgcatcattcgtccacagggatttatcattatcagagatgagaataccactctctcaagaatcagtgatctcgcaccaaagttcctatgggatgtcacgactcgcacgttggaaaacgaagagaacaggccggagcaggtcttgatttgtaggaagaaattctgggccattgtttaagtagtacttgtgcctgaagattttatcttacgtcctatcccaccatccggtatcttgctgacacaacataaggaagattttcgggtgtacaaaaaagtttcaagatgttcctgcagtgtgcacaagacatttggtcgcggattctttccagctgaggacaccgcattacagaaaaaaagcagaggacatgactgggatttccttatcttcagcctgcttttccagtgcttgttgtgtaatgccaacttcttgtcttggaacgatgaatcggcaggtgtagaaggacaagataacgctctagattgtcatgtaatttgctaattttgtaaactagtttagtttaggtttttttctttctttctggaaacctaggttacgaagtatagttac

SEQ ID NO: 218 - DNA, 1902 bp, Hordeum vulgare
gaggagttccgccagctgctcatccgcgggaccgcgtcgctcgccgccgacgacctgcacgcgtccctcctccgccgcctctcgctcacggtgcccaccttccactccgcctcctccgtcgacctggagtgcccctccttcgccagccagcccgacgagggggacgaggccgcttccgccgcgggcaggtggagctccgtctccgacggcgagatctcgccctacctcatttcccccgacaccgtcagcaccctcaaggacatcgcggacgtcatgctgcgcgccggctatgggccggagctctgtcaggtttacagcgaggtgcgccgggacacgctcatggagtgcctcgccgtgcttggggtcgacaagatgagcctggaggaggtgcagcgtgtggagtggggcgtcctagatggcaagatgaagaagtggatccaggctctcagggtcgtcgtccagggccttctcgccgaggagcgccgcatttgtggccagatcctcgcggccgacgcagatgctgaggaggagtgcttcactgaggcagccaaggggtgtgtcttgcagctgctcaacttcggtgatgccattgccattgggaagagatcgtccgagaagctgttccgcattcttggaatgtatgaggcactagctgagttactgccagagctcgaggccttgttctcaggtgacgcaagggatttcatcaaggaagagggagaggggatactcgtgaggctaggtgatgcggtgcgtggcacggttgctgagtttgccaatgcgatacggggggagacttcccgcagatcacttccaggcggcgagatccacccgcttacgcgttatgtcatgaattatgtgcgactgcttgcagattacagccgctggctgaatcatcttcttgatggttgcgagactgagctggaaaatgggggtgacaatgcggatatgactccactcggacactgtctgctgatactgatcacacatctattggacaagattgaggataaagcgaagctgtatgatgatgaggcactgcagaacatatttctgatgaacaatctgtggtatgttgtccagaagatcaaagattcagagcttaagactttgcttggggataactggatccgtaagcgccgcggtcagataaggaggtactctacagggtacctccgatcctcgtggaccagggtattagcttgcctgagggatgatgggttgccacatgcaacaggttcatcgagtgcactcaaggctgcactgaaggaaaggttcaagagcttcaacttggcttacgaggagttatacaggacacagacagcatggagggttgtggatcctcagttaagagaggagttgaagatttccatctcagagaaggtccttccagcataccgttcgtttgttggaaggttccgagggcagctggaggggggaaggaattttgcaaagtatataaaatacaaccctgaagatgtggagaaccaggtctcagatttctttgaagggaaaaaattgaatgcttgatcaatctgtctatctttgaaggaatgttcatatcaatggttgtggttataaatccctggcaaaattcattcgggcaatgtgcttgaaacttgccctaccatcatgcttgtgaggttcgaagatggagaaatcaattttgactggtggatcagaaatattgtgaatgcaaggcaccctgggtcgaatactctgcgtttcatgtttgactctttttaaggggagtattgacattagccacatgggattcagggcactgcggtgagctgtgtaactgttactattacagtttacccttcttttgttgattattgactattgttggatggtcggtggttgacatcttatgtacaatttatacagcagttatgatgt

SEQ ID NO: 219 - DNA, 1157 bp, Hordeum vulgare
cggcacgaggctgagacctgcttttatagaagaagaatcttatttgaggagtttatttcattctgaatgcaatgccgatggttattcatctgagtggagagaggaatacaacagagaaccccggccagcttctggaaccaatggcctaattgatggtgataaattgagattggacatcaatgatgcgggaagtagcattgattcaaccatctataagctggaaatgatgacaattgagctgttttccgtctatgggaagcagtttatgattgatccacaagactttcaagatgcagaaccagatcttctttcaaatcatgcttcggacattataaaacgcatggaagaaaacagtgatcagtgtaccatggctctacggtccctctgtagcagaaaaaaaggcctcacggtagaggaggcacgcttgataggcgttgatagtcttggtatcgacgtgagagccttttctggcttggaagctcggaccgttcgattttcattcaatgcccaggcgttatctgaacgttcagccgaaaagaagatcaagcgaatgctttttcctcgttatcgcaagaccgtgaaagcttccgctgaagatgaatgttagccaacttatttaattttagcttcgaacgcctaacagtaagctggtgaggacaaagggtgtgcagggaactcaaccaaagatgtgcacccagtcagctcccagtttgttaggagaagctaacacccgtcgacatgaaatgacctcaagtgctagagtgctcggtggaggtttcggcttggtcggctatagaaggccaaccacccatggcttctgacaaataaggtggtggccatgtatagaggagcatccttggacgggacgtgaggcgattcggtgtcggtgcaatctgcagctgatcaatcatagcccataagtttccccctaaacaaaataaggtgcaggagacgcaggatacaaagcgacagctctttggcctgaataaacaacgtcttcttagtttactacaaacatgtaactaactccatctgatccgtttccttcccatcctgaataaattgcaattatgttatttcgcaaacaaaaaatgcaattatatttagtgccaacatgtcgctgtcgaaaccttgatggtgtctcggcaataaaaata

SEQ ID NO: 220 - DNA, 1905 bp, Hordeum vulgare
tcggcacgaggagcgtattggtggcggatttggtggaaaagaaactagatcagcaatatttgctgctgcggcatctgtagcttcctattgtctaagaaggccagtaaagattgttttggacagggacgttgacatgatgacgactggacagaggcacagtttcctagggaaatataaggttggatttaccaatgacgggaagatactggccttagatctcgaaatttacaacaacggtggtaactcactagatctgtcccttgcagtcttggagcgtgctgttttccattcggaaaatgtgtacgctataccaaatatcagagtcagtgggaaagtatgctttacaaatctcccaagcaatactgcttttagaggttttggtggtccacagggtatgttgattgcagagaattggattcatcacatggctacagaactcaagcggagtccagaggagataaaagaacttaatttccaaagtgagggaactgaggtttattatggccagttgctccgtaattgtacaatgcattcggtttgggatgaactgaaggcatcttgtaatcttttggaggctcgcaaagctgtaaatgttttcaacaatgaaaatcgttggaggaagcgaggcattgctatggttcccacaaaatttggcatatccttcactgcaaaatttatgaatcaggctggtgctcttgtccaagtttacactgatggtactgtcctggtaacacatggcggggttgagatgggacagggtttacacacaaaggtagcccaagttgctgcctcatcactagatatccctctaagctgtgtatttatctcagagacaagtaccgataaggttccgaatgcttcaccgacagcagcctctgccagttcagatttgtatggtgctgcagttttggatgcttgtcagcaaataaaggctcggatggaacccattgctagtagggggaatcatatgtccttcgcagagttagctcaagcatgctacatggaacgagtagatctttctgctcatgggttttatatcacccccgatatcgggtttgactggattgctggcaaggggagtccatttaattatttcacgtatggagccgcatttgcagaagttgagattgacaccctaactggggatttccacacaaggacagctgatattgtcatggatctcggctattcgattaatccagcaattgatattggccagattgaaggagctttcattcaaggtctgggttgggctgccatggaagagctaaaatggggggatgacaaccacaagtggattcgacctggacaccttttcacttgtggtcctggctcttacaaaataccctctataaatgatatacctctcaatttcaaggtttcactattgaagggtgttccaaatccaagggccatacactcatccaaggctgtcggagagccaccgttcttcctcgcttccgccgtcttgtttgcgataaaagacgcgatcgcggcggctagggcggaggagggccatctcgactggttccccctcgacaacccggcaacgcctgaaaggataaggatggcgtgtgttgactccattacgaagaaatttgcgagtgtgtattaccgtcccaagcttagcgtatagtggttgctgccagagtagccgatacatgcaacgtaaatgtgtatacctgttatgtggtgcactatactgtacagtccggacacgctgtgtgcatgataaaagtacagatgaagtgttgatataggattacgaataccactgtacttcaaataacctggaatacgagcaaaaacaattagttcaaaatttgggttcatttctgcgagggggaatttgaaaggtcactgtatttaaaatgtgattttcaaataacaactgccttttttttc

SEQ ID NO: 221 - DNA, 601 bp, Hordeum vulgare
gtggcagcgatcttcccattataatatcttgcgctagtcttgcactggcagatgctgggatcatgatgtatgaccttgttacatcagtatctgtgtcctgtttagggaagaatgttatcatcgatccaacctcagacgaggaggcatggcaagacggaggccttatggtgtcttatatgccggcccgcaaggagatcacacaacttacgctgactggggagtggactgatggcaaaatcaccaatgcagtagagctctgtatggatgcttgcagcaagctttgcgagatattgcgggagcgcttgaaagaccccgcgagcctggcgagcgaatgacatttgagcagacacatgtttgcagaatcgcaacagatatccttagctgtagaagttttgtagggaagggaggacaggactgctgtttgcaggagcacaatttgcatggctgtggtgattgtttcttttggcaaaagagtttagccgagagaaaatcttgtaggtgtgcaagccatgtcttgtactgtgagttcggaacctgggatttttcggaactttgtactatcattctatggattgtttatgatgtcaaagctattgccctg

SEQ ID NO: 222 - DNA, 691 bp, Hordeum vulgare
tctttgccaaatatgtaccaaacactattcgactggtacatggacatgatattgtgccacatttgccaccttatttctcctttctttccaaactgacgtaccaccacttcccaagagaggtatggatcgatgattctgacggcaacacaaccgaacagatttgtgatgccagcggcgaagatccaaactgctgcaggtgcctctccatattgagcctgagtattcaggaccacttcacatacctgggagtagatatggaatcagatgactggagcacctgcagaatcatcacagcccaaagcgtcgagcgattacggaaggatcttgccagcaacatcatcatgacaaagcatgatgccgacgtctccattgtcgagaatagtgtgcagacagactggagcagttccagatagcatactgcattactgttaacactatatttgtaacagaagacgacgccttttctttctcttgaagatggggggtttcagttggggaatttcattcagattgggttgtacattgttctttcatagcctgtgaatatgtagaaatgtagacacgaattataggttctagaccgtaaactcttgccggatgcacgaaagatactctgtgttcacatcttgtaaaatacagtacccatgcagatatctatgcagatgtctccagtccgggaaataaagcagaa

SEQ ID NO: 223 - DNA, 1122 bp, Hordeum vulgare
gatgagcatggcggcgacggcaccggcggccgccacggccacggcctggccttccacctcctcctctatccaccaccacgccacccccaacccccgcgccctccgctccggcttcctcggccgcgccctcacgctctgcccgcacccggtggacgcccgcgccgccgccgccgtgtccgtgcgcgcggcctgggacggtccgctctcctccgcgcgcctcatcatgcagggccgcaacgtcaagctgacggagaagctcaaggagcacatcgaggacaaggtggggcgcgcggtgtccaaccacgcgcacctggtgcgggaggtggacgtgcgcctctccgcccgcggcggcgacctcagcaagggccccaagctctcccgctgcgaggtcacgctcttcacgcgccgccacggcgtcgtgcgcgccgaggaggaggaggaatcctcctacgcgtccatcgacgccgccgccgccgtcgtcaagcgcaagctgcgcaagatcaaggagaaggagacggacgtgcgccacctcaagggcaccaaggagtggcaggccgccgacgctgatgcgactggcttctccgacgtcgaggaggaatcggagctagagctcgaggaggacgacctggtcgaggtcatcggcgccgaggacgaggagaccgtgctcaccaaggttgtgcgcaccaaggtgttcgagatggcgccgctgacggtggacgaggcgctggagcagctcgagaacgtcgaccatgacttctacgccttcaggaacgagcagacaggcgaggtgaacatcctgtacaagaggaaggagggagggttcgggctcatcatccctaagcaggacggccacgtcgacaaggccaccgtcaacgccaaggagcaccccgtcgccggctgaccacgccctccgtcaatcactagctgtagctgcattagttggtctgttttttcccctcatgatggtgggtgtctgtcaagcaagtgttggtgtttcatcagatcagacagccccttctttgtgcaaattaacagacgctctctgggctgtgttaactcatgatgatcccacataccagttggtaagttgtttctctggctcgaaacggcagtcatattaac

SEQ ID NO: 224 - DNA, 2518 bp, Hordeum vulgare
gtgatgttgcttacagctgtatgccatatattattgatggagcactcagtgaaaatagttcatatggaggatttgaacattctggcattccagatggcattcctcaactggaagagtacctagctgtgtactgctctatgtctgcacgaccttggcctgcagcaaattggaagttctacattgccttttcactgtttcgaggggcatctatctatgcaggagtataccacagatggactatgggtaatgcttcaggcggtgagcgtgctagatttgccggcaaggctggcaatgttatggttgactgtgcctgggattacattaatagagaaaatgtcctgagagcacaccctgctacaggtatgcatgtctcgaaggctccccaacaaggtttccatgtagagcaggaagattcaactttgacaagtggtcaaggcaaatttgttcctagcgaaaaggttatgaagctacagcataaaataatgaagttcatgaaagatcatatataccccaaggaagatgagttatacaaacatgcacaatcaacctcacggtggacaatccatcctgaagaagaaaatttgaaagcattagcaaaagaggagggattgtggaacttatttattccgcttgacagtgcagctagagcaagaaagctactccttgaggaccgatcttatgtttctgctggaagttcaaatgatcttttgctaggtgctggtctcacaaatcttgagtatggatatttatgtgagattatgggccgttcagtttgggctccacaaatatttaactgtggtgcacccgatacgggtaatatggaggtcctgttgagatatggaactaaggagcaacagaagcagtggcttgttcctttactggaagggaaaattcgttcgggatttgcaatgacagaaccacaagttgcatcttcagatgcaacaaacatagaatgttcaatatccaggcagagagatttctatgtgataaatggcaggaaatggtggaccagtggggctatggacccgaggtgcaaaatcctgatattaatgggaaaaaccgatttctctgcacctaagcataagcagcagtcaatgatcttagtggatatcaacactcccggagtgcaaataaagagaccattgttagtctctgggttcgatgatgcaccgcatggacatgcagagattatttttgataacgtccgtgttccggtcacaaatatcctcctcggagaagggcgtggtttcgagattgctcaaggaagactaggtcctggaagattgcatcattgcatgagactaataggagcagctgaacgtggcatgaatatgatggttgagagggccttaagtaggaccgcttttggaaagaagattgcgcagcatggttcctttcagtcagacctggcaaaatgccggatagaactggagcaaactaggcttctggtgcttgaagcagccgatcagctcgaccggcatgggaacaagaaggcccgcgggattctcgcaatggccaaggtggcggctccaaatatggccctgaaagtgcttgacatggcaatacaagtccacggcgctgccggggtctcatccgacacggtcctatcccatctatgggcaaccgctaggacactgcggctcgccgacggccctgatgaagtccatctcggcacgatcgcgaagctggagctgcaaagggcaaggctgtaagatcaggacgaggtccagattcaataagggggacggcaaacctttggagaaggtcagttaaggatatcatcacagtcacgggtagatagaatggtgaataagtggcgttagattcctccatgtacactccctgtttgccttgtcgattccattgtcatttgtccatcagaaccatgacacatctttaatgttcgtcctcttgttgtaaagagtccaaccctaccagcaacagttacatgagtaccagtgatgactattacagatctggacaatagtctcagtagtaccaatgcgtatttcagatttgaacgtcggcgccaacagtttttcttcagtgtactgtggaaatgagagcctaatgtaatctcttattcaactttttttacctatgagccaaaatgaatggacccccgtacccatacatttcggtcatcctattcctacccgaggccgagcgtgtaggggaaggaggtggagttgagccagaggtcgccctggatgaacgcctgcgcggtgaagttgccggcgtcggcggcggcggtgatcacccggtaccccggccacgccaccctcgccgacgtgtcggcgccggggccccggttcatgtactcggcgtaataaagcgtgtcgagcgcgaaggtgccgttccactcgagccaaccccgggggtgcaccagggcctccatcttggactgcatgaacaccgtccgggagtaggccttccagggccgtccgaggtaggaggagaagttggcgagcacggggacgaggtcggcggcggcggcgacttgcatccctgcacggcg

SEQ ID NO: 225 - DNA, 786 bp, Hordeum vulgare
atggtcggcggcgtgctgctgcacctgcgctcgctccgccgcttcgagcacagcggcggctggatccgcgcgctcatggaggaggccgagaacgagcgcatgcacctcatgaccttcatggaggtgacgcagcccctgtggtgggagcgcgccctcgtgctcgccacccagggcgtcttcttcaacgcctacttcgtcggctacctcgtctcccccaagttcgcgcaccgattcgtcggctacctcgaggaggaggccgtccactcctacacagagtacctcaaggacctcgaggccggcttgatcgagaacacgccggccccggccatcgccatcgactactggcgcctccccgccgacgccaggctcaaggacgtggtcaccgccgtgcgcgccgacgaggcgcatcaccgcgacgccaaccactacgcatccgacatccattaccagggaatgacgctgaatcagacgcctgcgccgctcgggtaccactaatcagttcaatgaaccatagatcgatatggcttctcagtccacgctgttacgtgctaccgctgccgccgatgttcgtcccgttaatttggatggattgttgcgtgcgcagtatgtttatgtaaacggtttatgtctgatgagttctgtttgtcactttgtacccaaagatatgtttttgtaagcccgtaattcttgtaaggacaacgctacccagcggcgccgcacttgcgtcctgcggtgtgcggtgcggcggccgaactaatcatcattctaataaaaagtaacgttgcc

SEQ ID NO: 226 - DNA, 695 bp, Hordeum vulgare
ggcggattgtctgtcttctaggggaaaggtctcgacgtgcccgctttgcaaagccagtttctcctggatcagcaaggtggatgaggccggcacttcagatcagaagatatactcgcagacccccgttccttgtggagcttcaaccgacatcttcatgttcacggatgaaggccacgaccttcctggaccatcgtccgcccaaggggcctgctacatgtgccacagccgtgagcccgaggagcttattctgagctgccacgtctgccgatcgcagtgggtgcactcgtactgcctcgatcctccactgaccccatggacgtgcatacactgccgagatctgcgaaggatgtatcagcgctaccgctagtccgaattccggaagttcattggcgtcttggactcttgattcttggcgtcttggagattctcagggcagatacaatgcaaggcatgttgacagctgatgattagttaattcctcaagattgaaggacagagcaagaagcagagagacaggaaaaggggcggcgtcaggctgcgacgctctttgagtttgccgcatcttacgtttatcttttttgcgtatatatgggttctcgagggtcaacatcttgttgatctgggcatggtgcaggtgcatatggcgctttcttttctaattcaggcaatgaacagaagaagttttgtactggtag

SEQ ID NO: 227 - DNA, 1673 bp, Hordeum vulgare
gtttggcaatacaagatttctttggtgcatttgtactcttacttgggagctcttccgttagcacatcgatggtatgtaagcctggaagtcaaaaacattcttctagaatccgtctcacaccacatcttgccacagatgttgagttctcctttcttggaacaaacagccagtcttgtgaaggattatcttaggttcatggatgatcatttgaaagaatctgctgatcttacttgtcttgcatataggcaccgtacttactcaaaggtaattgaatttgtgcagttcaaaaatcgcttgcaatgctccatgcagtatcttgctgtaaaatctgattctgtaatactgagcctgaagcagaagtcggagtctcttgaggaagtggagtccgttcttgaaaatgtgaatcacggaggaggcttggttgatctatcaaatgaagacaacatgaaacatttaacttttaatgaagatctcgaggcacgcccttggtggacaccaaccaccagtgtaaattttctttcagaaccaattgatgaaagttcaacacctgcgtgctttagggccaaagtgtgcaagcacaaatctactgagaaggatggccctaagatgggagatgctgagagaaaatgtcttgtcccccggcttgtttatctttccatgcgtggttgtgtatcttccctcagggagactgagcacaacgggtctgtttctgatatcactgttggggaaatgaaaaccttacttgagaaatatgctaggactattggttattctatggatgatgctctaagcatgattcttggtatatcttcaggcaagaagtctatgaaggattttgctcctgatattgtgagctggatgagtttcgctgtatttattaatgcgatgaacctgtggtcaaatgaatcagtgatccccagaactgaaccgagcagcccaagttcttgggagattgtggacagcttggtgaaactttgcatagaggagcacctgactgatgccaatcgaatcctgacttgtcctggaaataaaattccactgttagtgcagatggttacggagcccatttcttggcatctcatcataattcagtcctgcacgagagtggtggctccgcaaggaaagaagaaaaagaaaagcggcccatcgctgcgaacaaacatgcctcagttgcaaggaattcaaagatctgttcagtgcttgattgaaacgctccaaagtgtccaaaaatggctatctgatcagatgagtccagaggagcaaggtttggatatcttgctgtcatatttccaaggaactggcgatgaaggtccaggacagacattccgagtcttggaagagaaaccagcagcacatgcctctgagcttggtgatcgaattgctcagtctctggaagcatggagttctactagtgtggtaagaagaattgttggagcagaacatgaggtgctagccgagttcaagaaaatggtcgactctaaactaaagctgctcatgtcagaatcggcttctctatcttcggtgttgcactagagttgatgaaattttgcacatgaattttgttctattcttgttgtggtgttccattatacatatgttgtaacagtataacagaatggtgttgcactagagctgttcgttgtttgacttgcttttatttgattgatgacatc

SEQ ID NO: 228 - DNA, 1047 bp, Hordeum vulgare
aagaaattgggcgagctattcacgaagcgcggtgttaatccattgacacccttgaagggtctattcatccaagggcctatattcatgagctttttctttgctatacaaaacatggtggagaaagtcccttctttgaaaggaggtggagcatattggtttactgatttgacaactcctgacgaactttatatcctcccagtgttgacatcggcgacattcttggctacggtggagctcaacatgcaagaaggcatggagggaaatcctatgctgcaaacaatgaagaagttctctagaatattggctcttatgactataccatttacaatgcactttcccaaggcaattttctgttactgggtgaccgcaaacttgttttctcttgggtatggttttgctctccggaagacagccgtgaggtatttcttgaatcttcctgagatagtaccacagcccgcacctgcggaagtgtcgaccttcaaccttttcaaggcaccaaagccagtgtcagcagtcaatacacccaccggggacaacggtgattcatccaccgtagtcaacagtgattcaaccaccgcagtcaacgggtcagagcagtctaatgctgagctaagcgaccgggttgtgtttcttgagaagaagattgcagaacttgagaggcgggctaaagctagaggtgaatctcaggaggaataaactaacaagtaagtttctgaccgagcacgcgaaatccaaagaagcactaggtattgcgtttgtaacccgcgtctggtggccataaagggatatcttgcgcgggcaaatcgatatagtaccaagatttgacttggactagccaattttgtgagcatgtgttgcaaatgctgtttcgggcgaataaaccgtaggtatcctggcagttaaaatcgccagaatgtttgttggattaagcttagtgatgctggctgagaagaaaccagagggtggttattattattgtaccacttgacatttgaaaatcgaattatgtaatagtattaacttttagtttgcgatcaagataaaacg

SEQ ID NO: 229 - DNA, 810 bp, Hordeum vulgare
cggcacgaggcgttataggtgaaagatgcattgcagatgcagcactattgctgattgagatggccagcaataataacgtgaaggagaaactgaggaagcttcctttgttgtccctgcgaaggtcacccaaagattgtaccctcattgaatccagaatcttgtccaatggacaagaatcggttgaaagcgcaacacagaagctggaagcgttcaagttgcagctgaggaaaccagataatgcgagtatagctgaaaacggcaccgagggtactttcaacacaagcgtgccagagaaacgtaataggtggtctgtagcgaagtcctggaccccctgtccgttaggcatgataccttgttcatatagttcaactgctgttcttcctgtccttgatatcattgatgatgaactggagcatgacacagctgaacatggaaattttgaggatgatggtcagattgaaattgctgaccccgagaagcagttggatgatgaaggctttctagaaatatcaagatcgccacctgaacatgggatttctgttatgccagaactgatccatggtctcaagggtacattactggttggtggcgtgtggaaaaaggtgactgaagaagagttgctctccataaagtcaagcatgaaaattttgttgtgatattggctagttattctcgcccctctgcagtaaaatatttttcttctgtaatcgatcgaatggtagctttttcttggggtatgagaaaaccctctttaatcagctctgctcagttccttcacaatttgggacaatagagagtttttctgttact

SEQ ID NO: 230 - DNA, 619 bp, Hordeum vulgare
agaatcccgttggagcggaaacggattatacattggatggagattgagaaagttgaaggcagctcaaactattacttgctgcatctatgcactcaggcaggaacatacattaaggagtttgtgcatggtgatcttggacgcacaaatccaagtatcggttccatgctacgttgcagagccgagatattgcagctcgatgtcaccgacgtaaagatggacttgctgcaataatatgctgctgccacgtgataccgttccgggcaagtattattggtagaggaggcgtgctgataagccaaggttcctgcagaagacgtatgccgatggcaagtgtgctaagaaggacgaatcgatttccttttcaatcgagcgcgtaacttgatgtcaatttgagaatgtacaccagccaggggcagccagcagcaatttcgagaaactggggtgaatttgggccccatttcgggtccaatgttttcccttctcccagagcaacaatttagagaaaagttgagaaattgaaccatctgttgtgtcgctttgtgttgttgtgctgctaaacaacattcattgagcagcatcacgcggatgatagaacaaagagaaaaaaagttgatttgga

SEQ ID NO: 231 - DNA, 931 bp, Hordeum vulgare
taaggtctcgtctaaagatccttgctgtattgaagttgcgctccgttgcttagcaacagaaggtgatggatttgggcttcatgaagccaatgatggaggtcttcttgctgcaattatggctgctggctttaaaggtgaactcaatcgttttcaacctggagtttcaatggaaatttcacgacttgatgcttggtattctgattgtcatggttcggttgaaagtactgctgcttatatcattcgagggctttgccgaagatgctgcctgccagaaacaattctacgatccatgcaggcatccatctccctttccgaagctggcgattctctagaccattgtgataaacttatcgagttagttgcttcatcagattctgggatgatgcacttgttcagccagcagcagttacaggagttcctgatttttgagagggagtgcttcatatgtaaaatggagcttgaggaagagcagatgcctgctgatggctaagccactcatggtttaaattatcagtttattgaagcctgaatctcttccacggtcttgccttttgtctctggcacgttcttcacaatgaacagaatagccagggcacaaacagaggcaaagaagcatgttccagcaagatctcaaggcgaaggagaagaatgttcctgctggatttgcatatcagtgagatgtccctggatgattcatgtattagacaaaaacgataggggtccgatgtagatttggcaacggcggaatgtctgcgtccaatccgattgaccatgtcaatgtaacaaccaatttctcagtttatagagatgtgcgtgcgtaagcatcattgggtgtatttggtagctgttcccattccaacatagttgttcccttttgaaacatgctaagtctgaacatgttgagtagatgcatttgttgttgtttgatagt

SEQ ID NO: 232 - DNA, 1132 bp, Hordeum vulgare
ggacttagaatggttcagaatggcgatatccttctgaataaagtatttgtcccagaagaagacagattaacaggcatcaactcatttcaggatataagcaaggtcctagcaatgtcacgtattatggttgcttggcagccaattggcatatcgatgggcgtctacgacatgtgccatcggtatttgaaagaaaggaagcagtttggagctcccctggcagcctttcagatcaaccaagaaaagcttgttcggatgcttggtaacatccaggccatgcttcttgtcggctggcgcttgtgcaagctctatgagtcaggcaaaatgacaccaggccatgctagtttgggcaaggcatggacgtccagcaagtcaagggaggtagtttctctgggtcgagagctattgggcggcaatggaattttggctgattttctagtagcaaaggcgttctgtgatctggagccgatttactcatacgagggcacctatgacatcaacagccttgtgaccggaagagaaatcactgggatcgcgagcttcaaacccgctgcagtagcaaaatctcggctgtaattcttcttctgcctccagctacgatgaacagcaaagtatgaccccccaccttgtattctggtgggtacgagtaagatcggaataagtgcaatggaatgatcaaatgtaatttgtaaggcggaaggataaagtcggagctggatttgtatctatgtaatggtgcagcatatggagtcacatctcacgatcagtatttgtgcactggggggtcgtacagcttctacatattgaaattgtgcagttcaggagaattttcccatgagacttacctgtgagatgagatgggtgcggatcatgtgccattttttggttgagaaaatatgttatgaccggtgcaaagtaccaacggaggaggcccaatgggcagggttaattacgggcttagcccaagttatcttacctatcttagagtccaagttatattagagtccaagttatctagggtttagtggaggttgtcctcctatataaacacatgtacccctcgatattaagcagacaataaacagtatattttgttgtcgtcttcctcaggagacgagagccccagcggccgcca

SEQ ID NO: 233 - DNA, 1320 bp, Hordeum vulgare
gacaagactttaaaatgttctaatggtcaggggtcagataaggtgccggctgaagaaatttcagttcagcagccaggggttgatgacagccatgatctcgttgagcaacaaaacagagacatggatactgaaatttcaaaagataaaagctctgaggaagctaaggtgattgctagtgaggtgcaaaatgatcaagcgacaaggagggataagagaaagacccagaaccaaggcagatggagaggggttgatcctgtgatatttttcaaagacgaagcgacaatcagaagcataatatcctactatggcatcaaggattcttttacccttgaaggccatcttgtgactaggaaccctgatactaatcatgttaaaagaatatactatgtctcaaaatcagttaaagaagttttggacctcaatgtgaaagttggcgagcggctgaaaatcacctcacttggcttaaagatatttgaaaggcagtcgtcaaaggagggttcgccatgcacatttaggttgtcatccgagggattgcctctgctgcttccttacatcaccaaacagattctatatgcatctgcaatagactttcagcacctcttacagtacagaatcattaaattccctgattttgtggatgcaaaattcggtgagcaagctgcagctttgctacaaggttgctgcatcgtaatattacgtgaagggcatgaggatctagagtccataggcatggatccctctgcaattgccattgtttgttggaaaggaaagaccaatctgtgcgtcatggtcactcccatggatgggagggagctgcttgaaaggatctcatttcgtttcgggctcaaaatcccaaaaatcgacgatgggaagcccgacctgaagagtgatgatggatcagacgagcagcctgatggtggcgccgagacggttgatccagaatgcgtgcctgagagcaaagcaccagaagacatggatatcacagacgtcaaggacgctgagtagctcggtttgacaccatgcgaggaagcatgtcatgtctggttatgatgatgcatcagagccccgctacctggcttacgagttgatggttgctatagtgggagagttgttgccattccttggttcttcctgtagtaattctatcctattcctttgccatgaaaaccacaccgcatacatggtgccagactgctagctgctgctcccgtgtaacgtactatcagtttgtttttggtgtgatgttggcacacgactgtcgaacggaactgggaacatgaatgcggagaattctaatttgttttgagatattttgattga

SEQ ID NO: 234 - DNA, 1610 bp, Hordeum vulgare
gcaacgactacggcagcaacaggatcctgcaccacaccatcggcctccccgatttctcgcaggagctccgatgcttccagaacgtcacctgctaccaggcagtggtgaacaacttggatgatgcacatgaacagattgacactgcaatctccactgcactcaaggagagcaaacctgtttacatcagcatcagctgcgacctcccgtcgatccctcatcccacctttagccgccatcctgtccctttctttctctccccaagactgtcaaaccagatgagcctggaagcagcggtggaagccgctgcggcattcttgaacaaatcggccaagccggtcctcgttgcgggagcgaagatgagggtggccaaagcacgcaaagccttcctagagcttgccgatgcatgcggttatccgttcgcggcgatgccttctgccaaggggcttgtgccagagcaccaccccaggttcatcggcacgtactggggtgctgtgagcactccattctgtgctgagattgtggagtcggctgatgcatacttgtttgccggcccgttattcaacgaccacagctcggttgggtactcgctgctactcaacaaggagaaggccatctttgtccagccggaccgagtggtgatcgggaatgggcctgcatttgggtgtgttctgatgaaggacttcctgcgtgcacttgctacccggctcaagaagaacacggccgcgtgcgagatacatagtcggatttttgtgcctcagggagaaccccgtccctctcagcctgaagagcctttgagagtgaatgtgttcttcaaccatattcagaaaatgttgtctggcaacacagctgttatagtagagaccggggactcatggtttaactgccagaagctaaaactaccacaaggctgtgggtatgaatgtcagctgcaatatgggtcaattggctggtcggttggggctactctgggatatgcgcaggctgctaaggataagcgagtcatttccctcattggagatggcagctttcaggtgacggcacaagaagtgtcgacgatgctccggtggggacagaacaacatcatcttcctcataaacaacggtggctacaccatcgaggtgaagatccatgacggtccttacaacatcatcaagaattggaactacacgggcttggtggaagcattccataacggcgagggaaaatgctatactgcaaaggttcgaacggaggaggaactgaaggaggcaattgaggcatccctgggacctaacaaggacagcctgtgctttatagaggtaattgtgcacatggatgacactagtaaggagcttcttgtgtggggagctaggcttttcgccgcaaataaccgcccgccgaatcctcagtgaacacaccaggtctctacaagatgctcatccagcttaatgaggtcatgtgaaagttcacatgtaccgaactctgaataaatcctccatttgagtttcactgttgtcgcaagtgctcatggttactgtacgtaggtgttctcagttcaggaactggtacttgtgtacctaaataaatctgaaaaagacgatgatgtggccagctaaagaagctcttggtct

SEQ ID NO: 235 - DNA, 1400 bp, Hordeum vulgare
tttttgggtcaggttagcaaacaatcagtacactttggagaaaactagcctttttgagtacgagacccattttactgtgatgaattataatggaaggatgaaccatatgaatactccagagttcgtcaaggagtttgagaaggagcatcaagttaaatggctggagattcatgaaagcatacgtgatatgataaggcgtgtctttgagtcaacctcagctgtccatcctgagatgcagaactcattctgcagggccatttatggcgttgatgttatgcttgataatagattcaagccaaagattttggaggtgacatattgtccggactgcacgagggcgtgccaatatgacacacaagctctcgttggaagccagggccccatcaaaggcagtgattttttcaacacggtgtttggctgcctctttctcgacgacttgacgaatgtgtcaccactgtaatagtcttgtcgaaaagctgttgtaacaccaatgttcttgcaccttgagatggattagggatgttgtacgttcatgcatcaaggaactgacatccatgaaaggatagggcacccgtgaactctgaaatgatattgtgagtgaagcttaagatggaatttgcttgtgttgcttgataaatattgctgcttccgattctaatgttgcatgcttataagtttgaactatccaatgttacgtggtcaagtagcaataaactgcacaatgccatgtcatcgcaacactgccgctacatcagtgaatttcctgttctacaggttttaggtggattccaacaggagatatggaatttcagatagcaagtctgagcccatgattttcagcaagttttaaccacgacgttcaagagtgacttgaaaagaaaaccctccatcatcaaaagtatatgtgtctcattctccaaggcaatggtaacgtaacgtagccaatgcagccactcgcacccacagtaacttcaaagcatcatctgccaactcctcaaagcccaaggagcatacaatcatacgcacatgagccgtgactgctgaatgtactgatcgctgatcatacgttcgaggcgtagccatgggcgccacaaccaaccatgccgctcccatctctcgagccatcctttcgctcgtgacgatcatcttcttctccgccgtctgcagctccgacccggacctcctcgtcgactactgcgtcgccgacatgagggccgccgccggcgcgcaccggcacagctaccgctgccaccctcctccattctattttgttcccttgcgccaagcccagcgaggaagaagagaagggaactcgctcgcgctccgctgcagcagcgaaccccgcgccgcagcgaacccgatcgatggcctccgctgcggcgtcgcagcccgcggccccg

SEQ ID NO: 236 - DNA, 1192 bp, Hordeum vulgare
gttccttcgcgctccgcctggggccgcgcttcgcggcgccaacggtggcgagtgcgacgaggggaggaggaggaggaggtggccgccctaccggcagccgagcgctggtgtcaaagaagccaaacaaggaccaccgtttgtggatcagaaaagattcggctgggtcagggaagaaggctctttgtcttgttaatactgtttcaaaactaccgaatgaaaaagaagctgtttatggtgcattggataggtggactgcttttgagcctgaatttcctattatagcagcagcaaaagctttggaaatgttgaaaaaacgaagaaaatggctacagattatccaggtaaccaagtggctgatgagtaaaggtcaggtgctgacatggacaacctacgatacactgctgttggctctttctatggatggaagagtagacgaggctgagtcaatttggaatactatcttacaaacttatacacgctcagtgcccaagaagttgttctctcggatgatccagatttacaacacgtgccatcttccggacaaagttttggagatatatgctgacatggaggaattgggcgtgcgtccagacgaggatacaacaagaaggatcggacgagcgtttgcaacttcaggccaggaagataagcagaagcctgtccttgaaaaatacttgaagaagtggaagtacatccatttcaatggcgaacgcgttcgggtacggagggcaggacctttggcctagtaaacgtcgtctgaatagcttggggcgaacaatgtgagtatcacctcgtctggacatatgcgattgctatcttcttccgaggtcctatgcgagcttgtcagatggaaggaagtgtcggagttgtaatgctctctagacaaatggatagtatcatagtacaggggtgagaaccggcattgctaatgatgttggtgcccaaacatgtgtaagttgtgatgtttcaaacaggttgccgccgacttcgataccatgtgtaggaacaaagtctgttaattttaaccgctacggcgtgtggcatgacaggcacagtcctgctcctgacaaatggtgcagttagagctacggcagtacccatcaaatgtctgcaagtcttttttgtgggtattctacaagatgaagtgtatggtatggtggatctgtcgactggtgcggcgatctaaaatatg

SEQ ID NO: 237 - DNA, 435 bp, Hordeum vulgare
ccgcgtcgtggatggcccggcggctgggtcccgacggcgagcgcgcgctggcgtgggcgcgggacaagtacatggtgatggactactgcgacgacccctggaacctgggccgccccgccgagtgcgacatggaccggctcgcctcggccgtctgattgttttgttccgtcggccataccgcttccacacacgtgtcgtcgtgtattaggcagacagacagacgtggggtgtttgcgttcgtgcttctagttctagcctagcctagcctagcctgctaggtcgtctcactcagatgtgacgtgtaggcgtagcaatggtagtatataggtgtacggatcataccaaggatgattcctgcagaaaccttccatatatatatgctcagataatacaaccatacagtgggtaagattaactcatttgtgaaaaaaaaaa

SEQ ID NO: 238 - DNA, 1389 bp, Hordeum vulgare
cggcacgaggaatatctatttatgggagaaagaaaagcgagtgggatcagatggcaagttggatagtgaataacgaattgtatagcgagaatgttgtttggttaatccagattcctcggatttacaatgtatacagggagatgggcacgattaattcattccagaacctcctcgacaacatttttcttccactttttgaagtgactgttgatcctgcttcacatcctcagctgcacgttttcttggaacaggttgttggcttggatttggtggatgatgaaagcaaaccagaaaggcgcccaacaaaacacatgccaacacctgagcaatggactaatgttttcaatccagcctatgcatattatgtatactattgttatgctaacctgtacacactgaacaagcttcgtgactccaagggcatgacaacgatcaaacttcgtccacactgtggggaggctggagatattgatcatctcgctgcagcatttctcacttctcacaatattgctcacggggtgaacttaaagaagtcccctgtcctccagtacttgtattatcttgctcagattggtcttgcaatgtctcctttgagcaacaactcattgtttattgactaccaccggaaccctttcccaacatttttcctaagaggcctgaatgtttctctctcaaccgacgaccctttgcaaattcacctaacaaaagaacctttggttgaagaatacagtgtcgctgcttcgctgtggaagcttagctcttgtgacttgtgtgagatagccaggaattctgtgtaccagtccggtttctctcataggctaaagtcacactggattggtagaaactactacaaaagaggtcccgacggcaatgacatccaccagacaaatgttccccacattaggatcgaattccgacacaacatttggaaagaggagatggagctgatacatttcggaaacgttaacctaccggaagaaaccgacaggtgaagatgttgcagcagttctcaaagccccgcgcacccatggtcaggcattccgtccatcccgttttctggccttcggagaagcgaacctatgctggtctgtgtagaagagaagaaaagcgcccgccccagtaccttttcgatgagtcttttactcgtgttacctgtataggcagatatatcagcatggaaggataaggagaagacactctaggattccagtggagacacacgcacacactcatcaggctcgctccctgggtacattagttagtgaccttccttggaataaaatccttgcatcttttgcttttattacccagatagtactacgtagattttacagcatgttaaatctggtaatttattcgcgtcgcctccctcactcatttatatcctaa

SEQ ID NO: 239 - DNA, 878 bp, Hordeum vulgare
cccgggctgcaggaattcggcacgaggtgctgcacgaggtcgagcagtcggatcgcgcgaccgccatcgtcatcaacaccattgacgagctcgagcagacggcgctcgacgccatgcgcgccatcctccccgtgcccgtctacaccatcggcccgcttaacttcctcacccagcagctggtctcagaaggcgatggcggcggaagcgagctcgcggcgatgcgctccagcctctggagagaagatcagtcatgtctcgagtggctccagggcagggagccgcggtccgtggtgtacgtcaactacgggagcgtgaccaccatgtcgaagcaggagctggtggagttcgcgtggggactggccaactgcggctacgacttcctctggatcgtgaggaacgacctggtgaagggcgatgccgccgtgctgcctcccgagttcatcgaggccaccaagggcagatgcctcctggcaagctggtgcgagcaggaggcggtcatgcgtcatgaggcggtgggcgccttcttgacgcactgcgggtggaactccatgatggaggggctcggcgccggcgtgccgatgctctgctggcccttcttcgccgagcagcagacaaacagccgctatgcgtgtgtggaatggggcgttgggatggaggtcggcgatgatgtgcgtcgggtggtggtcgaggcgaggataagggaggtgatgggagggggagaagtaggaagggagatgcggaggagggtggcagagtggaaggaggtcgcttctcgctcgaccgcgcagcttggtggccggtcgttggccaaccttgagagtctgctcaaagatgtactgaagtgatcagatcaccaataacaaataattaagctgggt

SEQ ID NO: 240 - DNA, 1518 bp, Hordeum vulgare
cggcacgaggcttgatatttgtggaagaaggaggtcgtgtgttcagctttggtaaagcttgcgacaagtgccgtataaaatctgtcatccgagttcatgagcccttgttctattggaaggttgcaatagaaggaaatcttggcttggcagaagcctatattaatggttgtttctcttttcttgacaagagagaaggccttctgaatcttttcctgattctcattgctaacagagatgagcgtaggagcaaccggattgctagaaaagggggtcggtggacacccttgcatgtgatagctaggttggcacacgctagatacattttgcgcgaagtctcaaggaagaacactgtgacacagactcgtcgaaacatctctctgcactatgatcttagtaatgattttttctcgcttttcctggataaatccatgacctactcttgtgcagttttcaagatggagaacgaaagcttagaagtagcccaacatcgtaaacttagccttctaatcaacaaggctaaaatcaagaggggagatcatgttcttgatatcggtagcggctggggaagtttagcaatacaagcagttaagcaaactggttgcaaatacactggagtcactttgtcagcggagcaacataaatacgcagagagaaaagtcagagaagctggcttagaggaccacataacgtttctgctgtgcgactaccggcaaataccaccttgcaagtatgatgcaatcataagctgcggtatgattgagcatgttggccatgaatacatggatgaattttttgcttgttgcgagtcttacttggctgaagatggcatattggtccttcagttcatctcagccccagaggaacggtacgagcaatacagaagaaggacagacttcataaaagaatatatatttcctggcggttgccttccttcattggcccgtgtaatgtctgccatgaccacgtcatcaaggttcagcatggagcatgttgagaatattgggcccaattactatacaactctgatgcactggagagacaacttcattgccaacaaagacaaaattttggccctgggctttgatgacaagtttatgcgtatctgggagtactacctcatattctctgcggcttgtttcaagttacgagctcttggagattaccaggttgttttctctcgtccaggcaaccggcggctaggcctgccttgatggctgaacgcaacatatcgttctccggtcagctgtagaatggttgctgctcgatagcctacgatcttctaatcagtcaaccctcgaatggtttcttcatacgggcagcctaatcaggtggtttagtgatctatcttcttgttttaatcatgaaatgtttagttttcatggctatcaataaactgtatgtgcgtatgcaagtgctaccttagccttgtcaatagaatttgagaattgtacggaaggaactggtttgttgctttgatatctattagacatacgtgatgtcttggtttgtgattttcag

SEQ ID NO: 241 - DNA, 747 bp, Hordeum vulgare
gactctgcggagcaacctttgcatttcaacatttcacacacaacttctcagattgcccgtggtattgccattaatgctcgtattggcattgatattgaagagaagaagcgaaatacaaccaagaatattttatctcttgctcgccgttacttcaccccttcggaagttaattatctagctgagatttcagattcagatgctcagcgaaaggaattcctgaaactatggactcttaaagaagcatatgtaaaagctcttggaatgggtttctcaggtgctcctttcagtacattttcgatcatgctggatacaagtatgggaattcggatttctaaggcatcgaatgcttccaggtctgattgccacctgtccgagaactggctgtttacactcgcggagctaaatagctctcactacatatcagtttgtatagaggacagctccagaagtcaaggtcctgaagacagtccagcaccagtagggttgaaagtatggaagaccgtaccgtttgtcgaagatacactcgtctctggaacagaagctgtaaaacttattgcctgactactgaaacattgttgtgaaacacacttggtccagtagcgataggttttggtctctgcccactgaaacatcatttttcatgtgtgttggctctcttctcttggtggaaacattgttggtctgagctgccattcaatggctggcactacattaccatatgtatctgttgagtttctttgatcacaa

SEQ ID NO: 242 - DNA, 930 bp, Hordeum vulgare
cggcccgagggaggccatgacggcctgcttcgcccgggtggacggcgaggtcggcgtcgacgacgggaccgacaccggcgagcagacggtgggctccaccgccgtagtggccgtggtgggcccgcgccgcatcgtcgtcgcgaactgcggcgactcccgcgccgtgctctcccgcggcggcgtccccgtgccgctctcctccgaccacaagccagaccgacctgacgagatggaaagagtagaagcagctggtggcaaggtcattgactggaatggatactgtatcctgggagtgctcgcaacttctaggtcaataggagactattacctgaaaccatatgtgatagcggaaccagaagttaccgtcatggaccggacagacaaagatgagttcctcatactagcaagcgacggcctgtgggatgtcgtgtccaatgacgtcgcctgcaagatcgcgagaaattgcctaagtgggcgtgcggcctccaagtaccccgagtctgtctccgggagcacggcggccgacgccgcagcactgctggtggagctcgccatggcacgcggcagcaaggacaacatcagcgtcgttgtcgtcgagttgcggcgactgaagagtagggcagcggcggtgatcaaagacaaccgcagctagtactagcactagtggtaatgtaggagtggctggctggatggggatgtcacattattcgagcagggcgacaaggagagaagagagaaagaatttgcggctgaattcgctgggatggttgtagttttagagggcccagggacgatgtgaccactgttgagttgagtgtgctgtttgtcgccgttgtattgcgttgcgttggttctttggttcttctatatgctgatgactgacgttcggggcgaaacggcaagaaagataagctgctttcgtcagttctg

SEQ ID NO: 243 - DNA, 949 bp, Hordeum vulgare
aggcagattgagattggtgtcatgcagtatcgtgagtctcttgaggagaaggggttgtggaacatggaggagcttgagaggaaggttgccagccaccgtaggcgtcttcagtctgaatatgggttgtcttcttcagtagatggggcaaacaacaggcactcttcagagagaataccatcggaccggaaagaaaggtatgatgatgcacgcgattcttccaagaagcggcctcacagcccaagtaggagccgtagtccttcaaagaaatcatcactggatagagaccgagagcacaaccgcagcagagacagattgcatggtaatgatgttgggagagacagggcacgtgaaaaaaggtcaggccgagagaaggacgatcaccatgatagaagcagagaaagagaaaaggacaggagaaaggggaggtgactgaggtatgttggttctagccctaccaaatatttggctagccaaaatttcggttgaccttttggttgcccatgagttggccaacattggcaaggaaaacgtgctatagtaaccaaaaaggcattggcttgccaaatacttggcaaccatccaaacagaggccagtgttttggacatgaccaaaatattggtagagtaagtttagctaccatgcatacataccctgatacttgaaaatccccctgttgtgcacttgtccttcggctgaataagcgtcttgagcaagcaaatgtttgagctgggctgcatccgccgatacccgacgcatgtaaatgggtgcacatggcctgctcaaagacctgtttgtagcggatttgaggatgtaggtggttctcctaacggaggacctgtttttgtagtatcaaggaacagtagtttgtgaaacatccaatattttgatcaagcaatactgaatgaaatgctgccagttcggggcatgggctgcagctaataaacttgg

SEQ ID NO: 244 - DNA, 626 bp, Hordeum vulgare
gatggaatatgaacaaaggtagcgagaaatggttatgctatggaggcgccgcaggcatcatccgttgtcagaggatctaaaaggcaagcataattgggaagtgttttgtcccacctagtttgttgcatgtttgccgcagaccagggtcatccgtgtatatccacctacacaataagctgtcgcagcacttgctgttacttgcagcaacatatggtatgttcgtccgattctttccttgacctttcaaggggttgccattgcagacgttcagttatgcacaattatacttacataacagagctgtgtatcttaggaactcccagcagatccttgtagtttaggaactcaagttcaggcaatatgagctaccaggtcctgcatatcttgggctcagcaaatcatagttctgagaataaagtgcaccagtctcgaataagtgtgggcttgtccgcaacttttctgaatctggtgaaagtttttttttcatgtaaggctgtaacatatgtacatctattgtttacgcagtcacacaaatacagtaatgtcgtgccagttgtaacattgacaaactgaacaatgtcgcaccaatatgtaacaggccaataatggaaatcatgagccattgc

SEQ ID NO: 245 - DNA, 547 bp, Hordeum vulgare
ggcggcctcgtctccttccttcttcttcgcgcaccccttgtctctactgcaccacgtcacccgcggcttcgccgggtacatgggcctctctcgtctctgccacgcgctcaaggatctcaagcctcgggccgccacttcttcccggctgcatgagcaagggcccggagcaggaggcgctggacatgctgcagatgatggttgcgcggccgtccaagtgcggtcgagaggggtgcctcagaagcctcgtggtccaagagaaggacgaggaggaacacaccactaggcttaggcttagcatagtctgcaattgtaggctatagcgttaacgcccatggggaattggctgcgtgtgttctttctggaaatctgaattcagagccttagagtgagtgcttccatctcttcctgttcttttcagaatacaagtttcaattccaggccgggcatgttgtttacgttcctcacttcagcttacaaaatgctaatttagtaagcaaggagctgttcctgtttgtatatctgtactgtattatagtattatacacga

SEQ ID NO: 246 - DNA, 1296 bp, Hordeum vulgare
cggcacgaggctcattgtcccatttcagttggctgcactgaaaactataggcgatgaagacaaatacttcaccagggtatccctaaggatgccactgtttggtatgaaatcgagcacctcacagaaagatcttcaaaagtccaacacatcagatctttcgttgcaaggaaaggctagctcagagttggcacttgatggttggcatagtattgctctggaatattctgtcgattggccactacaactcttctttactcctgatgttctttctaagtaccgcaaagtttttcagtatctcattcggttgaagaggacacaaatggaattggagaaatcctggacagctgtaatgcatcaagatcatgttgatttttctgattattgcaaggatcagaagaattcctctgcaacacaactgcgccggttacgcacgaagcctttttggcgagtaagggagcatatggctttcttgatcagaaacctacagttctacatccaggttgatgtaattgagtcacagtggaatgtcttacaaactcacgtccaagattcacatgattttacagaactagtgacctttcatcaagactatttgtcggcattgatatcacagtccttcttggatataggatcagtgtctagaatactggacagtataatgaagctttgcttgcagttctgctggagtatagagcaatacgaaacaggggcaaacatgtttgagattgatcacataacggaggagttcaacaagaaatcaaattcgctgtacactatcctaaggagtagtcgacttgcaggaagtcagagagcacctttcctgaggcagtttctgatgagactgaactttaactctttctttgagacaactgcgaggggtgtgatgaattcgggcaggctgcggccaggcacagcgagtacccagctgtaagcctatcaagccatggtggctgttctcgccgttatttgcatgaaaatcctgctacacactgacaatggcgcaaactcatcacacaagaagaggaggaagaatctgtaggatctgtaaattagctgtagcatgtgagttgttttgccctggaaagtaaacacttggtgatgtttgtttggctagtgttgtgatgtgtgcgtctttggggttgcttgcccactttccccatgttattggtatctctactgggaacatggtgtgtggcctcatgaaatggtagcagactagcagacccgttcagtacttcagcaacactgcaaggatatgacaacattgcaactgttctggcaggatgaatgcaacaa

SEQ ID NO: 247 - DNA, 711 bp, Hordeum vulgare
cccggttacagtaataatagcaacagcaatgcttggagcagcaacaacaaccaaaattggagtggttcacatcctgatactagggctaccactaccggcattggttccacaaaccctaatcaagcaacaggctactcaagctacggaagtggaggttatactggaaagagcttagaaggctctgctgtgaaggaccctgatcctctggacatgtccgaggaagccaaggccgagagatggttcaggagggcagcccagataaaggacatctccgagctcgccaacatccccgatggggacttccctgagataatgccgatgaggaagggggtgaacagattcgttgtgagcaagcggaagacgccgttggagaggagattaacctctcttcagtacagaaggaacctgccgatcgtaagctctgagccggacaaagatggtagctgaaagcaggtatatttattccgatgcaagagcgaagagtttacacatggatatgtacttctacttccgatcgtgataaaataagcagcaaggcgaagaaatccacgcggaggagacagctgaacgcccagaacatttttactgtatcctaaagttttgttctcgaccagtagggatttgctgtgtttcatttgttacgtgtatcagttgtatgcatgtgttgtcgtacctgaaaccgcgagtgcaatcatcaaataatttgtacgg

SEQ ID NO: 248 - DNA, 581 bp, Hordeum vulgare
tgttgatcgacaaccaaccagcagagggagggtatcaaaatttcgaggtgatcaatcatccatgccagcggctacgggtatcagtcaagagggaacaggtacctgtcaagagagaaaccatagcacattctgaggatgagagcgtcgctgcccccatggcggtcgttaaggaagaagacacaaccaggttgggcctccaggggatcttgaagccctgctacacgggcaagagaaaaggcaggaagccgaagattctaaggcgcggcggttcatcatccgttctcagctcatggaagagcgcccggactcgaaagaagaggaaatcatagatgcagatcgtctcagtgaatgcacccttattctttggcttcgaatcttccgtttaattagatgatgatgacgacaactgcgaaccttttcctttttttttctttctacctgactgatcgaagccagaagagggtgatggaaaacggcactacggcagcgaagtgcttgtaactctgttttatttctgttgttgttgttgcgtgtggtctttgtcctgaaagagtcaaactttggttgttacagtgttattt

SEQ ID NO: 249 - DNA, 788 bp, Hordeum vulgare
gaacgacagattaattctattttaaatagggagcttgaggcattggtggaacaatcacaggtggaatctgaagctagaagagctcttcatgtagacttggatgaggccaccgtttcactaaatgaggtgaatgagagtacattatttctgtctaataagcttgatagcactgtttccaggatttgtgctattaaagaagagaaagaggtgctttcagcggctcttttggagcaaaagaaaaggacagccgaagctcagaaaaatatggtggacgctcagcatcttattaaaaggctcgggatggagagagagaatagtgaaatcaggaataaaaagcttgaagaggaattggccacagcaaaaggtgagatgttatatctgaggaggcagattactgcaagtgggtcacagaatacagatgttatggaagcaagcccaacaccaaatttcagtcaacctctggaagatcgtgttccaaataccagtagtactgatgctgtacctcctcgttctgctaagaagatctataggagaagaaaagacagaccatcaacataagcattatcagaacatgtgatctaccatcaatcttccatttgctctcatttccaacatttgaatggtagcactttataagaaatgtttttgtttaacttccaacatttgaaagctagcatattagactactctagattatgaggaattgcaaatgtatgtttatctgtgtacaaatgtgttgttgtcttgagtgtgtcatgaattataatatggcgactcatgctatcttc

SEQ ID NO: 250 - DNA, 636 bp, Hordeum vulgare
gaaccgcagtgaagttgaaagggaacttggaatgcttttctcaaagggagggggctcaggagttgggactaaatccaagtactctggctccaagtttagcatggtcgttgaagatctgacagagggtgtgctggtgttcgaagacggggatgatgctgtaaaatactgtgatgctctacagggcggtggtcaaggatgcgagggaattgcagagctagaggcttcatcagttttcaacatgtgccgtcaaatgaaagctctcgctgtccttttccggcgtggaaggactcctccaacgccacaaagccttgagcgtgacttgagggcgaggaaccggtcactggaagactaggatcttctgaaacgcggtgtagatatgttaattgtattcttctagctgttgaagcacaggccatacgccttgtatactgaatggtacatagatgtttgaagccacaaagaaaatgatgcaaaataactggtacatagattcaatgatagccaagatggagtggaagtcaagtctgacagtgagtagtacatatttagcttgagattagcaatctctgtaaaactggatattcttgtaattatttacattgtttacagtgaataaatgagattttaaattactcg

SEQ ID NO: 251 - DNA, 484 bp, Hordeum vulgare
ggttatatatgtcccagatgcaaagttaatgtatgcgagcttccaacggagtgccgaacatgtggtctaacacttgttagctccccacatctggcacgatcttatcaccatctattccctgtatcgccgtttgatgaggtgacgttcaaattaggtcaaaagggaggacaaaattgtttcggctgccagcagagtctcattaacacaggtgggcaatctaatatccatgtccgttgtccaaaatgcaaccaccacttctgctttgactgtgatatttacatccatgagagcttgcataactgccccggctgcgagagtcagcgcagttcatctcgatagggacaccatggtgtgcattgttcaggtgttgatcctttttgagtcggagctgcgcattgttgtaagctttctggtgcactgacattgatgacagtattgctggataatcaaacagtgtacaggtaacacctggcatccttttttc

SEQ ID NO: 252 - DNA, 1956 bp, Gossypium hirsutum
agtatatgtctatatcaaccctttcttcctatttgtgtctttgtctatttaaggtttactgcattttacagcttgattatatagcttcttttgtccttttgtatcatattcccttaaaatcttatcaggttcacgacttcgtttatgtcttagctgaggagaataaacgacttgttgcctatttggaagatttgtatgaggactctaggggcaacaagatggttgtggtacgatggtttcacaaaattgatgaggttgatattgaccttcatcacaattataattgcagagaaattttcttttctcattgtcttcaagatctcagtattgaatgcatagatggattggctactgtccttagtcctttgcatttcaagaaatttttgaatgaggcaacacacactcggctggagccatttgtatgctgcaagcaatttgaaaatgatgttaagccttttgatgtgactcaagttaagggttactggaaacaagatatacttagatatatgtatggtctttctccttctaatgattgtgtgactcgtcagcaacgtgctgacgacctgaaaactgtttgggatgttgatgacgatgttgggattaggcctagaaagagatattgtcgatcaaaagatgatgatatgcacatgcatttcagtggcagtagagagtcaatggatacatcatttgcagatgtgcaagactttcacaaaagcaaaaatggaaatgtatcattcaatttcagtggtaggaattttgcgttcctgtccactggtgaggctaagcaatattcttctcaccatttaatggtaggttctgaggttgaagtgctaactcaagatagtggtatgagaggttgttggtttagagctcggataattaagaagcacaaaaataaggtgaagttgcaataccaagacatccaggatgcggctgatgaagctaacaaattagaggaatggattttggtaaccaaggttgccacttctgatgaagtgggtattcgtgtttctggccggacagctattcgaccgtcttcacaattcactaaaggtagtacttcatgtattggtgttgggtctgttgttgatgtctggtggcatgatggttggtgggaaggccttgttgttcaggagttggaagataaatttcgtgttcatttcccaggagaaaagcgggaatcagtctttggtatcggtgatataagacaatctcaggaatggctaggaaatcggtggataaatatgaaggaaaggcatgatcttgtgagtaccatactctgggccggaaagcaagacgcaagcaaatcctataatttcaataccgacaaaaacaccatttgtgagagtggacagtgtggtaaagaagccactgagtgtaaaggttctgctgttgaaccaggaaatgagagggcacaagatgcgagtgttgttccagatctttcaaaggatggtcggctttctcagttgaagtggaagtcatctaggaagagaaaacgtgtgacttcaacctgtgtacggaaactgaattgcagtcgaaacctcatcaaaagcactgcacagtcagttgcttgtgaacgatttttgatccctgcatccttaaaagtcgataatgagaactgcaagaacataggtgatccgttattcagttcttcagtagtgccgccgctaacaagcttggtaatgactaggtgattggagttgttgctttctgttttgtttggaagtgttaatttcggaagtctggcattggggcatccatctccctctttttttcttgtatgtaactttcagcctatggggctctaacttagagtcttgcaaatttcaggctacagttttggatgcattataataacctggtagatctctaacttactaagcctcgtttgtctaggatgtttccattaggatctctgcttgttttgtattctatttattgtttttggaaataaaa

SEQ ID NO: 253 - DNA, 1244 bp, Gossypium hirsutum
acgagcggccagtatcaacgcagagtacatgggggatccatccatccatccctctctcaatctttatctccttcaattgtttgtttttgggttaaaaagctctgtttttttattacccttttcatcaaaaagcttcaatctttcgaccatgttgcttaaagcttcccctgctttttctttgttgaagaatccccaagttgaaactcgggttcctctgttttcaagaaacggttctgggtttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtatgcctattttgatagggacaacgttgctctcaagggtcttgccaagttcttcaaggaatcaagtttagaagagagagagcatgctgagaaattgatggaataccagaacaaaagaggtggacaagtgaagctgcaatccatattgatgcccctctctgagtttgatcatgcagagaaaggggatgctttatatgcaatggagcttgccttgtctctcgagaaactaacaaacgaaaagctcttgaacttgcacaacgtggctgagcgaaaccacgattcgcagttgactgatttcattgaaggcgagttcttagctgagcaggtcgaatccatcaagaaaatatcggaatacgtggctcagctgagaagagttggcaaaggacatggggtgtggcactttgatcaaatgcttctccacgagggagctgttgcatgaaaacctgaccaaagaaaccgccgcttgcttctgataccagccatcgttcttttaagttcccgtgttagtagttgttgagagattaagttttgcaagttgtatggctagtttagaaaactttgtgttgatgatataagaagattgagagactcgaagggataatttgtaagtcctcttgatcatagctatagattttcatggttttcgacttttcgtatcaacatttttcgactgttttttcttcggttaaatgctctgcacagttagcagataaaataatacaagtagggatcattttgaagtttggattgtgtttctatgaatgaaaaaaacgaagctatta

SEQ ID NO: 254 - DNA, 1085 bp, Gossypium hirsutum
ggatgttgtcttcttttatctgctcacttttctttctgactcagttccgtctctctttttctctctcgcaatattgtctaactaagttcctttgctgtgggagttctcgaaactcgaaccacataataaaaatggcgatgtgggtctttggatacggttctcttatttggaaagctgggtttaactatgatgatcgtcttgttggtttcatcaaggactatcgccgtgtattctatcaagggagtactgatcacagagggacgcctgagtatcctgggagaactgtcacattggagcctgctcctggggaagtctgttggggagctgcttacaagatatccaaggaggaagataaagaaactgcaataacgtatttagaagtgagggagaagcagtatgacaagaaagcttatgttgatttcttcaccgatcccttagctacaactccagccatttctggagtaatggtgtacatagcatctcctgacaagaagcttaatccgaactacttggggcctgcttctatagaagacattgccaagcaaattgttcgtgcggaaggcccctcgggaccaaacagagaatatcttttccaactagaaaaggctcttcttcagattggttgtaaagataaacacttaatggatcttgcaaacgaagcaaggcgcattctttcagaatccgagcatactgcatcatgatgcaaatttgttggaaaggaaaaatgagagaataaatcacaaacctaggaaaaagcatgaatggcattatagatgttagcatcatggaaattgcatgttcctccatgttttgctctggaccgggacacacaccgaaacatagtttcttatagtgtgggacacagtcaccccaattctacaaacaataacttcatccccacaagcaaacagtttctgaaagtgggcgttttccatatttttttccttcatttctaattcgggtatttttccctattaaacctgcttgttcttcgatgacgaaagctatgttaacgtttgattcatcgttgtcccactatgatgatggatttgtttatgaaaaagttaattaaatatgtaagcaag

SEQ ID NO: 255 - DNA, 2760 bp, Gossypium hirsutum
gttcttcattgcttaagaaacgggcttttaactgaaaaaagtgcttttctttgaaaagcaatgaagaacagccatcgtttgctagcaaattctcagaagctgagaagtgcttttggctagatggagaagtagaaatttttagcttttcaaccaaaaagtgctttttgggctggttcatttacttttttagccacacacgaacgcccttctttgctctctgctggttctttgccctcatctctgccctctgctggttctttattcctctgccctctgccctctgccagtgagtttgcggcagaccgaagagagttgccaattgcagttggcgctggctttgcgggtttcttcgctggctgcttctgctgctgattccaacttcttggatttcaattctgatgctaacaccaacagagtttcctcctcctcttcctcttcttcttcttcttcttcttcacctcagcatgtgtctcatcgattctgggtaaatggcattctatcttactttgatagacttccagatggattttaccaagtcaatgggatggatccttatgcatggactataagtgctgatcaaggagagattggcctgatgccctccatcgagtcattgagggccattgatccgcatgctgatttgtctattactgttgttctgattgatagattaagggatcctagtttgaaggaacttcaaaattgggttctcaaaatatctagcagctggatcagcacaaaagatgcaattaatcagcttgcatgtcttgtctgtaaccgaatggggggtgcagcttcttctgaagaagatgtttatagccaatggaaggagtgcaccgaagttctgaaaaactgctcaggctctatcgtatttccaattggaagcctatctgttggcctttgcgtccatcgtgtgttactgtttaagatattagcagacttggttaatctaccatgtcgcatcacaaagggttgcaaatattgcaggagggaagatgcttcatcctgtcttgtgcagttgggtcctgacagggaatatttggttgatttgtttgaggagccaggagccttaagtcagcctgattcctcactcaatggtacttcatcaattttagtttcttcaccgctgtgtcatccaagatttaaaccggttgagattgctacaaacatcaagacattggccaaactctatttcattgatgatcaatcccataaacatgcttgccttgatgcttcctcagacaatgctagcaatcaaaatgagcaaactggtccacagcctaggaaagcatttgatagaaactactttaacaagaacaaccccttttccaccttaagcaacaacaaagaatcttctctttcacctctgcaccagagcactttgtggaatattggctgtgataaagatcttcagatgctgaactcttcaaaattgttcccaaaagccatcaactcaacacacttgatcagaagtcctcctctgccaagttctgttacttctcacatgcacaaagatgtttatcaagcttttccatactcagatccaatgcaatgtactattaacttcaagcaatcagatgatccagtaatgagctttgaccaggaagatctaaatattccttggagcgaacttgttttaaaagagagaattggagcaggttcttttggaactgttcatcgggctgaatttcgtggttgcgaagttgctgtcaaaattctcatggagcaagattttcatatagaacgcttcagggaatttttacgggaggtttccatcatgaaatgtttacggcaccctaacattgttctgtttatgggtgctgttactcaaccaccaaagttgtccattgttactgaatatttgtcaagacggagtctctttcgacttttgcagatgcctgatgcttggaaggttttaaatgagaagcttcgcttgaacatggcattggatgtggcaaggggaatgaattatcttcatcaacttaagcctcccattgttcatcgggacttgaaatccccaaatcttttggtagacagtaattatacggttaaagtctgtgattttggtctttcacgttctaaggcaaatacatttctttcatcgaaaacagctgccggaacaccggagtggatggcacctgaagttctatgcaatgagaattcaaatgagaaatccgatgtttatagctttggagtggttctgtgggaacttatgacactccagcaaccatggaagcatttaaacccaccacaggttgtggcggctgtaggtttcaaaggtgaaaggcttgagatcccaagccatgtaaaccgagttgtagcttccttgattgaacagtgttgggctcgtgaggcttctgaacgccctcccttctcccatgtcattcaatgtttgcagcaagtcatccaaaatactgcatctcaagaacttaatggactaagtctttgatccacaacatatatgggtatgtccaatttttcatgcaaatatatgaaaactttagacaaaattcaacataattgtattaacgcatatccatattaaagacttgccctaatccaaatcacatgggtgatatcctcctaattatcaatttttattttaaaatattatcaaacatctttgataggattagttcattaaataaggttgaatgcatgtagtcttgggagcaaatgtgcgattcttctaaatgttatttcgattaaaaagaattagtataatataatttattatttgctagtagctgacctgcgcgg

SEQ ID NO: 256 - DNA, 1214 bp, Gossypium hirsutum
ccgcgcaggtgagttagggacctgtttaacaaggcaaaggctaacgtccccatgtttggtgttcatcgatgagattgatgctgttggaagacagagaggaactgggattggtggagggaatgatgaaagggagcaaactttgaatcagctgttgactgaaatggatggttttactggtaatactggagttattgtcattgctgctactaataggcctgaaattctggattctgctttgcttaggcctggaagattcgatagacaggtaactgttggattaccagatataagaggaagggaagaaatattgaaggtacacagcgacaacaagaggctagataaggatgtttcactcagtgtaatcgccatgagaacaccgggattcagtggtgctgatttggcaaatctcatgaatgaagctgccattcttgctggtagaagaagcaaagacaagatcacgatgaaagagatcgacgattcgatcgatcgaatcgttgccggaatggaaggaacaaagatgacagatggaaagaacaagattctcgtggcgtaccatgaagttggccatgctgtatgcgcgacattgacaccaggccatgatccagttcaaaaagtgactttgatccctagagggcaagctcggggtctaacatggttcataccaattgaagattcagatctcatttcaaaacaacaactctttgctagagttgttggagggctcggcggtcgagcggccgaagaggtaatctttggtgagccagagattactactggtgcagcaggggacctgcaacaagtaactcaaatagccagacagatggtgacaaagtttgggatgtcggaaattggaccatgggcgttaactgatcctgcagtacaaagcagcgacgttgtgttaaggatgcttgcgaggaattccatgtctgagaaactcgctgaagacattgattcatcggttaagaaaataacggaaactgcatacgagattgcaaagaaccatataaggaataaccgtgaagccattgacaagctagtagaagttttgttagagaaagaaactcttacaggatatgagttcagagcaatcctgtcagaatttgttgatgaacctgtaataaaagtagatagaactcctgttcgtgagatgatcaacgcttgagtcgctatatacatgtaaataaatttacacgttattctataaaatatatatt

SEQ ID NO: 257 - DNA, 1317 bp, Gossypium hirsutum
ggtttcaaagttggggtttggctgtatgggtctcactggaggttacagttgtccagtctctgaagaagttgggatatcgattatcaagcatgcattccacagaggaatcactttctttgatacatctgatatctatggacccaaaactaatgaaattttggttggaaaggcattgaagcagctaccaagagagaaggtacagctagccacaaaattcggtttcgaaaaactggattcaacaggtatcaaagtaaacggtacacctgaatatgtccgtgcctctatcgaggctagcctaaagcgcctagatgtggactatatagatctctactaccagcacagagttgacaccaacactcctatagaggatactatgtctgaactcaagaagttagtggaagaggggaaaattaagtacataggtttatctgaagctagccctgaaactataaagagagcacatgcggttcatcctataagtgctttccagacagagtggtcgctgtacactcgtgatatcgaggatgaaatagtccccctttgcagggaacttggaattgggatcgttccttatagccctcttggtcgcggtttctttggtggcaaaggagtggtggaaactgtgcctgcaaatagtcatctgctatatttcccaaggtttcaaggagaaaacttggacagaaacaagatgttgtatttgaaagtggagaagttggctgagaagcatggatgtagccctgcacaattagcacttgcctgggttcttcatcaaggggatgatgtagcaccgattcccggaacaacaaagataaaaaatctggatagtaacattgattcagtaaaagtaaagctcacagcagaagatttgaaagaaatttctgatgcggttccgataaatgaggtagcaggtgatgttttgcctgatagatttagtcaattacactggaagtttggtaatacaccaccaaaggggagcaaagtttcaacctgaaaaaaaccatggatgccaagtctgcagcaaaatatgaagttttggatgaacggactctccaacaactcaaactattgaaaaattgtatcaatgatttagtaagcaatttggttagagtactaatgaagggttgagtgagagtagaagcctgcattaccaaaccaaaacaaataagcagttttgtattgtgtttctgcctgtgatatgtagctagtaatcttccaagttatgtagtttgaaaatgaaccaggttgtttgtttatcacctgaatgctgctagtaacagcagcattattgtattaggtttctactacctgctttacttg

SEQ ID NO: 258 - DNA, 3127 bp, Gossypium hirsutum
atttacaatgagcaaattggggatttactcgatccaactcaaaggaaccttgagataaaggacgatccaaagaatggattgtacgttgagaatttgacagaagaatatgtttctagctatgaggatgtaactcaagttttgattaaggggctttcaagtaggaaggttggagcaacaactgtaaattccaagagctctcggtctcacattgtttttacttttttcattgaatcttggtgcaagcagggagcttcatcaaaatgtttcagcagttcaaaaacaagcagaatcagcttgattgaccttgcaggattggatagaaacaaacttgaagatgttggtagacaacatgtactggaaggcaaaaatgtcaagaagtccttatcacaacttgggtatttggtgaacactcttgcaaaagaaactcaacctgaaaaacctgaagatgttccatatgggggttcctgtttaacacgtatattgagagaatcccttggtggcaatgccaaactcacagttatttgcaatatttctgcaaacaacagaaatacaagtgaaatactgagcactcttagatttgggcaaagggttaaagctgtcagaaacgagccagtaataaatgaaatatctgaagatgatgtaaatggcttgagtgatcagattcgtcaactgaaggaagagcttataagagcaaagtctgatgcatatagctcagttgggagtaaaagtggatattttaaagggtggaatgcacgtgaaagcttgaaccagttaagaataagccttaaccgctctctgatccttccacgcatagataacgaatacgaggaagagattaatattggcgaggaagatgtaaaggaactacgtcagcagctagattatttagatagctcttgtgagacaaacttaagagatccattggacaagagaggttccattcaatcttctgtaaaagaaagttgtgagacagacttgctgagtgaagatgacattcattgcccaaaagaaacagagatagaagaaattgatgaagtggaagttcctcccatgtccagtcctgagccagctgatgacctttcagttacatcaaaaactttgaaggctgttgatccttcaattagaaatagcatctccatcagcccacatcgtcggtcttcaatccttgaagagcctacattgtctgaatctcccaaaattgcaaataatctaaggaaaagcatggctgttccgtcagcacttttggccagtcagaaaaatgtatcagagagttcagagtcagaggtattacgagagttgctcaaatatagtgaccacatcaggtcctcattacgtacaagcaagacgtttttaggacctacagagtctttggctgcaagccttcaaaggggccggcagattattgatcaacaccagcatagttcagttcccaacagatcttcagttgccttctctttcgaacacctgatgctgaaaccttctccagaagcagacaaggccaatgcttctgttcaaacattaccaaatgacaaaccatctccggatggttcttctactcctttgttttgttcatcttgccaaaggaagtttgacaataaccaccctgatgaggttcaggatagcttgaagacatggattgtaacggttgataaccaacagagagatggcaggaacacagtggaagaagcctccaaaaaagagaaaacacttgaaagtgtttgtaaggagcaagcagccaaaattgagcagttaacccagctggtgaaaaaatacaaacttgaaagagaaaattctgcaattgaacatgctcctgagcctctgaagaatgaaataatactgtttgatgagcagtccaacaatggtgaaaatggaaaagaatattttgatatgactgaaaaggaagcacttcttcaggagattcagacattgaaaagtaaattgcagtcatatactgcttctccatctccaaacaagtctactgaaatactgaggtcctctttgttgtcacgttccattcaattgcgaaaaagtgtagactgtcgtaataacagcgaggaagaacttgagcgagaaagacaaagatggatggaaatggaaagtgactggatatccctgaccgatgagctcaggatggatctggaatctaaccgctgccgtgccgaaaaagtagagatggaactgaaattagagaagaagtgcaccgaggagttagatgatgctcttagcagagctgtcctcggtcatgctagaatggttgaacactatgctgatcttcaagaaaaatacaatgatctggttacgaagcaccaggcgataatggaaggcatagcagagataaagaaggcagcagcaaaggcaggaagcaaaggtcatggtgcacgttttgccaaatccctggcggctgagctctcagctcttagagtggaaagggaaagggagaaagaacaattgaaaaaagagaacaaaagtctcagaatccagctaagagacacagcagaggcagttcatgctgctggagaactcctagttaggctgagagaagctgagcaagctgcctcaattgctgaggagaactttagtaatgttcagcaagagaatgaaaagttgaaaaagcaagtggataagttgaaaagaaaacacaagatggaaatggtgaccatgaaacagtaccttgcagagagcagattgccagaatctgcactacaaccattataccgagaggattcagatgtagcagcatcacacaacagcagtgcaattccatatgatgatcaggcttggagagcagaattcggagcaatatatcaagaacattactaattcatctaaaacaaatctgaccttactttggtcagaatgaagatatgtatacctatgttgtttgtgagtgtcggatacgaatatgtatcttacacaatttaattcttttaaaatgttttttttttgtgtgtaaaagttacaagtcaatcttatacccatatccggatatatgtatgttggacatgggttagagcaagagggacacatactactattcttgtatttttattttttatttttgatcaaaatactactattcttgtattgaatgcatcatctctaataatatttatttttgagtctaaaa

SEQ ID NO: 259 - DNA, 897 bp, Zea mays
ctttttaaagtgtaactttattctattgcgattttcacaaaaagaaaacaagaaaccgaattctctagttggtgattctggttgcattctcatgttttgttatttttcaggccgctgatatactggccaaggaaggtatcagtgccgaggtaatcaatcttcgctcaattagaccgctggatagagctactattaatgcatctgtgaggaaaaccaatagattggtaaccgtagaagaaggcttccctcaacatgggattggtgcggaaatatgcatgtctgttgtagaggacagctttgagtatcttgatgcaccagtcgagaggattgctggagctgatgtgcccatgccgtacgctgccaaccttgagaggatggctgttccacaggtcgatgacatcgtccgggcagccaagcgtgcttgctacagggcagcagtaccgatggcagcaaccgcctagtccagcagaaccctgcatgttgcatttctttgtctaattttaatgtccgtgctgcagaaagacgtgtcacataatggtgtgacgagtacccactgccgctgcaactcaactatagcatgagctgagtttttgtagagccaccgagaggtgttcagtactccagttccagttccgcttatcttcgccgccgcagccggaaggctgcgcatgactctgcgtctgttttatggttcacgaatgattgcagatttgcagcagagcctctggagatgagaattttacttgtggcgagatgttgtgagtaacttgtattcagaagggggaactctcaagagatcctcaagtcgtgattccagttgcggctttcttgatagtaacgtactccctctgttttttagttgtcgctggatagtttaattttgcattattcagtgat

SEQ ID NO: 260 - DNA, 2729 bp, Zea mays
ttgtgcaacaaatttgaactatactttcaactcgataatcaatctaaacggtagtgcctttaactggaaaaccctaattaaatggcaactgatcaacctacagctacaagcttacaactccacgagcttccacggctcagcgtcggcgcgcagggccatgacagctccgagggcgctaccagtaccaccgcacaccgcgcggcgcgcccagggccgccacccccgttccacgcctgcgccgccgccgccgccgcgccaccatctccatccacagcagcagggggccacggcgtccgtgctgggcgtcggcgtcccgagagcctggctctcgcagcgcaccccagtcctcggcctccgcgcctgggtcctcgtcgccgcaggcgctgcggcggccgccctcgccctcttctgcctcgccgtctgcctctgccgccgctgcagccggcgccgcgcaccgcgcctggccccgtgcccgcatcggcccggcgccagcaagtccctcaagcaccgcgtgcatgcgcaccatcaagcagcgacaatgccgccgctcccgccgccggccaacaaggacgccgaggaggctgccgctcgctggcgccccgcttcgttcgaacagccgccgatccaggccatcaaggcggagcagaaggcgccgctgatcctcgcggagcatttcgcgaattcgacgagcggcgagagcaccgcgagcgaccagggcggcagcgatgcggaggttccagaggcggcgcggcgcgggtggggccggcggtacacgcgccgcgagatggaggaggccacgggcgggctcgccgccgccaacatggtgggcgaaggcgggtacggcgtcgtgttcaggggcgtgctccgcgacggcaccgccgtcgccatcaaaaacctccacaacaacaggggtcaggccgagaaagattttcgaatggaggttcagacaatcgggcgcgtccggcacaagaacctggtgagtttgctcggctactgcagcgagggagcttgcaggatgcttgtttacgagtacatggagaagagtaatctggacaagtggctgcaccacgacgacagcgaaaccagctcactgacctgggacatcaggatgcgcatactccttggaacggccagagggctggcctacctccacgagggtctggagcccaagatagttcaccgcgacatcaagtccagcaacatcctcctggaccggcagtggagcgccaaggtgtcggacttcgggctcgccaagctcctctgctcggagaggtcctacgtcaccacccgtgtcgtgggaacgttcgggtcggtgtcgctttttctctgtttttttttcgcagggagagagggctgttgtttcagttcaagggagttcgtcatcgtctcccgcgtgcgttgcaggtacgtggcgccggagtacgccgagaccgggatgttgaacgagaggagcgacgtctacagcttcggagtgctcgcgatggaggtcatgaccggcaggactccagtggactacactagaccagccgacgaggtgaacctggtggagtggctgaagcgcatggtcgccgaccggagggtggaggaggtgctggacccgaggctgccggagccgccgccgtccaaggcgctgaagcgggcggtcctggccgcgctccggtgcgtggacccggacggcagccagagacccacgatggcgcacgtggtccatatgctcgaagacgaccagattctcagagacgaattcaagctcgcgcgggatctgtctcctcgggagtcggatagctacgaacgcgaacacagcaggtgatggatgggaggcagggcagcagtctgggacagggacaggacactgggagggatgttaataatagcaagatgtttttgctcgtcgtcgtttccgacggtgaagccacgcggaggatagccatggccgccttactccaccaagcggctaccccgaccgcaaaaccaccccaccgcccatgggctctcaactccacacacagccgcctctcaccgctctctaaacgacggcgcgccccagccatccgctcggcggccacggacagcagcttcagctccggcgagacgccgtccaagaagaccacccggaaggagaagcaacaggagcggcggcggcagcaggacgtgcaggaacggcagcagcagctcctggggatggaagaagcgtccctggcgaagcaagacggcggcggcagcaacggcgaggttgacgacgacgacgagcttccgcagcccgtgttcgaccgcatcctgcgccggatcgcgttcacggtgggccttcccatggcgtcgggcgtcgcgctgctcaacgtgtacgacgcgctcaagcgcggccagggggtggtggtgccatcgtgggtgccattgctgaccatcctcgtcgccttcggcacgtcggcgctgggtatcgcctacggcacgctgtcggctagctgggaccccgacaaggaagggtcgctgctcggcatcgacgaggcccgggccaactggcccgtgctgtggcaggaagagattgagaagcagaaggcaaagcagaagaagaaatgaccggctggacatgagactgaaaatcttgcgcaccttgctactgatcatgtaatattcgttgggggtatcgatcctacctttcagtaaaaagaaaatataaattagctgagtaatacacaagtactgaattttgaatagagaatactataatagcg

SEQ ID NO: 261 - DNA, 3644 bp, Sorghum bicolor
aatcccaagcgaggcgtggcgaagcggaggcggagcggaggcgcgcgcgctgctgcgggctcgtctcgtccttggcgagaggagggggggggggccggccgggggatcgaattcggcgggggagccagcgcggtgggggcgaatggctggcggggcggaggtagcggtcgtggaggacacggcggtggtgggggcgccgactgcgacggcgacgccgccaccgcctgacgcggccggtggcgcggaggaagggatgcggatggagggctggctttacctgatccgatccaaccggttcgggctgcagtactcccgcaagcgctacttcgtgctcgaggacgccgcgctccgctgcttcaagtccgcgccatcctccaagcgcgaggatcctgttagaagtgcaataattgactcttgtattcgtgtgacagacaatggcagagaaagtttacataggagtgacttttacatattcacactttataatgcttccaatcattatgatcaacttaagttgggtgcgagaagttcagaagaagcagctaggtggatcaggtgcttaatggagtctgccttaaagtcccctagaaaagatgagcacattgttgcttgttcacacagaagatggcaggctttcagacttgctatcgatgttaattcagaaaatcctcatgaaattagctgtaataatttgcatcctactcactatccaaacaccatccagagaggtaaccttaccaattcagagaaaaggttgagccgccgcaatagacaaatgcactcaatagattggactttattttcatctgctcataacgatccaatggcatctgatgttattgcaccttctccatggacaatatttggctgtagaaacgggttacgtttgtttactgaggcaaacgatggtggctctcgtgggaagtattgggatgatcatccagctataatggcagttggtgtggttgatgcgaattctgaggctgtcttccagactctaatgtcccttggccaatcaagatctgaatgggacttctgtttgcgggaaggaaaggtggtcgagcatcttgatgggcatacagacataatccataagaaattaagaggcgactggttaccatggggaatgagaaagagagatctattacttagacgatattggaggcgagaagatgatggaacttacgtaattctataccactctgttttccactacaaatgtcgtcctgagagaggctacatccgtgcatgtcttaaaagtggaggttatgtaatatcaccagtcaatcaaggaagacaatcagttgtaaagcacatgcttgccatagattggaaattctggaagtcttatctgtttacatcatctgccaaatatatcactatacgtatgctaggcagagtagcagcactacgagaattcttcagagcaaaaaatggtaattgtgcttgcatggagttctcatctggtgagttgaccagggacatgggactaccacaaggtgaaaatcagcgaataaatttggagattcagcaagaaaatgagaacagaagacttgagggtcctactgaaggatcagtgggtggttctaacaggcacttaaacagtaccagttcctttgttcaacttaatgacgcgacagacgagttctttgatgtaccagatgaatcagaatatgatcaaagagaagttatgtttccttctgatgagagcacacatgcttcggatcagcgtcatgctaaattgtccaccgctgctgtttttgtaaaaaggttgcatgatcttgcagtccagaaaagaggatatgttgacttacagggagctgcagatgctgataatgggccatgttgctatggatatactcttcccaaagattcgagctatgcagtaccttctacttgggcaatgacagatcctacaacattcttaatccggggagagacttatttgcatgatcgtctaaagatcaaggcaaatagtaccctgatgcaaatggtaggtgctgattggataaagtctgataagcgtgaggatgatctagctggtcgccctgggggactagtccagaaatgcgcagcacaaggaggcaccaaattcttcttcgttgtaaacatacaggttcctggttcaacgacatacagcttagctttgtattatatgatggatacgccattagaaaaggtccctctgcttgaaagatttgtaaatggagatgatgctttcagaaattcaaggttcaagctcatcccttacatctcaaagggatcttggattgttaaacagagtgtgggcaagaaagcttgcttggttggacaagcattagaaatcaattatttccgtggaaacaactatttggagcttggagttgatataggttcatcaacagtggcccgaggtgtcgtgagcctagtgcttggctacttgaacaatctggtgatcgaaatggccttcttggtacagggcaacacatatgaagaactcccagaattcctcctaggtacctgccgactgaattacctggatgcctccaaggcagtatcgatagacgagtgctagaaggaccccaactgacctcattctttttgaagactgtacatcaaaagaccaaaaggctgaatccattccttgctgccgacacaatcggcagccccagatgctccttgtattgcccccgccaaaagtggggatccactgcagacgttgtacattctcctctcgccgactgctcaggtattgtgttgtaatgatgatagcaatccatgataaaaggcccccattctttggcatcttatcaccacgaaaaaaagaacggaaagaaaagaagtgtattctaatccttgtaccatggtgtcccatctgacctgagtgatgtcagatcgttggatctaacagcaagcaaaccattaactatgcattgaccaggagagcaatagctggaatgattgtatttgagaactcgcggttcccccactttgaactgaaagggatccccaaccaaaatagcagtgatcatgggtgctcagatcgcttgaaccgaaagcatcaacaaggagtggagcttgcgtctatcccttaagtcctcgctcctctacaaggacagcatgataaaacggtggtttcatcatcgctgcatcatcgcgctcgggcgcactgttttatgctagcggtagcatcagcttttcgaatgttcattgttcgccacgctgtgtggtccttcaagtgcttggagccgccgatgtgacggctgaacggccgggatcgcttttgctgtgccagtcgcacttttgatccaacgacgtgtcggtcgcgtgcaatcttggttctgaggtttcggtcagcgtgcgaacatggcacggacggtgggattactgaactggatagcgcgatgcacgggcgcgtgccggtccggcccttcacgtgtgtccggtgtgcagtgcaacgtaattagggcacctctaaggacacctctgctagctcttataaatcaaggcagcaaattgctgccatggaacacctctgctagctcgtaggcagcaaattgtaattgaagagagacattttttattctcatgttaggttcagaaggactactaaaatatatttttcgtgggagacctatgaaagttgccatctaaaaaagattgag

SEQ ID NO: 262 - DNA, 963 bp, Sorghum bicolor
acgccggacccgtccccggccgcgccgctgccgctgctgcgcaccacctcgctgcccaccgagaccgaggaggagcgctggcgccgacgcgagatgcagagccgccgccgcctcgaggcgcgccggaagcgccccgccgctgcagccgcggacgcgaacgcgaacgccgccgtcggcagcgggaggaggtccaacgcctcgcaggggagcaactctgtaagcaccaccgagcaaggtattggtggaagcgcaattaaccagtccacagatgctaggagtccatcaacctctgataacacaaatcaaaatagcatgcttcctccaaccaaagcggctgagaagccactaaatggcactcccacagagcagcctcgcctgcggacgcttgggtccctcacaacacgtacgagcagtaccagtgacatcaggaagctcatgatggaggacatgccaatggtctcatccaaggtagaagggcctaacaccaggaggatcgacggcttcctgtacaggtacaagaaaggcgaggatgtgaggatagtatgcgtctgccatggtagcttcctcactcctgcagagtttgttaagcacgctggcggcggtgatgtgtcgaatccgcttcggcatatagtcgtcaaccctgctccattctcatgaacagggggttacagggttaaactgctgctggtatctactgtgctgtaacatgtaggctccctgtttcggggagttcaacggaaggtctctgtattttacataaattgagtgtgacagcaaattcaagagaaatgtcatctgcaaatgttataggcttgtctacaaattgacaaggattcagttgctgcaataggtgggtcgtagtctggcaccctggaggacatgcaggcttacaacacgagcctgttctttaacattaaatcgctcaaattcactttaatttttgcaaacttactgtttcctttc

SEQ ID NO: 263 - DNA, 898 bp, Sorghum bicolor
gcaatggaggccgcggtggccacgagtacgagggtgccgcccctccctctgccgcccaccgcggtgaggcccctgctcccgtcgggcctggcgcggtcccgccgcgggttcgcttcaatctccgacgcaggcggaggtggaggccgcgtatctggaggaggaggaggaggaggcggcggcggcggagacgactccggtgccggcgccgcagcgggcgccgcggctgtggcggctctgggtgaggccgagcagcaggcggacggcggcgactccgacgcaatcgtgctccatgtcgggggaatgtcgtgcggcggatgcgcggccaaggtgaagcggattctcgagagccagcctgaggttgctgcagctacagttgatgtcgaaaaggccaccgccattgtatggacaacacctgaagcgaaggctaccaaagattggcaaaagcaattggccgagaagcttgccaatcatctcacctcttgcgggttccagtctcatgtgcaagacgaaggcgaagctgaacaaactgattcttgacctcagcagtgccttatgtatgtatgactatgagtgaccaggaagttttagcatggaggggtccttgaataaagacaatgtctcctattcctactactacttcagaagttgtacacgcggatctactatgtacatttgattgagagttatatagttctatgagtgctcagcaagttttacgccattatattgttgttagggacacctgaagtcctgaactattgaaggcaaactagtgataaaataaaaaggcaaaaaaaaagctttgacagcgttgtaaaatgattccctacatataagtatttggtaaatcttgtcctcagctttcaatatatgtgtgcgatttatgtttgctatcttc

SEQ ID NO: 264 - DNA, 559 bp, Sorghum bicolor
attgtcctccgaggcagcagcgtcatgaagcgctacctcaacaacccggaggcgaacgacaacgccttcaggggacgtcggcgtcgtgcaccaggatggatacatcgagatcaaggaccggtccaaggacgtcatcatcagcggcggggagaatatatgcagcaaggaggtggaggaggtgctgttccgccacccggccgtggccgacgcggcggtggtggccatgccgcacccccgctggggcgagacgccgtgcgcttttgtcgtgcccaggaacaacgctgccgagctcagtgaggacgacatgctcgcgttctgccgcaagcgcatggcgcgcttcatggttcccaagaaggtgcaggtcgtcggagcgctgcctaggaacgcgctcggaaaggtcgagaaggtgaagctccgggaggcggcacgtaagctggcgccctccgtaccggcgcagaagcccaaggggaagacgacaacctcctcgacgacggtcggcggtcgccgcgaggaccagccggtggcgcacgtcatggcggtgtcaaggctattggtggcc

SEQ ID NO: 265 - DNA, 1688 bp, Sorghum bicolor
ccgaactgacatggccggccacgcccagtcgtggaggacgtacctgtgctgcggcgcgggcggcagcgcggcggtcgaggacgacagcgggtcgacgacgcggcggcggaggatcacacggcggaggggcaaggacagccctcgctcgtcgtcgtcgcggatgtcgttcacgagcctcagctcgtcggagatgctgtcccctgaggacctgtcgctcacgctgtccgggtccaacctgcacgccttcacctacgccgagctccgctccgccacggccggcttctcccgcgccaactacctcggctgcggcgggttcggcccggtctacaggggcgccgtcggcgaggcgctccgcccgggcctccgcgcgcaggacgtcgccgtcaagtacctcgacctggaaggcggcacgcaggggcacaaggagtggctggctgaggtgttcttccttgggcaactgaggcacaagaacctggtgaagctcatcggctactgctacgaggccaagcaccggatgctggtgtacgagttcatgagcttcgggagcctcgagaaccacctcttcaaaagtgttaacggcgccctcccatggatgacaaggatgaagatcgccgtcggcgcggccaagggcctcgccttcctccacaacgccgacccgccggtgatctaccgcgacttcaaggcctccaacatcctgctcgactcggactacaacaccaagctgtccgacttcggtctggccaaggacgggcctcagggggacgagacgcacgtgacgacgcgtgtgatggggacgcacgggtacgcggcgcccgagtacatcctgacgggccacctgaccgccaagagcgacgtgtacagcttcggcgtggtgctgctggagctgctcgccggccggcagtcggtggaccgctcgcggcggccgcgcgagcagaacctcgtggactgggccaggccgtacctgaagcaccccgacaggctgtaccgggtcatggacccggccctggagtgccagtactcgtgcaggggcgccgaggtggccgccgtcgtggcgtacaagtgcctgagccagaaccccaagtccaggcccacgatgagggaggtggtcagggccctggagcccgtgctcggcatggacgacttcttccccgccggcccgttcgtgttcaccatcagcgtggaggaggacaaggtggtgggcgtcaaggtggaggtggaggagaagctgccgcagcagcaccagagccaccaggacaggcaccggcagaagtaccccaactcgtcgatccacgccggcggcattgtgctgcacggccgggaagggatggtcggcggcgatgactacaccgccacgctccggcggcagcggagggcggcggcggcgagctaccacaaggagaggggggcttaattaagagcaggagcggggatatgtgtgtgcgtgtacataactacatactagagaggtgacacaatgtcactttggcttggtttagtatttgagattgtgtgattcttgtttcttttcttctagatagtgatagcgatgttactaggtgttaggcgatgatacaggtatgcaaaaatagtgtgatgaaaagtccggatcggacttgcaaggtttgttgcacttgcacaaaggtgttgtgtaaaaggaaatggcttggtaaaatggtcatctaaattct

SEQ ID NO: 266 - DNA, 1225 bp, Sorghum bicolor
gcatacacagccacctgccagctttggcgatcgagcaacgacgacggacggccggccggacggacggtggacatggagcgcggcgacgactgccagttcatggtggtgcaccagtacgacgaggcggcacagctcatgcaccagctgatggtggcggccgcgggggaccagcaggaccccaacgcgggcgcggcggggcggggagccggcggcggcggcggggagaggaagcggcggttcacggaggagcaggtgcgttcgctggagacgacgttccacgcgcggcgcgccaagctggagccccgggagaaggcggagctggcgcgggagctgggcctgcagccccggcaggtggccatctggttccagaacaagcgcgcgcggtggcgatccaagcagctcgagcacgactacgccgcgctccgggcgcggtacgacgcgctccacgcccgcgtcgactcgctcagggaggagaagctcgcgctcgccaagcaggtggatgagctgagggggaggctgcagagcgtcagcgagcggcaagaccagagcggcagctgcgaggtcaacgacgccgcggacgacggcaagaggaacctaaatagcaccaccaccacctgcctggtgctggtgcaggaggacgatggtgccacgccgccggccgcagtagacgcctccggctccgaggactcggcggcgaccgagtacggctacggctacgactacgaccacgtcgtcgcgtacggcgagggcctgcacgatcccttgtgcgccactccggacctgtgggatacatggccgctgctggagtggaacgcggtggcatgaacccacgaccacgagcgaggaagaagcagcagtcgtgtactcgatcatctctcatgtctcttcttctgtatcgtcacagtgtacgtgtacgtgtacgtgtggtggattcatggtgattcagttgatccgtggagagattgactgacgggaaacagatagagatagagctagctgtgtattgatcaggaatcagctggagggggatcgatggatggaccatgaaagcttcatcacgcattgtacaccagggctcgagcgaggggacgatcgatccgtcgtcggcctctcgatcggccgccgtgcatcttaggatccatgtccgtgagaggtgtgattcgatcagagccgaggcaatggtgtcgcacgcacgtggttaatttacgcatgctgttgtgttgct

SEQ ID NO: 267 - DNA, 1059 bp, Sorghum bicolor
ggtttacgcttgggttggcagcatgcacttaaaaagcaccaccacaccacaccacacgccaagaaattaaaaagcaaccggccaacgagtcacagcatagagatgacgctcccgcgccgccgccaccttgtcctgctcgccggcctcctggtcctcgtcgtcgtcgcggccaccgccaccgcgtcgacggattcctcttccaccacggcggtggcggtggacttcgtgcggcggtcgtgccggtcgacggagtacccacgggtgtgcgagaccacgctggtcccctgcgcggcgagcgtgggtcggagcccgcggcggctggcgcgggcggcgctggtggtgggcgccgaccgcgcgcgcaactgctccgcctacatccacggcagccgcagcggcagcggcggggcgatgaaggactgcgcggagctggcgcgcgacgcggaggaccggctgcggcagtccgcggcggagatggagcggatgggccgcgccggcaccccgcgcttcgcttggtccctcagcaacgtccagacctgggctagcgccgcgctcaccgacacctccacctgcctcgactccctcgcgcagcacaaggaccgcggccgcggtggcaagggcagcgacggcgacgacgatgccgtcagggtgaagaggagggtggtcgccgtcgcgcaggccaccagcaacgcgctcgcgctcgtcaacaggctccagccggcgacgcaccggcagaggctcctcctgtgactctctctctctctcgtagctgcagcttgctatggaagtcggtgctgctgattcctcatcgatcctcctcgctccatgtccgattcctcacttcccctgcatctccttcgccaatcccatgtatgtatgtatgaatgaatgtatggactatggatatggttcgatcagcttgctcgatttcgtagttctctttgtctgtcagtagtaattgtgcagctgggatcattcgatacctactaatgattgttcagggttatatatgctcatgcttaactaaaataaccagatctgtgattagcctgatgaataaat

SEQ ID NO: 268 - DNA, 2209 bp, Sorghum bicolor
atgtcgtcgtcgtcgccgcctcgcaggccgcagcgccgcgcggcgtcgacgcgccctccgtcgtacgacgagtccctcctcgacgccgagctggagggcttgctcggcgacgccgcctcgcgccgcgtgcggcggctgcgccggctgtccgcggaggagcggcatcgggagacggatacagaggcgctcatcgcgctctctctgggtgaggataaggccgccgtcgagctcggcggcagcgttatcactggtatccacgccaacccgcttggcgtgctcgcgcggcagcttggtcttccgctgcataaggtgcgggaccgctgcccgctctactacccagatggccggattgtagagactaggctggataggaccattgatttggtgttcaacacgcttctcgaccacgccaccaaggttcgggagtctcttaatgaagctgcagagaggatttcgttggaagaagccatagagaaactcaggagactctaccatgtggccagaacggatgaggagcagatggttttgaattggcattttgcaaatttggaattctccaatgccggctgcctatcagagctttcactcgcgcactgggaccaggacgatccttatgagatggggggagatcattgtttcttagctggaggcaattctagactcatacatgcattgtgtgatggggtgccggtactctatgagaagaaagtgtcgcgaatcgagtatggagtggatggggttagtgtcacagtggaagaagggcagatttttcaagctgatatggttctctgcaccgtgcccctcggggtgcttaagagtggaagcatcgtgtttgacccagagttgcctcaggagaagcttggggcaatacagaggttgggatttgggttgttggacaaggttgccatggtgtttccccatgtgttttgggatgagaatattgacacgtttgggtgtttgaataaggatagcagcaagcgtggggagttcttcctcttctacagctaccacactgtctctggtggagcggttcttatcgcacttgtggcaggagaggctgctttggagtttgaaaaggttgatcccatcgtttcacttcatcgagtacttggcattctaaaaggtatctatggcccaaaaggtgttactgttcctgatcccattcaatctgtttgcacgagatggggcagtgatcctttttgctcaggttcatactcacacgtcagagttgggtcttctggtgctgactacgacattcttgctgagagtgtgaatgaccgactctttttcgctggagaagctacgaatcgcgcataccctgcaaccatgcatggggccttattgagtgggttaagagaagcttccaaaattcatcgtgcctcagaaagcttagtgaattctgaccagaagaagaattcattgcctaaaaggctcaaaccacccaatggtgcccttttggatctgttcttggagccagacctagaattcgggagattctcattcgtgttctcctcattgacacctgatgatccagaggctacagggatacttcggttttcacttgacaagcgtttctttctgcagcccaataatccggagttagatggggatcaaaaggactacagctctgcatctggggccttccatttgtatgccactgtctctcgagagcaggcagatcagctacagaagtcaagcgaagatgatagaactaggctaggagtgttatgcaaggattttagtgtaaagctaatgggttatgataatacatgcgatgtaggtagcgatctgatttcgagcatcttgagtgcacggaaagccaggaaactgctgcagcacccaaagaacttcaagatctcacgttgatgtgtaccagttcgtgttttcttttgtagaacagaatgcgttattttgttatgttcaagacaggctggtggagcttggaatttgctatgacgtgtacagattacaaactgtgtctcgctttagcaggaactgggaatctggaatgctccatgttctgttcttcacttgtaaaaattgctggtcatgtgacttcagactttagttggttataggctttgtttagttccaaaaactttttagttttagatactgtagtatttttgtttttatttagtaattattgttcaattatggattaattagatttaaaagatttatctcgtgatttatagataaactgtac

SEQ ID NO: 269 - DNA, 12751 bp, Sorghum bicolor
ggagagagagagtgcagcactgcaggggtctactgaggaactggaagtcgggaaatggcggaggcgacgaattcgagcttgggcacgtaggcgttgttcctgccatcgccgcagcggttgccggactcttacgccgccgccgccgccgccgccggagaccactagttctcctgcgcggcggctccgcggctcctgcgctctcttttaccttcctcccgctagggttttctccgatccccaatcacatgctagttcacaaatggcttcatcgcagcatgttgagatggaggccgcaaaacttctacataaacttattcaggagtcgaaggatgagcctgctaaactagcaacaaaactttacgtgatatgtcagcatatgaaactaagtggaaaggagcagtcactgccatatcaagtcatatcgagggctatggagacagttgtgaaccaacatggaattgatatggatgcattgcgatcatcgcgaattccatttgctggtggtcctcaggcaggggattctagtggtgccatgtcaaaggacaaggaggtcattggtaaccagtctccgatggttggaagtgatgcatcccaaactagtggacaagctggactgtggcagcttccatcaggttcaactgatatgacaaggcatgggacatctatttcgggtaggctacctacagggccaaataggggagatttctcagcagctgaaattcatcaagcctccatgtcacaaaagagcggtagatcctctggcattgaaagccctgcaagcctgcagatggaggataccagatctatgaattcacacgattctttgaaatctgatgagaaaacaagcaagaaaacctcttccaagagaaaaaggatggattcaaaaggagctggggatttgcattctgaagacaactcaaagtcagatgctatgtccactggaccgaataccagaaaggggaaacaggttggtaaggctggtagacaaggtcaaccttccatgggaattgagcatgagcaaccgcatatactgcaaggtggtactgctcaggtgccaccgatacatggtggtgcaccttttctcaggactcacccagaaggtccttctgggaggacaatggacaagacgaaaccatcaaatccattctcaatggctcaaattccaagttttcctgaaggactggcttctagtggtgccaccatcgagttgcaaaaaagtatacagggtggagcaaatttatttaatcctagttttggttggaaccaaaacccacaagttccaaccttgaagaattctcaaggttctattcccaatttagtgaggtctggagttactatcgaaggcaaaattaatgtaggggcacaaggagcttttaactctacctcggcaccacaaatggaatttcccacaattcctccttacaacccctcttcctttggagttagctcacagtttctggacaaaggcaaggagttggcttccagcagtactggcgctgaacttcattccacgtctaaagttgcatctcagcctggaattcctcatttcttatttgaggcaaacgtaatgtaactttgcagggaagtcccatgcaagaaaggcaaggtattatcagggtgccacagagagctgatccatcttcacttccgagcagaagtaccgggccaagtccaatgtctcacacttcttccaacacaccatttaaagaacaacagctgaagcagctcagagcacagtgcttagtatttcttgcatttaggaataatttgcagcccaggagggtacatcttgaaattgctttgggcagagggcctcctgcagaaagtgacagtgcaggtcagaggggcagcgagggcagagtgtctgatgctttgggaaaggaaaatggtagcagtcgggagaattctggtgtcttttgtaggcaaactgatatctctagacttccatccacatctgcaggaagtattgcagaggttgattccttactgaaggacccagaaaatgctacaaaaaagatcaaggttgctgaacaggagaagtcattgatggaagtagaaaatatccagcaagcttcagctagttctggaatgcgttcccaagaaactgcatctcaaaatccatctgggccacaacagtcatactttcagggagatacaagaagaattgcctctgatatccataggactgatgctgaaaatttgagccggaatttaagttggggaggccagggatctactgttttgggtggtactagacagcatctgaatcaggaaactaaagaatcacttccaccttcaaagtcacaccatatgcctggtgatggtttcaactccaatataccaggaatagatcggactccagagacagccggagctggtaatgatgttgaaaattgtagccatgttgtggatattgtgcctgagcaggctgctgatgatggagatgaggaccttccagagcatgaggatttattgtcatctcctccaaagcacacaatgacagaaaaatggatcttggattaccagaagagaatttacaatgagagacaaaagagggcatcggagcagcataaattacacagcagaatgtcagcatcatatgagaagctaaaggagagtgtcaattcttctgaagatctttccgcaaagacaaagagtgtcattgaattgaaaaagcttcagcttctgccacttcaacgtcgtgtacgcagtgaatttttgctggactttttcaagcctaatacaaccgacttagagcgcataaaatcactgaagaaacataggcatggccggcgggtgaaacagcttgaaaaaattgaacagaaaatgaaggaagaaaggcaaaagagaattcgtgagagacagaaggagttctttgctgatatagaggctcacagagagaaacttgaggataacttcaaggctaagagagagcgcttgaagggattcaatcgatatgcaaaagaatttcacaaaaggaaagaaagaattcatcgggagaaactggataggatccaacgggagaaaatcaatctgcttaagaacaatgatgttgagggttatcttagaatggtccaggatgcaaaatctgaccgtgtcaagcaactattgcgtgaaactgagaaatatctacagaaacttgggaataaattacagaatgcaaagtccacagatggccgctcatcttttgttactgataagagtgacgctgcaaacgacattgaagatgagagctaccagccacagcattatctggaaagtaatgagaagtactatcaactggcacacagtgtgaaggaaactgtaaatgatcagccgtcttatcttcagggtggcaaattgcgagagtaccagatgaacggtttgcgttggctggtttcattgtacaataataatttgaatggtattttagcagatgagatgggtcttggtaaaacagtgcaagtaatctctttgttatgctaccttatggaaacaaaaaatgaccgtggaccttttctcgtggttgtaccatcgtctgttcttcctggatgggaatctgaactcagcttctgggcacctagtataaataaaattgcttattctggtcctccagaagaaaggcgcaagatgttcaaagagatgatcgttcatcagaagttcaatgttcttttgacaacatacgagtacttgatgaacaagcatgataggccaaaactaagcaaaatacaatggcactatataataattgatgaagggcaccgtattaaaaatgcttcttgtaagcttaatgctgatttgaagctttatcggagctctcatcggctattattgacaggaacacctcttcagaataatcttgaggagctgtgggcacttttgaattttctattgcccaatatatttaattcatcagaggacttctctcagtggtttaacaaaccatttgaaagtaatggtgataattcacctgatgaggccttactttcggaggaggaaaacttgctgatcataaatcgtcttcaccaggttcttcggccctttgtactccgaagacttaagcataaggtcgaaaatgagctgcctgagaaaattgaaagacttgtgagatgtgagccatctgcttatcagaaacttctcatgacaagggtggaagaaaatcttggtgggattggagccgttaaggttcgctctgtgcacaactctgtcatggaattgaggaacatatgcaaccatccttacctgagccagcttcatgttgaagagattgagggctatctgcctaaacatttcctgccatctattgtgaggctctgcggaaaacttgagatgttggacagattgctgcccaaactcaaagcaactggccatagggttctacttttttctacaatgacaagattgcttgatgtaatggaggattacctggtttggaaaaagtataaataccttcgattggatgggcacacttctggtcaggaaagaggagctcttatcgataaatttaatgatcctaattctcaagcattcatttttcttcttagtatacgagctggaggtgttggggtcaatcttcaagcagccgatacagttatcatatttgatactgattggaatcctcaggttgacctgcaagcacaggctagggcccacaggattggtcaaaagaaggaggttcttgttttacgtttagaaacggtccgaactgttgaagaacaagtcagggcttcagcagaacacaaattaggtgttgctaatcagagtataacagcgggtttttttgacaataacacaagtgctgaagatcgaagagagtatcttgaatcactcctacgtgagtgtaagaaggaagaagcagctccagtgttagacgacgatgctctgaatgatattctagctcggagtgaagctgagattgacatatttgagtctattgacaagcaaaggagagaagaagaaatggcaatttggcaaaaggtggttcaggatggttcaactagtgggctagaccctgcagtattgccttctcgtcttgtgactgatgatgatctcaagcccttctgccatgctatgaaactttacgagccatcatcaaatgtgaaaacagtaaaggtgaatgtgaggaagaagggtgaacttggggggcttgatacacaacattatggaaggggtaaacgagctcgtgaggttcgctcttatgaggaccaatggactgaagaagaatttgaaaaactttgtcaagttgattctcctgaatcaccccaacctggtggcatgtcaaaggatttggatattcctaataaaggcattaagactgaaattgctgtggagagttcaaaagaaccagaacaaatgaggatggaggcatccccaactgttggggactccccaccagccaaacgacggagaggcagacctaaaaggtcagatgttttcttatctcctactgcagatctgactgatgctgtcaaacaagacacaggaaccacacaggatggtagtttggccacaccagcaagtaccttccattctgatacaccagctactccaatccattctgctgcttcagatgttaatatacattctatttcaccagctgatatcaagaaacaagagttcagtactgatactaagccttccagttctgtctctgttttggaaggatccacggcgaatgaaattggtacaccattacagagtgttcataatgtagcagctcctgcaccaccgcatcaatcagctagggggagaaaatcccaagcaggagaaacacctcgcaggcgaggccgaaaaccaaaatctctatcttcatctggtgtagatgatgttagtcttaacccaactgtttcaactggtagtggggtagcagacactagttatgtttcttcatattctcatgtgaatatgccctcatcacaaggcactgctgtggcactggcaggaatccagaaggatttggtcacagttaaattggatacattgttgccagatagtggtaagaatatttctcctgttaatgaagataaaggtgctactgttacaacacctgtggcaaaagatatctgtgctggaactgtgacaacatcagacaacactatcaccctgacaccgaatactcttaaggaaaacattggattagttcaagtagcatctgcacctactatgcctatgcctgtggcttcagaagaattattgaaaacagcagcacatgttgtggtggcagataagcctgttgagaagcaaactgcttcacgtcgccgcagaaagaaaacatctagtagcgaggatactggagtcagcactagacaaagatcagctatgaaaaaatcttattacagtacttctgttgccattgatgaagttggttctgccatgaccccaaatgagaaatcaggtatagagaaggaaagagatgtcagttcaattcaagatactcccaatcagctgccaaatattaactcaccactgtatgagaagtctggatatgattctcaaccaagcacacctatagctgtccccatcaatgaagctactcttcctagtggctttgatacccgcactactcattctaagataactctagcaacatctgccaatcctgctgatcatgataaaccggttgatttgcaccttaatgcgcctgtttcggttgattcccaaaatcatgaacaactcaagacaggaaaggaccatttggcagtgagttctggaatcttttctactcaattgcaaacagttactgcaaatcctactagtgataataaaccaggaactacccagtttgaaccatctgcttcctctgttcagaattcaggtaaggatgccactgcactgacttcttctgaggttgacagtgctgctccaaataaggcaccaagcaggaggaggaaagggtcaacgcgggaaccacgcaccagaagaacttctgcagcagctgcaagtgaacgccgtgcccgacttactggatcgaagcaggcagaggacacaaagaagttaaagatgtctgcaacgccaactacaacagtgtgtgttttagcggtagagcaacagggagctgcctctttaagagctgaggttaccaatgcttctgtttgtgaagagcagaagaatcctgggagtcacgtgtcttctgacatttcaattcctgtggggagtcatgtgctgggcgcaataagtactgaagaaacaactgccactgtgataactcagactcctgcagtggctaaatcagaagaaagaaaacttccagtaggggatcaacaaggtattcagtttgatagtacagtaccacaaacgaagatggtatcaaatgatgaaagcatgcaaggtactgaagttaataattcggaacagacaaaaatagtttctgctgctgaaccagcacctgcaaatgatgaacacatgcaaggtactgaagttagtaattcggaacaaacaaaaatggtttctgctgctgaaccagcacctgcaaatgatgaacacacgcaagctatagaggttggtagttcagagcaaccaacaagtatggtttcagctgtggaatcagcaccttcaaatgatgaagaacacacaacgcatgaagtgtatcttgagactgctgctgatgatatgcttacctctagtgcagcaacagatatattgcgggatacagttgagcatgcagctcgccaggccaatgcagcatgtacagatggaaccacaaggcagtctgaagcatcacaacttgatagcaaagcctctcatgatgcctcgtataaagacactactactactgtctccaccaaagatgatagcaaagcctctcgcgatgcttcttacatcttgcccagtgaaggcactgctgttgatgttactggttctaagcaagatgatgtgaacattgttggcacacaaactgctgatgcttccaggggttcttctagtcattttcaagctactttacaatcaactgagtcagattggcatccaggtcaagaggagaatttggagagtaggaaggagcaggtgaaaacggaagaagctttggataacagttctggtggcaatcaaactcacagtttgggcgatgaaccttctcatgatacatcattagcaagaaattctcctttggaatactcgaatgagcgttgttctgctcaagtaattggtgaaactttcaaaagtaaagaaaatattgttgaagtccattctgccatgaatactgatggccctgatgaagctctggatgcattgtatgtccaatctaaggaggccagcataacagatagtggtgtagctaccgatgttgataaatttgaaggtaaagagactagtgtcgaggtccgtgatgacatgaatactgatgggcctgaggatgctcaggatgctttgtccacccaatctgataaagaggccagcatggtagaatttggtgtgtctaacgatggtagtcccacagtttgcaaagcacacaatgatctcgagggtcatgtatcttgtgaagataggactggtggtgatatccataccaatgcaaattatggttctaataataaaagtgaggacaccattgttaatcctgttaaaaccacacgagaaccgttggaagaaagcaccgttattgtatcagagaattctgatttgaataagcaaagccacacattgcatactggaaatgatcctcctgcaagtaccctgttgatagttgagtctaacaaagttacttgtgatgctgaaattgtttgtgctagcagattagagtcttcttgtattgaggctgaaacagtggctatccaagagtcagctgttactgattttgagggaacaaaaggaactggggatttgggtcacaaaactggcagtccgctgtgtgatgatgttcatgatacatcatgttctgtgattggtcttgtgtgtgagaaagaacctactgaagatcttactgatggtagccattcagaagcacctaatttacttgctgctgtagtacaaactcgagaaactactgttgcaaaccaagaggaaatcatagatgcagtagtgtttattgatgcctgcaaggcagaacctgatggtgattgtactgttgctaaaggagctgaagagactgtagaaatggttcattctgttgaaaagcaatctgctgtattagaacatgttgagagacagacgaaacaaactacgatttgtggttctgtgctaaatgagtcccctcaggctgcagggttggaagaggactgctctgtactgaagcatggcggtcctactgcctcatctgagcttcttgctgtagcacccaatccaatcagtgaaacttctgttattcaagccgaaccagaggcaacaaactcggatggatactgcacaacagaggttggcagtgctttatctgaaactgtcaggggactggagccaaataaagaaactgctgttccaatgcaagaggatattgaagaagctaatgatacttctaataattgtgaagcacacaataattcggggattcatgcatttggtgaagtgttgatggaaatgcagtcatcagaggtcaaggaagtatcttttattcagtctggtgcagcaaatttgagcacacagactcctgtactgcctgatgaaacaggacaaaccaatgtggcttcgactgcagaactagtacctacaaatgatgatgaacacatgcaaggcactgatgttaattctgagcaacaaacaaagatggtttcacctgctgaatcagcacctggtaatgatgaacacatgcaagacatcacggttctaagttcagaactgcaaacaaagatggtttcagctgcagagattgatgcattatgtgtccaggagactgcaattgttgatcttgggggaactagaggaacagttgatctgaatgacattagtacacaggttcctgcattacctggaagtgatgtgctaggtgtggaggcacataattcagaaccaaaaaaagcatcctcaccaggtgatgaaattattagttcagaacaacaagcagaaattgaaacgattgcagagacagaaacagtgagcgttaaggagaatgccattgctgatcatgaggaaacaggtgaccagagtggcgtaagtatacatgctcctctattagctgaatctggagaaaagggatcacatggagttgaattgtgtggtattgagattgaggctaataattcggaacaaggaaagatggtttcaactgtggaagcagcctctacaccagacgatctagggcgtcacacacatgaagtgcatgtaactggtgatggtgctatattatctagtgcggaacaggacacattgcaagataacataagcagtggtgctgatgtggacctaacaaccagccaaaggaaaacagactctgaaggtatcaaggatccttctattgggactaacatagaggagatccaaggcccttatgaaacctcgaacaaggaccattttactgatcctcctgcgactaccctggtgatagctgaatctgataaggatacctgtgatgcagaagttgtttgtgctggcaagttagaatcttctggtgttgaaggtcattgttcagaacaagtaaagatggcttcggttgcagaagcagcgtctagcctggctttagtaggatattcttcttcagaagactcaatggtggatgctgctgcccgagtagctgatggtgattttgcggatagtaaaggggctggtgttgattgccaagaaactatgcctactcaagccacctctaccctcccagagaacatggattggcagaatgattctcttgcagctgctgcggtgacggttgaaccaatgtttgcttcctcatctgagcacgctgcagaatccaagccaattgatgaaacttctgttatgcaagtggaactggcaaccagtacaggggatgaatgtgcagcagagggtgacaatgttgtttcatctgaaactgttgtggaatcagagcctgttcaagaaactgttgttcctagtcaaggaggtagcatagaagctaataatacttctaccatcagcgaagtaaacaaagataccgagtctcgtgcatctggtgaagtatgcaaagatgctcagtctcatggcggtgaatcttacactgaactgcaattggcaccttcctctggtgaggaggccatgatattgtgtagtgagctgcccagccaggaggtgaaggaggctccaagcagtgaacctttggggtataatgaaaatgtgaaaacagaaaatgattcttcttctcaagaaccagtcaatgaggaatctgctcctggtgctgaaaatgcaaagattgatgaagctgacacagaacagcaactgcctcctgggcagcaggtgaaggaggctccaagcaaccctttggggaataatgaaaatgtgaaaatggaaaatgaagcttctgctcagggaccagtaaatgaggaatctgctcctcgtgctgaaaatgtaaagattgatgaagctgacacagaacaactgcctccatctggtgaggccatggtagacatatctagcgagctactcagccatgacgaaaaggtggctccaagcacagtccctttaggaaatgatgaagatgcacatatggaagaggcttctgctgcacagagagagctaagcactgaagttgctcatggtagtgaaaatgcgaaacttagtgaagctggcacgtctggtgaggccatggtagacgtatctagcgagctactcagccaagatgaaaaggtggctccaagcactggccctctaggaaatgatgaagatgcacagatggaagaggctgctgctgcacagagagagctaagcactgaagttgatcatggtagtgaaaatgtgaaacttggtgaagctggcacggagctgcagttgccaccaccttcatctggtgaggcactggtagacatatctagggagcaactcagccaagaggtgcaggaggttgcaagctctgggccctcaggaactgatgaaaatactgagatggaacggctaaacaccgaacattcacctggtggtgaaacctcaaaacttgttggagctgatccgggaatacaattgccaccgtctggtgaggctgtggtagatatatctaatgagccacccagctgccaagaggtaaaggaggccccgagcagtgacagtttgggaaatgatgaaaattcagacaccgagaagactgctgctgccttacagggacggctaaacaccgagcttgctcctagtggcgaaaatacagaatctaatgaagctgacactgggaaacaagagacacccgtgtctgctgatgctatggtagaatcatccagcgagcctcccagcgatgaggcaaaggaagctccaaccactgacctgtctggggatgatgaaaaagcaaagtcggcaagggctgctgttgttgcggaactttttggagatgcaacagaaggtggttcggatcagccattgccgtctccaagagaacaaggcaaggaagcagaggctgatggtgacttgtagagtaaattatgcaaatattgtattaagagctactagaatctgtgtaagtaagaaatgatattagtgctttagttgtaactgttggaagcttttactcagaatcaaaagcaacgtgctgagattacagcaacagtggcccacggcagtttactactgtttgatgttcctactgcgttttgttgagacagacagttgatctgtctcgtcttgcatcgaagttagctttgcgccatgttatacaaccagtcaagttcttttcgccacgacgacgtgctct

SEQ ID NO: 270 - DNA, 1190 bp, Helianthus annuus
aaactaaaacaaatggctagagttccaagagtgaaactgggttcacagggtttagaggtctcagctcagggtttaggctgcatgagcatgtccgctttctacggacctcccaaacctgaacctgacatgatcaatctcatccaccacgccgttaactccggtgttacctttctcgacacctccgattactacggccccaaaaccaacgaaatccttcttggcaaggctttgaaaggggggatgagggacaaagtggagctcgctaccaaatatgggatcaaactcagcggttcgtgggaggtaaaaggcgatcccgcctacgttagggctgcttgtgaagctagcctcaagcgacttgacgtcgattgcattgatctctattatcagcacaggatagacacccgtgtgcccattgaaatcacgatgggtgaactaaagaagctggtggaagaaggaaaaattaaatatgtcggattatccgaggcatcagcatcgaccatcagaagagctcatagtgtccatccaataactgccatacaactagaatggtccttgtggtcaagggatgttgaagaagatattatacctacttgcagagaacttgggatagggattgttgcatatagtcctctaggacgagggtttttcgcatctggttcaaagatgatggagaagctcgaagatggtgactatcgtccgaactttccaaggttccaacctgaaaatcttgaacacaacaagatcctgtatgagagggttagtgaaattgcgtcaaagaaggggtgcacaacttcacaactagcattggcctgggttcaccaccagggaaatgatgttgtgcctattccaggaaccaccaagatagaaaatcttgaacaaaatattggagctttatctgttaagataacgccagaagagatggctgaacttgaatccacaactcatttagtaaagggggctcgatgtaatgccggtactccaacatatctagactctgaaactcttccattgccatcatggaaatcttaatttatcaatgatatgagtcttttgtttatcctgtgttgctatacccaacatatcatattcaatttccagtaacgtgcttaagtttttaaaacttggttatactttatctacatatggtttcatgatgtatgtaactcgaagaagatgaataaaaggttgtt

SEQ ID NO: 271 - DNA, 2097 bp, Gossypium hirsutum
acgagcggccagtatcaacgcagagtacatggggagcttcaaaacctcagcattgaatttttctttcattttttgggataaacaggaaggagacggagagggagtatcgacggtgatggagatgcgagacatcgacgaccttccaaagaacgccgctaactacatggctttgacgccgttgtggttcttggaacgagccgccacggttcatcccaccagaaaagcggtgatccatggatctcgaacgtacacgtggctccaaacttaccagcgttgccgtcgcttggcttcagctctttcgaaaagctccatcggcgttggtagctcggtagccataattgcaccaaacattcctgctttgtatgaagctcattttgggattccaatgtctggtgctgttgtaaacaccatcaatattcgcctaaatgcatcaaccattgctttccttttgggtcattcacaatccaccgtcgtcattgtggaccaagagtttttcaatttggcagaggatgctttgagaatcatgaaggagaaaagccaaggcaatttcacacctccgcttgttattgtcattgctgacgaaagctgcaacccggaaacacttaagtatgctttggggcaaggagccattgagtatgagaagttcttagaaagtggtgaccctgactttgcttggaagcctcctcaagatgagtggcaaagcattgctttgggctatacttccggcacgacagccagcccaaaaggggtggtattacatcaccgaggggcatatctaatggctttgagtaatcctattatatgggaaatgaatgaaggagctgtatatttatggactctgcccatgttccattgtaatggttggtgttttccttggacacttgcagctgtttgtggaactaacatatgcctccgacaggtaacagcgaagggcgtatactcggccatcgcgaagtacagggtgactcacttctgtgctgcacctgtggttctcaattccatagttaatgccccgcctgaggaaaccattctgcccctcccccatgttgttcgtgtaatgacagctggtgcagccccacctccttctgtccttgctggaatgtcccagaaaggtttccgagtcacccacacttacggtctctccgaaacctatggtccttctacagtgtgtgcatggaagcctgaatgggactccctaccacctgaaactcaagctcgtctaaatgcacgtcaaggtgtccgatacgttggtttagagtgcctagatgtcattagtactcaaactggtcagcccgtacctgctgatggaaaaaccattggagaaatagtgtttcgcggtaacattgtgatgaaaggctacttaaagaacccgaaagcaaatgaggaaacattcgcaaatggctggtttcactccggggatctgggtgtgaaaaatccagatggatacattgaaataaaagataggtcgaaggacataatcatatcgggaggcgaaaacatcagcagcgtggaagtggaaaacagtctctatttgcaccctgcagtaatggaggcatcggtggtggcaagggcggacgagcggtggggagagtcaccttgtgctttcgtgaccttgaagcctggggtggacaaatccgatgaacaacggttagctgaagacataatgaagttctgcaggtccaagatgcctgcatactgggttccaaaatcagtgatatttggtccactgccaaagacggccacaggtaagattcagaagcatgtgctaagagcgaaggcaaaagagttgggacccgtcaggatgagtaagttataacttggaagttccaaaactaaattattaggcatctaaatcttgttgttattaacattaaaaagaagataaaaaatgtaggggattcctactagtagtgttgtattttgtactgtttgtgtaggcttgtagcagtattttatgaataaatatttctggtcaagtaatgtttttgcccaagtgtctgaatgtaataatatatatttgattgaatgtgatagataaagaataattaaagtgataggaatgctgttatgaaataatttagtaagcttgaaatacta

SEQ ID NO: 272 - DNA, 673 bp, Hordeum vulgare
ctcgcctcgccgccgctaggtaagatagcttcgcgccatgccgtcgccgcgtccgccgtgctccagccgagcagcagctcgggcccggagttgatctccgtcgctccctcgccctctggtgcacgggaagggatcctccccgtgctcctctccgtcttcgacggctcgcggggtcccaaggagtcgcctcgacgtcgtctgcttcctcttcttcttcaggcagaaccggttcggatgcgcgccagacttcagcagctcgccgtcgccttctgaagcctcgttccacatcgttttcatgccctagttaccggggccggaaacgagtacgaggagtccggagagttcgtccaggaagaacaaaagcagttccagaccgaagaaaccacatgcaagatgaccgtgaccttgacaccgtttctagctttgttatgcttagaatcacgtttccttcgttacatgctcgctgcctaccacttgatatagatgctacatgtctttgccatgaaccccaaacacttccctgtcctagcaaatattgtctggctaagtaggcttgctcaacccctaacggatagctttgctagttgcaggtgccagctgtcccatgtgacaacatgggtattttgatatcattatgtttaaactgttatttaattaatgcacctatatactt

SEQ ID NO: 273 - DNA, 327 bp, Hordeum vulgare
gaaaaataactttggttatctgttgcaaaggaagcctctcaaatggaaactgtgaagacctggagacgtaatggatgcccattggggatttcttgaccactgaagagatgatttacagaccgttgaaatgagagcatactggttattctatatgtaaagcagcatttctggatcacacaaagatgaatgtgctgcttcacaaacttttggttataaatggacgaagtccttatctgcacgtaaatgtaaactagctgtactttttcgtataattggtgttaatttttttcttatatggactttatcaagaagattgcaattctatta

SEQ ID NO: 274 - DNA, 662 bp, Hordeum vulgare
tgagcgaggggagggaggagagagagagagagaggaaggagatgccattggccccattcgtcagcctgtgaggcgttgatcagccccgggcccccgcgcttaagtgaaaatgtattctccggaattcgctttctcttttgaaaagcgtactcggcccggaggcgcgttctgtttccagtcagggacctgtttgtaggaatttatttttatggataggtccctaaacttcatcgggtcttatctttttgctcgggactccgattgaggtgattccaaaaccctcggcttcgtctcgtcgatcccgtcatgttgatagcattttcacaaggtggtgagactgtgaaaatgacccttttgcccttgtctccaatcagcccccttcgagagagagcgatgtctggcgatcctttccgcggactctcagcacctcttccgggagtattcttcaaccccaggttcacataaggatccgtcgttcgtcgctaaggagacagagcatttgcggtctaggagcgtaaccgagtcagatccctgtggattggagctgcatcaagaccatgctgccttagatagagcttttttcgctgccattaaccttgtagctcatcgtgtaaaactcttatattcattaatagaaatgcctatgttcatgaaaaaaaaaa

SEQ ID NO: 275 - DNA, 258 bp, Hordeum vulgare
gccggcggccgtcccgacatggtcgcggaggctcttctcctgaacaccgttcagcaggcacaaacaaccttgtgaagctgtggttctcactttatcaaggcagtagagagttagccggtgcggtgtaaacactctgaaactagtttcgcgtagtgattaggttctcgcctggtgtatgtattgttcagaagtctcttgactcggttgttttagaaggtgttctgttcgttgacagctttggcaaccccagggctcgcc

SEQ ID NO: 276 - DNA, 688 bp, Hordeum vulgare
gatgtgcatttcttcctgtcacgctaaatgctaatgtaaccattggaaacatgattctgattttttgttttgtttttgccaatataagaattttggccagatttgtatctggcctggaaaatgttgcatgttgcaagggcaatatctgagaagagtcctggcagcaatatggagaagtataaaatctttgctgctcttgctaaagtctctgtggaaatagacgacaccgattactcgctcattgcgtgcttcaaagctttggccatgttggagcatttgctggagtgtgatcatcatcatattatcaatctaaacttacaggtacgttttgccttcgagttggaatccatgattggagatgcaaaggctatttcattgttcaagtcacgtatagagaacttgaaaagggcgagtgaagatttgttggctgataatggtgatgatgcatcatttactgaagttggctcagaaaaatcctttccagccaaggaaatacggttccttactgacacattattgggtgcattggagcacaagcttgaagacctggagcaagcaaatatcaaccccagtttcagaggcaaatgctggagccgaccttgagggcggctgcaggctgaagcgtcggacgagctaagctcaagcaaatctctgtagaagatgatagcaacgacagcttagatgttga

SEQ ID NO: 277 - DNA, 1182 bp, Hordeum vulgare
cggagcgcctcactgctcggtcgccatggcgtccctcgtgccccggctcctctcccgccgccggatcctgcaacccgccgtcgctctatgctctccatgcgatccttggatgcgattccgcggcgcaagttccccacgcccctgcccgctgttccgaccttccctggggggtgatggacgcggggaacctgcggggatatgctggtttctctcgccggtgaggcacgggagcacggcggtgacgctggacacgggcggcggctttgcccgcttctcgttcggagatccgggcacgacgaagcagaatggggggcaggatcagccgccagcggagaagaagaagaagatgtccaagaagtccaaggtcaaccagctcaagtggttccgcctcaaggccaaaaagaagatgaagtcgcccaaccccgaagtcaggataagatacaagctcgaaaaggccaagaggaaagaagagtggctgattgagaaactcaggaagtacgaggccccgagggctccggagcctgttcacgaccctgagattctgaccgaggaggagaagttttatctgaaacggactggggagaagaaaaagaactatgttcctgttgggaggagaggggtgtttggtggtgtggttctcaacatgcacctccactggaagaagcatgagactatgaaagtggtctgcaagccctgtcggcctgggcaagtgtacgagtacgcggaggagctggcgaggctcagcaaagggacagtcattgatattaaacccaataataccattatcttttatcgtgggaagaactatgtgcagccaaaggttatgtcacctcctgatactctttctaagcagaaggccttggagaaatataggtatgaacagtctcttgaacataccagtaaatttattgagcagttggaacaggagcttgaagattaccagaagcatgttgctttatttaagaagcgcgagggagctaattctgagcaaatcagtaatgaagactctgctgttgatgacctcacaactagctcagatactgattgaatcaccttcttcatcaattgacatctcatattctctccgcaatgaaggtttgagaagatctcaccacccgaaaaacttatgtcatgtttgttttttcactcttccaaatgtttggcaggtgcaagagacgtttg

SEQ ID NO: 278 - DNA, 462 bp, Sorghum bicolor
tctcgcagagataaggagaagcaatcagacatgagaacccaagcgctgttcttcctgacattcgcccttctcgccgtgctcgcgcaatccagcaacaggcaccaccaccaccaccaccactcccaggttcaaagcagagggcagggaggaggaggaggaggggagcttgcgagccggggcaaggcggcggcgcgagcgtggccgtgctgcgacagctgcggcgggtgcaccaagtcggagccgcggcggtgccagtgcctggacgcggtgccccgcgggtgccacccggcgtgcagggactgcgtcaagtccagtctcagcgccgacccgccggtgtaccagtgcatggaccgcgtccccaacttctgccagcgccgctgcaccgcgcccgccgccgcgcactgaccgcccgcccggccgtgctgacgactgatttctgctttgctctttgacccaccaacc

SEQ ID NO: 279 - DNA, 354 bp, Helianthus annuus
tgtctttcaagtgaaaatggcttctaagacatttcttcttcttgcccttgtttttgctgtcgttcttctaattacctcagaagtagccgctagagacttagcctccaaccatgatggtgaggttgatggccgtagtggatacaaccacggtagcggtggacacggagggtacaacaacggaggcggacaatacaacgttgatggacgtggaggatacaacaaaggcggaggacatggagggcatggagggcatggcaaaggtcgtggtggccgtggagggcatggtggtgaagaggcaactgcttacaaagaaactcaaaactgatgataagcatattcgagctggatgaaaca

SEQ ID NO: 280 - DNA, 1261 bp, Solanum lycopersicum
cacgaggagaaagtgagttgtgttgacaaggaattaaattaaaaatggagaaaaatgaattgatgaagttgaaaagtagtgagagtcaggtgatggacggttcagatataatgaagttagttggaaatgaggctgtgtttagtaactttgtagatcataagtttgaagaacttgacatagacaaagacggtaaactttcagtgaaggagttacaacctgctgttgctgatattggtgttgcccttggtttacctcctcaaggttcttcccctgaatctgatcatatctactctgaggttcttcaagaattcacacatggaaagcaagagaaagtaagcaagactgagtttaaagaagttctttcagatattttactaggaatggctgctggtctaaagcgagatcctattgtactccttcgtatggatggtgaagatcttcttgagttcgttaaaagtcctgcattcgaaccagagatgatttccctgtactctgagttagaattgcctgatggatccctcaaagattacatcatcaaggcttttgagaagctcacggttgatcaagggatgcctcctgcatcagactcatgggtaatgagtaatgttgtggagccagtagttgaatcctgcattggagcaactaacgagcaacctgttacacaagaaacatttttggctgaatttaagaaagttgcagagagtgctgctcaacgtctcaaggagcagccagtcattgttgctcacagcgagaatacatttgatggaagtggaattaaaagactattgtctaacaagtttgaattggataagacgctggactctgccttaaagactatacccagagatcgcaatgggaaaatgtcaaaggaatacctacgagttgcacttgatgttcttgcaccatcagctggtttacctcccattggtgctgttgatcagatggataaggtcatacaagaagtctgtaagatgttggatgccgatgatgggaagatggttaaagaggaagagttcaagaagttgttgactgaaatactgggcagcatgatgctgcaattagaagggaagccagtttcggtgtccacaaactctgttgtgcacgagcctcttgcttcttcctctacgctcttgcagcctccatctatttctgagatgtaactgatcttattaaattagacaaaaaaaaagaataacaggggatgtatgatgtaaatttctgttaaaatttaaaggctgagagacactgccttactaataca

SEQ ID NO: 281 - DNA, 761 bp, Solanum lycopersicum
gcaagaggaatatgaagccatactatacattgaagatgaagaggaaggatttggaagatgttaatgatgaattctctgatttttcactttcctctcccgccagaaaaattcgtcgactggatgcggtgttgcctcccataatagaagaggttgaagaaccagagattcctatagcttttgagcaagcaacaacttatcccagcttcggaagcaatgcagtaaagaggggtctagtaattgaggaactgccaagtgtgcccgcgaatgaagagagggcaattgtgctattcaagcctatgaacacacagcctatgcattccccttctaatttctccgttaaagtggatccccagtttcttaatggtttcaaaagtcaagtcttctgggataacacagcaaatgcatttagactagttgatgctaatgaagcagcgcaacaggacgactctagttctgcgaaagaatgtctggcagttgttccttgggttccatctcaatttccttctgcagcagaagctgaagtccttagtcaacctgatgtttcagatatgatggatgctgaagatatggaaggagtagctatggatattgaagataacagtgtggatgttgaaccaagaattgcagtcgatgctggtgcagttagtgtaaatgatggtttgcatcattggcagcaacagcattgtatgactacgactcaaccgcctcagaacacatcaacaccgattccctggtacagtaactggcataaggattagtag

SEQ ID NO: 282 - DNA, 365 bp, Solanum lycopersicum
gtcactatgaaaaacacatcaaaaagttccaaaattacccccaaatcaagccaagatgcgagaaaagaccggcgatcggccaccggaatgagtggatctccgaagaaaggcggccatggtggaaagtttacttgggccggcgacggaagttattcttctaagaaagaagaagctgatgctgctgttgttgtcgacgcaaatgaccctaattttgatgaaccggaggagaattcgattgatgaatcgtagatttgcatttcgaatgatttgaattgttgatgtaaatattgaagaatttggtgattttatgcagaatttagaggggaaaattgggaatgaaatggaagggaagatctgttatctgt

SEQ ID NO: 283 - DNA, 1162 bp, Solanum lycopersicum
tccttgacttatttgaaagctgctatcttaaatcagtttggattagcaatgcctccaaatcctagggtcgatcgtgcttttcgttctatgaaagctcttggtatttctggagagaaggtgaagccagtgttgaagaatcttttaagattgtataacaaaaactgggaccttatagaagctgagaactatagggtccttgccgatgcaatatttgatgatgatgaagcaaaggatgcagaaattaaaaagtcaactgaggataccgaacaagaggctctggtgcaagatgagcctgaaccacctctgaaaaggcagcgcttcaaaagtcaatcaagtcaaccaaatgagtctcttgaatctcaattgcaaaaccagtcacctggtgattttgattcccctcagtccatgggcaatgaatcacaacctggatcacacccatcacttgatagaaacaaaggaaagcagcccatgtttgccgattcattagtaccacaggaagagctgccttcatctcagccttctgacgtggacaagagccttccagttcccaggagagctggatctacttctggttctggcatcccagtgtcacctacgaagaatgccattgctaatcacactcttatcaaacctaaggatgagccaatcactgatgacctgccaagtcttgaagttcctgttgccatcatccgcccaggttcatcaagtaaagggaagtcttcagttgcaagtggttcagaaggtagacatggtgatagtaacgcatcagccactgtagttgaagcagatacaaatgatggaaatccacccagtccagttgtagctaatggcaagcctgaaacaagtacagttaagtcttcttccgccctggagatggcttcctcacaatctggagaggtgaaaatgatcttgacctatggctcggtccttggaagatcagatttccagatgcctactcttgatgcagtggtgaagttaatggacgataaatgtcagaaagagtacaaagagctcgatcctaatttttccgtgatgaaggtcatgacagacatttgtcagtgcttcttggagatgagcggtgaatcaactaataaatcatctgacgagtgaacgaaatatgtcctatgaaagcatgaagagggaaggaacgagacgagttaac

SEQ ID NO: 284 - DNA, 853 bp, Solanum lycopersicum
gttctcaccaaatgtcccaaacctctccatcaccctataaatatatgcaatttttatcttcacatttgatcatcaaaaactcaaaaattatatcttcccagcaacattaatggctactccaagtgtacaagaaattcgtcctgcatctcttgattctacttccgaatcgccagccctgtttgatggaactacaaggttgtatatcagttatgtatgcccttttgcacagcgtccatggattgccagaaatttcaagggtttgcaagataagatcgaattagttccaattgatcttcagaacaggcctgtttggtacaaggaaaaagtttaccctcaaaataaggtgccctctctggaacacaacaacaaagtgattggagaaagtctcgatctggttaaatatatcgacagcaactttgagggtccgtttcttctacctgatgaccctgaaaaacagaagtttgctgaagagttgatagcttacagtgatacgttcctgaaagaaatatatgccaacttcaaaggagatattgaaaagcattctggacctcaatttgactacttagaaaaagctctcgacaaatttgatgacggacctttcttcctaggtcaattcagtcaggtcgatatcgtgtatgctcccttcgttgaaaggttccaaatcttcttgaaagaggggttaaattatgatatcacatctgggaggccaaaactagcaaaatggacagaggaactgaacaagcttgatagctacattcaaacaaaagctgatcctaaggaagtggtggacttatataagaaaaaatatttggcgtaaaactgaataaaacgctcgatccatcaacgttgttaa

SEQ ID NO: 285 - DNA, 907 bp, Solanum lycopersicum
ttaagtctatccacattctcgtcggaaagtaagtatgagtgacaatcggagtcaaagacggcgagttggagagtcgtccgaatcggaagattctggaatttacaatgagaggattcttatcttggtgtttgcctcaatgaattgggatattcctacactatgtcgaacagcctcggtaaataggaaactacgtgcagttgcgagaaggattctatggaaagagctttgcgtgtatcgagctccgcaaatgataacggccttaacggacggcggtagaattggcggcggatggcaggcgatggcaaaattgatgttcttctgcaatggatgtcaatcgacccggcatttccaagtgtgccgaccggaagcgggtcacttcgtgaaaacatcccggttttcgaagacatccggtcggagttttttggtgaagaaatgtacaagtgatttgctgtacgtgagtgatccgtgtgaacattcaactgggagcgatgatttggggcttttcagaggggtattttgggggtttatgaaatctaggacaagggcgagtttgatcagaagacgagtggagcttgaagaaggagccaagtgtccattctgtcgtgctcgggtttggagtatgacggcggctcggctcatacccaaaagtgcggcgcggcggcttggttcgatggagagtggattggagtactttgtatgtgttaatgggcacttatatggtgcttgttggctggttcctttatcgtctgatgatgaaggtgagagtgaggaagctgaccggagatttgacgacggcggcggcggctattttcatcgcgagaatcagatagtaataaatgggtctctgaattacgggcttacttcttgatgttcatcatccccgaagttagcaagcaggatcatttag

SEQ ID NO: 286 - DNA, 1981 bp, Hordeum vulgare
aaagtcgacgcatggagcttctcttctttcccaaagcccatgattcccttgctgcttgctcttgattcatactgaatctgcagcaacaagacaagacaagagattgattgatggaggagttcatcagtctcggcgacgactccaccgcatctgagcctcctcaaccacaggaccacgggcccacggacaaggacatcatagatctcgaccaagcccaagccgatgcagcagaccgagccgccgtcaatttgaatttcaatgctactctgccagtgccatcccagcaacaaccacaagacactgtcaccaccaccaaggctagtaccgtcatcgagatcatcgacctcgaggaaggacagattgccttccaagaatcatctggtgcccaagatgcagcagcagcagataacctccagcccaaggaccaagcacaagccctgactgcaaatggaccggagcctcctccgccatcccagcaacaaccacagcaagacgacatcatcgatctcgaagaaggccaggttgaggacatggacctctccgatgacgtccttgtcacaaagcacggtgtctcagctgaaacacccaagggcagtgatccccttgttcatgcttcaaaaacaggcagcgccttcatcgaccaaagccccacaagaggagtgaaaagagcccggacggaatcagctgagccttctgtccgtgtagtttacaacaacttgacaagagaaagcaaaaggaagctcatggaactaatgcaacaatggtccgagtggcaagctagaaagcaacacgccttgacggaaactgtggaagaagtcttggactgtggtgaagagacttattatccagcattacatgttggttcagagagatcctgtgctgtgtcattctgggtggatagccaagcacgagaaaatgctgctgctgatgatggcgcggtgccgctgtacgatcgagaatttacattgggttcaactcctatgggtgattcatcaaatgctgaaggcaaaaaagacaaggacgattctcgctgtttcaactgtggttcgtatagtcatgccctgaaggattgcccaaagcctcgtgaccatgttgcaattagcaatgcccgcaagcagcacaacttgaaaaggaacctatctaatgctagtaatcgtggacaaaatcggtactaccagaagacgccaggcaaatttgacgatctgaaggcaggagtcctaggatctgagactagagaatgcttgggcctcagggaaaatgacccgccgccgtggctgcacaggatgcgtgaattgggttatcctccaggttacctagatgaggtggaagatgaagacaaaccatctggcatcaccatatttggcggggaaggggaggcgaatgcagagcagcagcagcagcagcacgaggagggagagcttccggagaagggcgaaccgtctccgcctcgcaagaggatgacggtggagttccctggaataaacgcgcccgtcccagagaacggcgacccttggctatggggcagcgctccgcctcctcctcttcagtcctcctcctcgggccgtcaccagcatccatcgtcggattctcagagggatagaggccctcctccccctccgggcgtcgagcaatactcgtcatcgaggtaccactcgtatgactatggaccggcgacccccggcaccggaagaagaagctcctctggttatgatgacggcggtgcctttacccctcactccgcgtattcaagcaggcagcactcggggtcgggctcgagggagagggaaagggaaagggaaagggaaagagagagggagagggagagggagaggcatgacaggcactactacagcagcaacaggaggtgaatgttacatatgtgtctgtagctgaagaaagacgtgaattttgtgatgatatcaaatttgctcagaatatcatataagtcagcacttgcaatatcagtcgctgtggatccttt

SEQ ID NO: 287 - DNA, 1440 bp, Hordeum vulgare
ccacacaaactccgctccgctccaccgccggcaatggcttgagccgagcgccgcatcctctcccttcccctcctcgcgccgaccggggacaggcaatggcggcgcgtccgccgcccagcccggcctccaccccgcgccgccaccaccaccacctcagcccggccgccaggcccggccgccgcgaccgccagctcgcccgctgcttcccggagccgttccccaagcccccgaaccccccgaacccgctcctctccctcctcaccgccgtgcccgactgggcggacgccgtgtcggagcggcgcatccgggagccgcggccgctctacacgcacgagcagtggcgggagcaccgcagctcgctgcgccacctgcggcacctcctctcctcgctctcctcccgcgtcatcctctccctcgtgccgcccgtctccgccttcaccgccttcgccgccgccgtcgccacctacaacacgctcgccccggactacgcgctcaccgcctcctccctgccctaccagctcacggcccccgccctcgcgctcctcctcgtcttccgcaccgaggcctcctacgcgcgcttcgacgagggccgcaaggcctggatgcgcgtcctcgccggcgccaccgagctcgccggcatggtcatgcattcctgcgccggcgccggcgagcgcggggacaacgacaccggcacgggcgcgctcgtcaactacatcctcgccttccccgtcgcgctcaagtgtcatatcaccagcaactccgacatcagaaaggaccttgagggcttgcttgcagaagacgacctgaatgttatcatgagctcaaaacaccggcctcgttgcatcatcgagttcatttcgcagagtctccagattttggattttgacgaacataagcggagcatcatggagtctaaactgtcttgttttcttgaaggaatttgtgtgtgcgagcagatcatcgggatccctgttcctctgtcttacactaggcttacctcaaggtttcttgtcctatggcatcttacacttccaatcatactatgggctgaatgtaaatggatagtcgttccagccacttttgtcagtgctgcctccttattctgcattgaggaagttggtgttctcatcgaggagccgttcccgatgctagcgctcgatgcacagtgcaagcagctccacgacagcatgcgtgacatgatgtcggtgcaaggcctggtccgaaagcaactcgtcgccaagaccaagggccgcggcagaggcagtaggctcccgcagaacggctggcccgtctccagccccaggagcgagcaggtgaaggtcgactgatggagctggctgatggcgaatcattcaagaacagcggcagttggaagcaaccgaagtgtctgcggtttgtgatgtgcagtcccacttccaggtattgatgctgctgctactg

SEQ ID NO: 288 - DNA, 524 bp, Hordeum vulgare
ggctatcagcaagtaggagaaggaagaaccagctgcttgatcgaagaagaagatgcaggcggcgaaggagaaggtgaaggacggcgtgagcgcggtgaaggccaagaccaagatcacgcaggccaaggcgtcggagaaggcggaggcggccacggcgaggtcgcacgcggagcgggagctggcgcacgagcgcggcaaggccaaggtggccgcggcaaagatggagctgcaccaggataaggcgctccatcgggaggaggccatggagcaccgcatccacaagcacggtggcggccatggccgccaccaccacaagcacggcgtcggcatcgtggccgcgcccccgccggctactggggccggggggtactaccctcctcctgccgccggtggccactactactaatcagctaagcagctcgatcgctagctagatggatacatgcgctgcgtgtgtgatgtgattccgatagctaataagtctctactttgtactgtttgtctttgacttacacatgcgtgct

SEQ ID NO: 289 - DNA, 784 bp, Gossypium hirsutum
cgaagtgatggctagaatttacaacggaaaaatgcaaataccaaagagcagcatggcgttgagaggtgctgccatggctggtggtgcttgcattggaagacaaagagccaccccatttgtcatttcatcttctccattatttttcagggtacgatcccttcattcccattcacatcctctcctaagattcacatcttttcctaaccccaaaactggatttaagtatcagattcgggcaatacaagaggtaactgcagatactgtaaaatcccagaaaggaaaagaagatgatgaacagagttccccacaaaattggaagattaaaatgctttatgatggagattgtccgctttgcatgcgtgaggttgatatgctaagggagagaaataagcaatatggcactatcaagtttgttgacataagttctgatgattattctcctgaagaaaatcaaggattggactacaaaactgttatgggaagaattcatgccattctctctgatggaactgttgtcacagatgttgaggcatttagaaaattgtatgagcaagttggtcttggatgggtttatgccattaccaaatatgaaccaattgcgacaattgccgattccatctatggtgtttgggcgaaatatcgtcttcaaataactggccggccaccattagaagaggtcttggagacaagaagaaagaaaaaggctgacatatgcaatgacaacaattgcaagatatgaagtttcctattaattgcagataacaggatacttttgtgaaacctt

SEQ ID NO: 290 - DNA, 567 bp, Helianthus annuus
cattggttttgtttttcgatcgcttctgatcaaaagtaggtcgaaaaaatgaaagaaaccgtaggaaatcctctgcatctaaagtcgttgaatcatatatcgcttgtgtgtcgatcggttgaagaatctatcgatttttatacgaatgttcttggatttttcccgatcagacggcccggatcgttcgatttcgacggtgcatggttgtttaattatgcaattggaattcatttgttgcaatcagaaaaccctgataatatgcagaagaaaagtgaaataaaccccaaggataatcatatttcatttcagtgtgagagtatgggagcagtggagaagaagctgaaggaaatggaaatagtttacaagagacagagggtagaagaaggtggaatctatgtggaccagttgttctttcatgatcctgatgggtttatgattgagatatgcaactgtgataaccttccggtggtcccgatagccggagaaatggtccgatcatgctcgcggttaaacttagatatcatttctcagaaacagatacaaacagttgttcagttgtaagcataa

SEQ ID NO: 291 - DNA, 1127 bp, Helianthus annuus
aactaatggctgagttaaacggaggaggccagtacaccgacttcccggccgtaccgacacacggaggccagttcgttcggtacaacatattcggtaacgagtttgagatcacatcaaaatatcatcctcctatcatgcctgttggtcgtggtgcttatgggattgtttgctcgatgctgaattcggagacgaatgagatggttgccatgaagaagatcatgaatgcttttgataattacatggatgctaagcgaacgcttcgcgagattaagcttatgcgacatttggatcatgagaatgtaatagctataagagatgtagtccctccgcctgcacgtagagaattctccgacgtttacatagccaccgagctaatggacactgatcttcaccaaatcatcagatcaaaccaaaacttatcagaagaacattgtcagtacttcttatatcaacttttaagaggcttgaaatacattcactcagctaaagtcattcatagagaccttaagcctagtaacttgttgctaaatgcaaattgtgacttgaagatttgcgattttggacttgcgcgaccaaatgcagataacgactttatgactgaatatgttgtcacaagatggtatagggcacccgaactgttgcttaactcttcggactattcggctgctattgatgtctggtccgttggctgcatttatatggaacttatgaacagaaagcctttgtttcctggtaaagatcatgtgcatcaaatgagactattaactgagcttttaggtactccttctgaatctgatcttgggtttatcaagaacgaggatgcgataagatttatcggtcagcttccccgacatcctaggaaatcattacaagatacgtttccacatgttcatccgttagcgattgatctagttgagaaaatgttaacattcgatccagccaaacgtatcacagtcgaagaggcgttggcgcacccttatcttgaacgattgcacgacgttgaagatgaaccaatatgtccaaacccgttttcatttgattttgagcaacaagttttaggagaagaacagatcaaagacttgatctaccaggaggcattagcacacaatccagagtatgcttaataa

SEQ ID NO: 292 - DNA, 486 bp, Solanum lycopersicum
cacctttactattactcaaatttctccaaaatctttgaatatgaagaagggaagtagttttattgcaatattgttagtcctttttcttagtgaattgcttgtcacggaggccgtgacatgcagtgttacagagctagttccatgtgccgcggcgatcctgtcatcacaaccaccctctaaggaatgttgcaataagttgaaagagcaaaagccttgtctttgtggatatcttaagaatccaagccttaagcaatatgtcaactctcctaatgccaaaaaagttgctaaaacttgtggagtatccactccaagttgttaggattctaacaaataaaaattcacaaatgatgatcattcatggatgaccagaaaacgcctttcgttttccacacttcctcaaagtgtctaaacactatcatctatatatgtatggcattatattgtaacttgtactcattttatgtattcgtaagccatgttagcttt

SEQ ID NO: 293 - DNA, 388 bp, Hordeum vulgare
caggtaacattctactgtaccgagcacattgaaagatggttaacgcaatcaaggggctgttcatctcctgtgatataccaatggctcagttcattgttaatatgaacgcctcaatgcccgcatcggacaagttcatcgtgcacatccttgaccccacgcacatgtttatccagcctaatatgggagattacatcaaaagcaagatggcggagttcagagaccagaacagctacgagaagccaacgtgaagggccaccatccattaccgcggtgctagcctcaacaaactccatccagggaacctatgttgatcatggctatgtagaatggttatatatatgctgagaccgaacattatgtttcacgcgtgatgttctggaatgactgt

SEQ ID NO: 294 - DNA, 1246 bp, Hordeum vulgare
cgagcgacctttccccatgccgctcccttcgtcctcctcctcctccgccgccgccgccgtcgcggccgggcccgcggcgtccccgctcgccgcccgaagccggggccgcctcctccgcgcgcgctccggccacgccgccgccgtgaggtgccagagggtcgatcctgtgaggctgagggcggtgaatggatcgcccccctgcgttcccctgtccgacaggtcgccgtggacccctgtgacgacgccgattttcggggacgcaagcatcaggaaggacgacacgaggctgcgcatcttctcaggaaccgccaacccctcgctcgcccaggaaatagcaagctacatgggtctagaacttgggaagatcaacataaaaaggtttgctgatggagaaatatatgttcagttacaagaaagtgtaaggggctgcgatgtgttccttgtgcaaccatcatgtcctccagcaaacgagaatctcatggagctactcatcatgattgatgcgtgtagaagagcatctgctaagaatattactgcagtcatcccttatttcggttatgccagggctgacaggaagtctcaaggtcgcgaatctatagctgcaaaacttgtagctaatatgattactgaagctggtgcaaaccgtgtccttgtttgtgatcttcattcaagtcaggccatgggatattttgacatcccagtagatcatgtttatggccagccggtgattcttgattacctcgccagcaagacaatttgttcaaatgacttggtggtggtgtcgcccgatgttggaggtgttgccagggcacgcgcttttgccaaaaaactatcagatgcacctctagcaattgtagataaaagaaggcatggacacaacgttgccgaggtaatgaatcttattggagatgttagaggaaaagtggctgttatgatggatgatatgattgatacggcaggaactattgccaaaggagctgagctgctgcatcaagaaggagcaagagaagtatatgcatgctgtacacatgctgtttttagcccaccagccatcgaaagattatcaagtggtttgtttcaagaagtgatcatcacgaacactatccctttgaaggaggagaagaatttcccgcagctgaccatcctttcagtcgcgaaccttctaggcgagacaatctggcgtgtccatgacgattgctctgttggccatgcgccatactccaccttggatatcgattgagaatga

SEQ ID NO: 295 - DNA, 2777 bp, Hordeum vulgare
ccgccatgaatgtgttcgcgggggtcggcggcagcgcgggggagcgcggcggggcgggcgcggggtccggggcggcggcgagggacgcggggtcggcggacttcggggcgctgctggagctgacgccgcacaagatggcggtgtgccacctcgtgcaggtcttcgcgccgccggcgcagcagcaggccccgccgttccccttcgagtcggccgcccaccacaaccgcctcgggctcttcctcttcgccctcacccgctcatgtgaggatttcctggaaccgccgctggaagagcttttgaggcagttgaaggcggtagatgacttagttaatggttggctttgtgagcagctgacaaccacactggctgggcttaactcaccagacgatttgttcaacttttttgataagctaagaggtgtgctcacttcaccggagggtggaaatgtgggtgatgaatttctggatccaaatagtcagcttggagtttttcttcgttgctgtatactggccttcaattcaatgacttttgagggtgtctgccatctgttggcaaatcttgtggcgtactgtaactctgctgacgcttcatatgatttggcagaagacgaggactttaatagtgaaatagaaatgagcgacccgatggatgcagatataggtgttagatctggggtatttgacagatatactcaaggctatgccactgggagccatatgggggagagctcttcgtctctaatccaagcaccaacctcactccataattttgatgaagccgatattttcaaagcagaggatagtccaacttgtctgagatcaaggtggcaattagaggcatatctgaaccagcaagctgacgttcttgaaaaggatcccagctcggtgcctttgaattcatttaacaacactatgacacagcttcagacattagctccggagcttcatcgtgtccaattcttgcaatacttgaatgctctttgccatgatgactatgttgcttcgttggaccatcttcaccgctattttgattacagtgctgggatgcaaggccttttcagtcgttctttatctcctcaccaagataatattgtcggaaagtatgagagcgctctgctctgcttaggcaacctgcattgttattttggacatccaaagaaagccctagaggcattcacagaagcagtgcgtgtttctcaaatgaacaatgatgactcgtgccttgcatatatattaggagccatttccaatctattatcaaagataggtatatcaagcacagttggattaattggttctcgatattcacttggaaacaatattggactgggcacaccattgtccattcagcagcagttgcttgttcttttgaagcgctcccttaagagagctgatatgctgagacttacaagcttactatcctttgatcacatctctcttgcaaaatttgatttgaagcatgtccaaaggccgttggtgtcctttggccctaatggttctacaaagcttagaacctgtcctgcagatgtctgcaagaatttaagattaagttcccatgtgctgtccgacttcggcacagatagcttatcaatttcgaatgataatggtagtttcagtacctcatggcttaggaatctgtctgatgcttccagatcttggtctaatagctcagcaaagactagaaaacttattgcaaatgactttgacaatttccactttcatgcacaaccaagtccaatacctacatcagtattgcaattagccggctcagcacatttgatgagggccactgcctgggagcactatggaagtgctcagatggttcgaatgaatacgctggtctatgcaacctgctttgctgatgctgcaagttcatcggagctgtcactggcatatgtcaagctaattgaacagttagcagtcttcaaaggatattcagcggcattctgtgcgctcaagcttgccgaagagaagttcccatcctcgatgaattcacagatccaccttctcaaaatgcaattgctacatgagcgtgccttgcatcgaggacacctgagaattgcgcaacaaatctgtgatgaatttggggtgctctcatcttctgtcagtggagtagacattgagctaaagactgaagctagtctacggcgagcccgcacgttactcgctgcaaaagagtttagccaggcagcagctgtggcgaattcccttttcactacatgccacaagtacaacatgcaagtagagaatgcaagtgtccttttgttacttgccgaaatacatagaaagtccgacaacgcggtccttggtctcccttacgcattagccagccaatcgttttgcaaatcgtttaatttggatctgcttgaagcttcggccacacttactctcgctgaactgtggctagctcttggatcaaaccacgcgaagagggccctaagtcttgtttatcaaagccttcctatgattctcggccatggcggtcttgagctgcgtgctcggtctcagttagtcttagcaaaatgccatttaactgatccagaattttcagtttctgaagatccctgtgctgttctggaccctctaaatcaagcagctgaagatctgcatgttttggagtaccacgagatggcgacagaggtgtactatctgaaggccatggcgtataaccacctgggcaagttagacgagagggaggaagccgcggctcgtttcaaggagcacgttaccacccttgagaacccgcgcgacgaggaggattcacttgcttactgatga

SEQ ID NO: 296 - DNA, 1811 bp, Hordeum vulgare
gcataatggggcggtggtgttcgccggcgtcggcggggccgcggtcggtgcagctgctcccgttgggcgtcgccctcgtcgccgcctccttctacgccggcaccctcttccagtcctccgcctcccccgcgctcatattgcccccttccgcctcccggtcgtccggttcctccgaaccccaaggtgcgtcagagttaacaaacaaagttgctcttacttaccgaacagcattaatctcagttccagctcatggacttgatgtgtgtcctttggaacacagcgagtatgttccctgtcacgatgctgcctatgtgagcaagttaagggagctggatagatctagacacgagaatcttgaagctaaatgccctccacgagaggagagcttgttctgtttggtgcctccaccaaacgactacaagatacctataagatggccaacaagtcgggactatgtatggcgtagtaatgtgaaccattcacacctttctgaggtaaaaggaggacagaattgggtgcatgagaatggtaagctttggtggttccctggaggtggcactcacttcaagcatggtgcaacagaatacatagagaggctaggaaatatgacaaccaatagtactggtgatctccgttcagcaggagttgttcaagttttggatgttggatgcggtgttgccagcttctctgcttatcttcttcccctagatattcatactatgtcattcgcgccaaaagatggtcatgagaatcaaatccagtttgctttagagcgtgggattggtgcgatgatctctgtgttggccacaaagcaattaccatatcctggaaattcatttgaaatggttcattgctcccgatgtcgtgttgactggcatgaaaatgatggaatattggtcaaagaggttgatcgtcttttgcgacctaatggatattttgtatattccgctccaccagcttatagaaaagataaagatttccctattatctgggagaagctaattaatatcacaacatcaatgtgttggaagcttattgctaagcatgttcagactgctatatggatcaaacctgaagatgaatcttgccgacagaaaaatgctgatatggggatcctgaatatctgtgaccccagtgacacttcttcatggcaagctccgttaatgaactgtgttcgcttgaacacggaccaactgaagattcagaaactgccttccagacctgaacgcctcttattttattcgaggagtttggaactaataggagttactccagagaagtttgagaataataaccagttctggcgggaccaggttcgcaagtactggtcatttcttggtgttgaaaagactagcatacggaatatcatggacatgaatgctaattatggtggatttgctatggcactaagcactgatcctgtctggattatgaatatagtacccaatacaacgatcaacacactacctgttatctatgaccgggggttaattggttcttaccatgactggtgtcagccattctcaacatatcctaggtcatatgatttgctacatgctttccacctcttttcacactatcaaggtcatgcaggaggttgcttattggaagatatcatgctagaaatagatcgcatcattcgtccacagggatttatcattatcagagatgagaataccactctctcaagaatcagtgatctcgcaccaaagttcctatgggatgtcacgactcgcacgttggaaaacgaagagaacaggccggagcaggtcttgatttgtaggaagaaattctgggccattgtttaataa

SEQ ID NO: 297 - DNA, 2237 bp, Hordeum vulgare
cccgatccaaaatcatcaagcggcgcgggcgcggggggcaggatggcggcggcgccgcccgacgggcaggagaaggtgatcgcggcggcgcagcagatcgtcaagtcgctcgccaactccaagaacgccgcggacgacatgatccgcatcctctccggcttcgacaaccgcttctccctcatgtccgacctcttcccggccgccggcgcccccgacgccgcggccggctccgagctccccgagggggacgaggaggaggtggagtacgggcgggagcggggccccggctacggcggcgacgacgacgacctggaggacgagagggacgcggcggtggaggacgcgctgcggctcatcgagcagtgggactcccccgcggccggggaccggctggtgttcgagtcgcccgaggacgccgaggagtacctcgccgcggccgcctgcctcatgggcgaggccggcccgcgcgtcgaggccgcgctgcaggtcgccatggcgcgcctcgaggaggagttccgccagctgctcatccgcgggaccgcgtcgctcgccgccgacgacctgcacgcgtccctcctccgccgcctctcgctcacggtgcccaccttccactccgcctcctccgtcgacctggagtgcccctccttcgccagccagcccgacgagggggacgaggccgcttccgccgcgggcaggtggagctccgtctccgacggcgagatctcgccctacctcatttcccccgacaccgtcagcaccctcaaggacatcgcggacgtcatgctgcgcgccggctatgggccggagctctgtcaggtttacagcgaggtgcgccgggacacgctcatggagtgcctcgccgtgcttggggtcgacaagatgagcctggaggaggtgcagcgtgtggagtggggcgtcctagatggcaagatgaagaagtggatccaggctctcagggtcgtcgtccagggccttctcgccgaggagcgccgcatttgtggccagatcctcgcggccgacgcagatgctgaggaggagtgcttcactgaggcagccaaggggtgtgtcttgcagctgctcaacttcggtgatgccattgccattgggaagagatcgtccgagaagctgttccgcattcttggaatgtatgaggcactagctgagttactgccagagctcgaggccttgttctcaggtgacgcaagggatttcatcaaggaagagggagaggggatactcgtgaggctaggtgatgcggtgcgtggcacggttgctgagtttgccaatgcgatacggggggagacttcccgcagatcacttccaggcggcgagatccacccgcttacgcgttatgtcatgaattatgtgcgactgcttgcagattacagccgctggctgaatcatcttcttgatggttgcgagactgagctggaaaatgggggtgacaatgcggatatgactccactcggacactgtctgctgatactgatcacacatctattggacaagattgaggataaagcgaagctgtatgatgatgaggcactgcagaacatatttctgatgaacaatctgtggtatgttgtccagaagatcaaagattcagagcttaagactttgcttggggataactggatccgtaagcgccgcggtcagataaggaggtactctacagggtacctccgatcctcgtggaccagggtattagcttgcctgagggatgatgggttgccacatgcaacaggttcatcgagtgcactcaaggctgcactgaaggaaaggttcaagagcttcaacttggcttacgaggagttatacaggacacagacagcatggagggttgtggatcctcagttaagagaggagttgaagatttccatctcagagaaggtccttccagcataccgttcgtttgttggaaggttccgagggcagctggaggggggaaggaattttgcaaagtatataaaatacaaccctgaagatgtggagaaccaggtctcagatttctttgaagggaaaaaattgaatgcttgatcaatctgtctatctttgaaggaatgttcatatcaatggttgtggttataaatccctggcaaaattcattcgggcaatgtgcttgaaacttgccctaccatcatgcttgtgaggttcgaagatggagaaatcaattttgactggtggatcagaaatattgtgaatgcaaggcaccctgggtcgaatactctgcgtttcat

SEQ ID NO: 298 - DNA, 1646 bp, Hordeum vulgare
tagccaccgtcactcttcgccgccgtgatccgcctgggccccgccgtgccggggcttctggagagagcgagcgggtgggtcgccggcctcgccgcctccgtcccgtatttccctctgatcctgccctctccgtggtttgggtctcaggggaccaaacctttccgccgcggcttgctggcgagtgaagtgcttttcttagtttccaatccgcgtatttttgcacacataattggttttccttcattggagtttaccaatgtcggccggagccactataaactggatcagaaccccatttcacacccagagatttcatgacttctcaagtctaagttttagatgccgaaacacttttgggtcaattcagccttgctggttggcaactgatcaggattcatccctctctaaagtccgtgtggctgcagactactcagattcattgccagattccaagtacatgagagatcggggataccatcctcttgaagaaattaaagaacgcccaaagaagaaggacatttcactgacagatgtagaaacagctagaacagtagtagaggcaaatagcaagggattgctcatatttcctgccagggtgcataatgaacctcatggacatgtttcatggtcagagtttcagtatgttgttgatgactatggagacattttctttcaagtacctgatgatgggaacatcttggaagatgatgatgcaaacaaccctgtgacagttttgatcggaacagatggtgcaattattggagaaactagtgtggtaactagtgatttcaacgaccacgtggtcattgaggattctatggacatgcatgatgatgacagcaaggttgacacagaaataacgaatattctcatagagtggggaatgccagtaacaatgcgttcaatacatcctatatactttgccaagtgtttgacaaaggctgttcatgataatcacggggagaagattgataatccatcaaacggggtctctattgtaggatacctgagacctgcttttatagaagaagaatcttatttgaggagtttatttcattctgaatgcaatgccgatggttattcatctgagtggagagaggaatacaacagagaaccccggccagcttctggaaccaatggcctaattgatggtgataaattgagattggacatcaatgatgcgggaagtagcattgattcaaccatctataagctggaaatgatgacaattgagctgttttccgtctatgggaagcagtttatgattgatccacaagactttcaagatgcagaaccagatcttctttcaaatcatgcttcggacattataaaacgcatggaagaaaacagtgatcagtgtaccatggctctacggtccctctgtagcagaaaaaaaggcctcacggtagaggaggcacgcttgataggcgttgatagtcttggtatcgacgtgagagccttttctggcttggaagctcggaccgttcgattttcattcaatgcccaggcgttatctgaacgttcagccgaaaagaagatcaagcgaatgctttttcctcgttatcgcaagaccgtgaaagcttccgctgaagatgaatgttagccaacttatttaattttagcttcgaacgcctaacagtaagctg

SEQ ID NO: 299 - DNA, 4153 bp, Hordeum vulgare
ggtgattgttgcccatccatgggttcgctcacgaaggcggcggaggagggggcgttcgcggcggtggactggtccgacgaggcggtcatctacgtcaacggcgtccgccgcgtgcttcccgacggcctcgcccacctcaccctcctccagtacctcagagacatcggtcttcgaggaacaaagcttggatgtggtgaaggcggttgtggtgcctgcactgtcatggtctcatgctatgatcaaactacaaagaaatcagagcattatgcaataaacgcctgcctggctccactttattccttggaaggaatgcacataatcacagtagagggaattggagatcgccagcgaggtttgcacccagtccaggaacgtttagccgaggcacatggttcacaatgtggattttgcacccctggtttcgtgatgtccatgtatgcactgctgagatcgagtaaacatcctcctactgaagagcagattgaagatagccttgcaggaaatttgtgtcgctgtactggctacagaccaataatagatgccttccgtgtgtttgcaaaaacggatgattccttgtacacagcttcaccttcagaaaatgctaatggccaagctatctgcccttcaactgggaagccatgttcatgcagaaatgagacagatgtcaatgctaatgaatcttcaacatcctcttccgtgaaaatctacttaccttgttcatacaacgaaatcgatggaaattcatacagcgagaaggagctcatttttcccccagaactgcagttaagaaaaattatgccacttaaattgaatgggtttaatgggatcagatggtatagacctcttaaattagagcagctattgcatttgagatcttgctacccagatgcgaaacttatcattggtaactccgaagtgggagttgaaacaaagttcaagaatgctcaatataaggtcatgatctcagttacccatgttccagaacttcataccctcaaagtggaagaacatggcttacacatcggttctgcagttagacttgcacagctccagaagttcctcaaaaatgttattgcggagcgtagttctcatgaaacttcgtcctgccacgcaatactacggcagttaaaatggtttgcaggaacacaaatcaggaacgttgcttctgttggtggtaatatttgtactgctagtccaatatcagatctaaacccactttggatggccactggtgcaaatttccagataattgatgtcaacaataatgttaggactattgccgcaaaagagttctttcttggctatcgcaaagttgatttaaaggctgatgaaatattgctctctgttatactaccatggacaagaccatatgagtatataaaagaatttaaacaggcacatagaagggaggatgacattgctttggtgaatgctggaatgcgtatgcatataacagaagctgaaggaaactggatagtatctgatgtctctattgtctacggaggggtagctgctgttccacttactgctgcaaaaactgaaaaattccttgttggaaagaagttggatgatggattgctggatgagacctttaatttcttaaaagaggacatcccactagcagagaatgcaccaggtggaatggttgaatttcgcagttcgctcacgttgagtttcttcttcaaatttttccttcatgttatgcatgagatgaacattaaagggttatggaaggttgggctggatgcagctaatatgtcagctatacagtcttacactagacctgtttctattggaacacaaggttatgaatcagtggggcaaggaactgccgtgggacaatcaatggttcatatgtcagctatgcttcaggtcactggtgaggcagaatatgttgatgacacaccaacacccccgaataacttgcatgctgctctggtgctgagtaagaaggctcatgctcgcattttgtctatcgacgattcagttgccaaatgttcccctgggtttgctggtctgttcctttcaaaagatgtgcctggttctaaccatattgggccaattatccatgatgaggaggtttttgcatctgatattgttacttgtgttggccagattattggaattgttgtggcagatacccatgataacgcaaaagctgctgcaaataaagtaaatattgaatattctgagctgccagcaatcctctcaatagcggaagctgtcaaagccggtagctttcatcccaataccacgagatgcatttcgaatggggatgttgaacaatgtttttcatccaatacatgcgataaaattatagaaggagaaattcgagtcgggggtcaagagcacttctacatggaacctcaatgcacttttgtctggccagttgattctggaaatgaaattcatatgatctcatctactcaagctccccagaagcatcagaagtatgtcgcaaatgctcttggtcttccactatcaaaagttgtttgcaagactaagcgtattggtggcggatttggtggaaaagaaactagatcagcaatatttgctgctgcggcatctgtagcttcctattgtctaagaaggccagtaaagattgttttggacagggacgttgacatgatgacgactggacagaggcacagtttcctagggaaatataaggttggatttaccaatgacgggaagatactggccttagatctcgaaatttacaacaacggtggtaactcactagatctgtcccttgcagtcttggagcgtgctgttttccattcggaaaatgtgtacgctataccaaatatcagagtcagtgggaaagtatgctttacaaatctcccaagcaatactgcttttagaggttttggtggtccacagggtatgttgattgcagagaattggattcatcacatggctacagaactcaagcggagtccagaggagataaaagaacttaatttccaaagtgagggaactgaggtttattatggccagttgctccgtaattgtacaatgcattcggtttgggatgaactgaaggcatcttgtaatcttttggaggctcgcaaagctgtaaatgttttcaacaatgaaaatcgttggaggaagcgaggcattgctatggttcccacaaaatttggcatatccttcactgcaaaatttatgaatcaggctggtgctcttgtccaagtttacactgatggtactgtcctggtaacacatggcggggttgagatgggacagggtttacacacaaaggtagcccaagttgctgcctcatcactagatatccctctaagctgtgtatttatctcagagacaagtaccgataaggttccgaatgcttcaccgacagcagcctctgccagttcagatttgtatggtgctgcagttttggatgcttgtcagcaaataaaggctcggatggaacccattgctagtagggggaatcatatgtccttcgcagagttagctcaagcatgctacatggaacgagtagatctttctgctcatgggttttatatcacccccgatatcgggtttgactggattgctggcaaggggagtccatttaattatttcacgtatggagccgcatttgcagaagttgagattgacaccctaactggggatttccacacaaggacagctgatattgtcatggatctcggctattcgattaatccagcaattgatattggccagattgaaggagctttcattcaaggtctgggttgggctgccatggaagagctaaaatggggggatgacaaccacaagtggattcgacctggacaccttttcacttgtggtcctggctcttacaaaataccctctataaatgatatacctctcaatttcaaggtttcactattgaagggtgttccaaatccaagggccatacactcatccaaggctgtcggagagccaccgttcttcctcgcttccgccgtcttgtttgcgataaaagacgcgatcgcggcggctagggcggaggagggccatctcgactggttccccctcgacaacccggcaacgcctgaaaggataaggatggcgtgtgttgactccattacgaagaaatttgcgagtgtgtattaccgtcccaagcttagcgtatagtggttgctgccagagtagccgatac

SEQ ID NO: 300 - DNA, 917 bp, Hordeum vulgare
agaggcgcagacacactttccggccatgtcggcggcggcagtagctgcggacacgtactccccagccgcggaggctgggagcaagcggcgggagaggcgggaggagctgcggcgccacctcgccgaggacgccgattggccccgcgccgacggccgctccttgcacgactgccgccccgcatttatgcaaacagggccaactactgctgcgtcagggtctgcttatgcagaatttgggaagacaaaggtcattgtgtcagtgtttggcccaagggagagcaagaaagcaatgctgtacagtgacactggtaggctcaattgcagtgtgagctatacaacatttgccactggtatacgtggacaggggttggaaaacaaagagtactctggaatgcttcacaaagccctggaaggcgcagtaatgctacatacttttccgaagactactgttgatgtttttgcgttggttcttgagtctggtggcagcgatcttcccattataatatcttgcgctagtcttgcactggcagatgctgggatcatgatgtatgaccttgttacatcagtatctgtgtcctgtttagggaagaatgttatcatcgatccaacctcagacgaggaggcatggcaagacggaggccttatggtgtcttatatgccggcccgcaaggagatcacacaacttacgctgactggggagtggactgatggcaaaatcaccaatgcagtagagctctgtatggatgcttgcagcaagctttgcgagatattgcgggagcgcttgaaagaccccgcgagcctggcgagcgaatgacatttgagcagacacatgtttgcagaatcgcaacagatatccttagctgtagaagttttgtagggaagggaggacaggactgctgtttgcaggagcacaattt

SEQ ID NO: 301 - DNA, 745 bp, Hordeum vulgare
cagctgccagcgaggtagggagaacaatggcggccgccgcaggcgacggcggcagcgtcccgccgaagagcccaacagcggaggcgcctcccgcctctcagccgcgcctgacccccaataccatgccgtgggaaaggtgcgtcgccggcgtccagtcggctctcaaagatccgttggcgcggttcctgagggagcagatcgagaaagccgggtgcaccgtatggccgacgctgatccgggcggccatctgcacggctagcgggggctacacaagcggcaaggggatagaagtttgctgtaatcacatgcgaaagcaagatgaaataactcaggtcataattcatgagttagtacatgcttatgatgactgtgttgtcaagaacatcaactggaacaactgcgctcaccacgcttgctctgagattcgagctaatcaccttagtggcaattgccattacaaacgtgaactgatgaaaggcttcctgaagataaaggggcatgagccagaatgtgtcaaaagacgagcgctgctttctgtccagaacaacccttcctgtcgagggaaagcggcaaaagaagcagttgagaacgtgtgggatacgtgctacaatgacccacgcccgtttgataaggctccatgaagtgcaagttgttgggacagttttgttaactttcagacgggttttatcaagtgtaatcctgtgggatagtttagttttccttcagatgggctccatgaagtact

SEQ ID NO: 302 - DNA, 1230 bp, Hordeum vulgare
tcttcttcctacccatttccagccgtcgccgccgccgccgaggtcgatggagagatggaggcgggtcagcgtgctggccatggcgctcctgctgctctccgcttgtcatggagcagagttctctgtcaagaatcacgatcagagtcttatttatgaccatactcttgctaagaccattgtggaatatgcttcagctgtgtatatgacagatctaacagctttgtatacatggacatgttcaagatgcaatgacttgactcaagacttcgagatgaggtctctaattgttgatgtggagaactgtttgcaggcatttgtcggtgtagctcacaatctaaattccataatagttgcaatcagagggactcaagagaacagtgtgcagaattggatcaaggacttgatatggaagcagcttgatctaagctatccaaacatgccaaacgcaaaggtgcacagtggatttttctcctcctataataatacaattttacgtctagctatcacaagtgctgttcacaaggcaagaaagacatatggggatatcggcgtcatagtcacagggcactcaatgggaggagccatggctgccttctgtgcacttgatcttgctatcaagcttggaagcgacaatgttcaactcatgactttcggacagcctcgtgttggcaatgctgttttcgcctcctactttgccaaatatgtaccaaacactattcgactggtacatggacatgatattgtgccacatttgccaccttatttctcctttctttccaaactgacgtaccaccacttcccaagagaggtatggatcgatgattctgacggcaacacaaccgaacagatttgtgatgccagcggcgaagatccaaactgctgcaggtgcctctccatattgagcctgagtattcaggaccacttcacatacctgggagtagatatggaatcagatgactggagcacctgcagaatcatcacagcccaaagcgtcgagcgattacggaaggatcttgccagcaacatcatcatgacaaagcatgatgccgacgtctccattgtcgagaatagtgtgcagacagactggagcagttccagatagcatactgcattactgttaacactatttgttacagaagacgacaccttttctttctcttgaagatggggggtttcagttggggaatttcattcagattgggttgtacattgttctttcatagcctgtga

SEQ ID NO: 303 - DNA, 757 bp, Hordeum vulgare
cactcgagcggagcagaggaagcggtgccagggcttcggttcgagggaggatggggaagtcgaagagcaagggcgccaagttcgccgccgtcaagaagatcatcagcaagaagaccatcaagaagcacaaggagaagctgctggaggaggtgctggacccccggaagaaggccgccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttagatttggagaaaggaatgatggattgcctttatgcaaaatgtaccccttgcatcactgattgtgttatggctgaacttgaaaagctaggacaaaagtaccgtgtcgcgttgagaattgcgaaggaccctaggttccagagattagcatgcacacacaagggaacttatgctgatgactgtattgttgagagaattactcagcacaaatgctacattgttgccacttgcgatagagatttaaagaggagaataagaaaggttcctggtgttccaatcatgtatatcacccaacacaggtactcgatagaacgactccctgaagctacaattggtggagcaccaagaatctgattagctgaaatacaccgtcacagttgcccaagttccttgatttaggatggacatgagtactgccgtgctgaatcgagctgattgtaaccacttca

SEQ ID NO: 304 - DNA, 1046 bp, Hordeum vulgare
ccgcattgacggatagagatagagcacatccatgtccaggttgatggccgccatgcttctcggaggcgcgcgggtcgccagcgccacggcgctcaccggcaacactgctgtgaaggccattcccaggccctgcttccttgctccccggccgcatgccgcgagctggagccccatctgcatgcagaccgccccgaggtcgtcgcaggcgtataacaacgctccggacgaccggagggacatcaaggacaagtacaggggcgcggcggagcaggccaaggacgccaccggcgatgccaaggagagcgcaaagggccaggcgtcgcgcatggccgacgagaccaaggacaaggcgggggacgccgcccagagggcctcccaaatgacggacaaggcgaagcacgagacgaaggagacggcaagccaggccgcggacaaggcgggcgagatgaaagaccgggccaaggagacggcggaggaagccgccgagaaggcctcccgcatgacggagaaggccaagcacgagacgaaggagacggcaagccaggccgcggacaaggcgggcgagatgaaggagagggccaaggagacgacggggcaggcgatggacaaggccaaggagacggcgggtgcggccaaggagaagacggcggaggtggcggagggcgccatggacagggccggcgaagccaaggacagggccgcggagggcaccaggagcgccggggagaaggtggcggagttgaccaaggagggcgcgagcaagatggcggagaccgcgcaggccatcggcgagaaggcgaagcaggcggcgcagggcgcctgggacgccaccaagggagccgcgcaaggggtgaaggagaaggtcgtctcggagagcacgacggaggagcactcgacgtgggacgacgtcgaggcggcgacgaaggagagggacaggatcgcgcaggaggagcggaagaggcaggccagggagaagggcgccggcttgccgtagacaaagatggctgtctggaaatctgtacgcgtctagtggcctctgtttcgag

SEQ ID NO: 305 - DNA, 1742 bp, Hordeum vulgare
atcaaacgccctgctcactccgaggcgcggccatggagctcgccaccgcggccgtcgtctccacagcctccatccaccacggccgcagccattcctcagccccacgaacagcctcctggtctagctcctcgtcgccgtcctcatcttggtccctgtccatccccgcctccacctcgcggtcccagaggcgacggctcctcgtcacctcggccgccgtagagctccgcgaggccgccgcgggtggtggggactccgtccgcgtcatcgagacgccgcagcccaactcctgtgttaagttcagcgtggaggtgcctccctcgatatgccaggagtgctaccaaacaactcttctcgagtactcaaagcgtttcaaggttcctggatttcggcctggaaagatagttccagaaaatgtacttttaaactacgttggaccgcaacatgttcgggccgcaacagttgaagctatcttaagacatacgcttcctcaagcattgtcctcggtagaagagagggcattagaagattctgtgcgcattctcactaagtttgatgacatgaacgaggctttctcccttgaccatgtctttagatatgatgttgctgtggatgttgttcctgaagtccgttggttatctgaagacaaatataagaacctcaaagtggttattgaaatagatgaaattgttgatgcagaaaaggcagccgagttagagcttaagcgtcgccgtaaatctctagggctgcttcgaatagtaactgacagaggcctacaggtaggtgatcttgttgtactggatatattggctgaaactatcacgaccgacggctctaaaggtgaaaaaattccatcagctgagagtacagggttccacttggacactgaggaaaatactaatcttgttcctggatttctgggttcgctgattgggattcgtcctggtgagactagaacttttcctattcagttccctgagtcatttgagcaggaaactctacaaggtgtccgtgcccagtttactgttgtctgtaaagaacttttctacagagagttgccagaattggatgattcgcttgccgcaaagctccttccaggatgcaataccatcgatgaggttaaagagcgaattttggaaagatgcaaagaagtggagaagacggctatagaacaagcaacagataacgcaatcctcgaccaactgggaaagttggtagatgttgatgttccacgttccttgtttcaagaacaaggccagcagttgtatggagccaaacttctacaacttcaggcagaaaggaagctagacaaagaccagctagcatccctttcaagcgagaagtcggtccaggagtacctaaaatccgagagggagaacatcactaggatcattaaacaaatgttggttgttggtgaaatattcaaggccgaaaatttgcagtattcgacagaccagctcgtcaaggaagttgagaactccatagaagagttcaaacgctataatcaagactacgacgaggggaacatcaagcagcaggttcaggatgttctggaggctgcaaaggtgcttgagtggctcaaggagaactgcacgatcgagtacataaaaaaatgagcgcggcgctcgatgctctgtcagttttgaaggatggcaggcgtgcaaactctctctggcctaccttggttttgcagacgggaagggtttgctctgtttatagcacacacaagagagaggtctcgttag

SEQ ID NO: 306 - DNA, 2273 bp, Hordeum vulgare
ggcgacgaataagtagcaaatctttacgccggcaagatggtgcagtataatttcaagaaaatcactgttgtccctcctgggaaggacttcattgacataatcttgtcccgcactcagaggcaaacaccaactgttgtccacaagggctatgctatcaaccgcattcgccagttctatatgcgcaaggttcgctatactcagcagaacttctatgagaagctttccaccatcatcgatgagttccccagactggatgacatccatcctttctatggcgatctcctccatgtgctctacaacaaggatcactacaaacttgccttgggtcagatcaatacggctaggaatatcattgcaaagatctccaaggactatctgaggctgctcaagtatggagacaccctgtaccggtgcaagtgcctgaaggttgctgcactaggtcgcatgtgtactgttctaaagcgtatcagtcctagtttggcatacctggagcagatcaggcagcacatggccaggcttccatcaattgacccaaacacccgtactatcttgatttgtgggtatccaaatgttgggaagagctctttcatgaacaaggttacaagggctgatgtggacgtgcagccttatgctttcacaacaaaatccctttttgttggccatgcagattacaagtatctgcgttaccaagtgattgacactccagggatccttgatcggccttttgaggataggaacatcatagaaatgtgcagtatcaccgctcttgcccacttgagggctgctgtgctgttcttcttggacatctctggttcttgtgggtacactattgctcagcaagctgcactcttccacagtataaaatccctgttcatgaataagcctctggtcattgtgtgcaacaagactgatttgcagccgcttgatgggctttctgaagaggacatgaagctggtaatggagatgaagtcagaggctatgaagactataccgcaaggtggagatcccagtgaagagggtgttttgttgactatgagtgctttaacagatgagggtgtgatggctgttaaaaatgctgcatgtgagaggcttcttgagcagagggtggagatcaagatgaagtcaaagaagatcaatgactgcttaaataggtttcatgttgctatgcccaagcctcgtgacaacagagataggcctacttgcattcctcaggctgttgttgaagctcaagcaattgctgctgcaaaggaaaagaagaaacttgagagggaccttgagaatgagaatggaggtgctggtgtctattctgccagtctcaaaaagcattacttgttggctgatgatgaatggaaggaagatattctccctgagatattggatgggcataatgttgccgatttcctggatccggatatcttggaaaggtgtgaggaactggaaagggaggagggtcttcgtcttgaagaagaagctgctcaggatgctttcatgattgatggccatgacgaattaactgaagaacagcgtgagatactgggtaagattaggaagaagaaggcaatgctcatccaagagcataggatgaagaagagtactgcagagagccgtcctatcgttccaaggaagcatgacaaggataggaaattcacaaccaagagaatgggcagacaactcacatccatgggcgttgatcctactgcagctgtgaaccggcttcgcagccagtcaagaggccgtaagcgtgagaggtcactgagcagagctgatggtgacaatgctatggacgttgatggccagcactcagacaagaagctgcgtacaaggtcgaggtctaggtccaaatcacgaccaattgaagaggtcgtaccaggtgacgggatccgggatgttgctcaaaagaagaaggccatcaagaaatcaagggactctgtcaagaacaggaacaaggaggctcgccgtggagaggcggatcgcgtcatccccacgttgaaaccgaagcatctcttctctggaaaacgaggaattgggaagaccagcaggcggtaaacaagtcaatgtggacgttgctgcttgcgatcactcgatcaggaactgcagaatcactgccatttttcgtgctgggcatcgggggaggcttgagcgccaatctggcaggagatactaccatctactgcatttttatctttgtctggcttttgctctctgttactcgtttgttagactacatcgttgtcgaactatatgcttgtaccatcggtctactccgcactagt

SEQ ID NO: 307 - DNA, 716 bp, Hordeum vulgare
cagcaatgggttcccttcacaagggtggggtttggtggttgctcctgctcgccgcggtgctgctggctaccgcggcggcaggcgcggagcaggacgatggggcggcagccactgccgtcccggaggtggaggtggaggtggaggaggtcggccggcccgtcgatgatcagggcaacgactcgtgcgacatcaagtgccaacatcataaagttccggcgaggaagaaacagtgcgtcgacgagtgccacagccgggagcatcatcacccaagcagggcgtcttgcgagaggaagtgtagccattggagagacccggcaaggaaggaacagtgcgtgcagcagtgcatgcgctacggcctcaacctcgacgtgggcggcggtgacgatgtcatcgagcgcccccacgccgaggaggtggaggtcgatgatcagagcaacgactcgtgcgaccacaagtgccaacatcataaagttccggcgaggaagaagcagtgcgtggacgagtgccacagacgggagcatcatcacccgagcagggcggcttgcgagaggaagtgtagccattggagagacccgacaaggaaggaacggtgcgtgcaaacgtgcatgcgctacggcctcaacctcgatgtgggcggcggcgacggcgacggcgacggcgagcagctccgccgctgggaagcggtggccggagccatcatcgaggtggtgtgatga

SEQ ID NO: 308 - DNA, 988 bp, Hordeum vulgare
atccaattcaatccgtcttcctcttctcctctccttgctgcactagtagatgagcatggcggcgacggcaccggcggccgccacggccacggcctggccttccacctcctcctctatccaccaccacgccacccccaacccccgcgccctccgctccggcttcctcggccgcgccctcacgctctgcccgcacccggtggacgcccgcgccgccgccgccgccgccgtgtccgtgcgcgcggcctgggacgggccgctctcctcggcgcgcctcatcatgcagggccgcaacgtcaagctgacggagaagctcaaggagcacatcgaggacaaggtggggcgcgcggtgtccaaccacgcgcacctggtgcgggaggtggacgtgcgcctctccgcccgcggcggcgacctcagcaagggccccaagctctcccgctgcgaggtcacgctcttcacgcgccgccacggcgtcgtgcgcgccgaggaggaggaggaatcctcctacgcgtccatcgacgccgccgccgccgtcgtcaagcgcaagctccgcaagatcaaggagaaggagacggacgtgcgccacctcaagggcaccaaggagtggcaggccgccgacgctgatgcgactggcttctccgacgtcgaggaggaatcggagctagagctcgaggaggacgacctggtcgaggtcatcggcgccgaggacgaggagaccgtgctcaccaaggttgtgcgcaccaaggtgttcgagatggcgccgctgacggtggacgaggcgctggagcagctcgagaacgtcgaccatgacttctacgccttcaggaacgagcagacaggcgaggtgaacatcctgtacaagaggaaggagggagggttcgggctcatcatccctaagcaggacggccacgtcgacaaggccaccgtcaacgccaaggagcaccccgtcgccggctgaccacgccctccgtcaatcactagctgtagctag

SEQ ID NO: 309 - DNA, 1242 bp, Hordeum vulgare
ccatctaaactaggtggaacagtacgtacacggcaaagcaaatggcctcaggagtgtttggtacccccatttcggagaagacggtgatagccaccggtgagtataaggaacccattactcaaaaggatgttgcagactataccatgaagatgatcaacgccggtggtaaggatattaacgcacaaaccttcgtcgacaatctcaaagagcggtacggtaacggaatagctgtaaaatgcctcatctacaatgccactggtgccactttgagcttggctaagtacaacgattggcacggccatatctatgatacaccctacccatcagatattcagaatgggcaatggggtgcattcctccacgtccacccaagtggtgctgcggttggttcagctggtgccgttgtgtatcgtagcaagatcccctccagcaccaggtcctgcgattggttgttctcctggaccgtcccctacattggtgccaacggggtgtacaccgaaatccgtgaggaaggacactacccaaatgtgggaagctggggttatatctatggtgtgaagcttgcaaattcagatctcaactctactgataaaaactatggatatgtttccaagactaatatcggtgaaggctctaccatgaacgcccgtggagttttccagtatccctactagatctcgttatcaacatcaaaggcttgtgtggcgaagacgttgcggtgtatttcctaagagccggtgtacaaactatggatatgtttcgtctactatctttgtggtgcatttcctaagatcgggtgcttatgaataatcaaggaagaagacaataaatgagatatcatgtgtgattttatattatttacaagtcgtttgtgtcaagctatccctcttttgtacccactactgttatcctaaataaatatcaaatttatgatactcccccgtctcggtttataagtcatcttagaaaaaccaaataatccccaaaaaaaattaggcacagtacattaactttcacctcatttctgtttttttacatgaataaaggaattaaccaaaaagagacgtggggcgtttatgtttttaatgacttgagactaactgacatgacatgcagtggtcaatttatagtatgggcattatattagcaaattaactttaatttctctcgttttcctctttgtcttggtcgcattgcacaacctaagattacctatacaccgagacggagggagtactcttc

SEQ ID NO: 310 - DNA, 346 bp, Hordeum vulgare
tccgataccaaagctcatcttcttctccttgaaatcttttcgggttcaccagatctgaaggatgtcttgcaactgtggatccggctgcagctgcggctcagactgcaagtgcgggaagatgtaccctgatctgaccgagcagggcagcgccaccgcccaggtcgccgccgtggtcgtcctcggcatggcgcctgagaacaaggccgggcagttcgaggtggccgccggccagtccggcgagggctgcagctgcggcgacaactgcaagtgcaacccctgcaactgttaaagctgctacgtaagtgtgatggtgtgagagtatacgtgaataacgagcgtctgatga

SEQ ID NO: 311 - DNA, 797 bp, Hordeum vulgare
gagacatgtctctgcagtgcactgcaaactcactccgggctcttgctgcgctcccggcgccatcctcctcccgccgcctggcgagaaatgctttccttatgccatgccatacgagtcgcatcggtgcgctggtccgagctgcggattcttcccctcccgccgcacccgcgtcatcgtccggagcagccgacaacaaggccgtcatccccgacgatgagttcaccctcgccaaggtgtcttttggcgtgattggactagggataggtggctccctcttgtcgtatggatttggggcgtatttcaatcttctccctggttcggagtggtctgctctgatgctaacctacggatttcctctcacaatcataggcatggccttaaagtatgctgaactgaaaccagtgccctgcataacctactctgatgcttttgctctaagagaaaagtgtgctacccctatcctcaagcaggtcaggagtgatgttacacgctatagatatggtgatgagcagcacctcgatgaagcgctaaagcggatctttcaatatggtttgggtggcggcattccaagacgtagtgcacctatattacaaaagattcaagaagtaactgatgatgggaaatactgtttagtactggaatttgaagccaaatcgttggggctatcagattttgagaagaggcaggcaaaattcacctcctttttcggtcctgggattgaggctaaaatcggaaaaggtggtgacgatctatatgaagttcgccttatctcggagaccaccgaggaagagtgatga

SEQ ID NO: 312 - DNA, 2751 bp, Hordeum vulgare
aaaggatccaactgttccacagtcgtcgtcccctgtcctctccccgtcctccgccccgcccgcaatccaatcccggaccggcggctggcgagcgagcgagcgagatggcgacgctgacctcggagctgctgcggccggtgcacgaggcgcaggcgctggacgaggcggcgctgctgcggtacgcggccgcgcacgtcccgggcttccccgcgccggcgccggcgctcgccctcacgcagttcggccacggccagtccaaccccacctactgcctcgaggcctccgcgcccggcggggagccccggcgctacgtgctgcggaagaagcccgccggcgccatcctccagtccgcccacgccgtcgagcgcgagttccaggttctcaaggctctgggtgcttacacggatgttcctgtccctaaggtgttttgcctttgcactgatgctagtgtgatcggaacccctttctacataatggagtatctggaaggagcattatatcttgataacaagttgacgggaataaccccagataaacggaggaatatatacctggctgctgcaaaaactttggctgctgtacacaaaattgatgcgactgcagttggattgcataagtatggaagaagagacaattattgcaaaagacaagtagaaagatggggaaaacaatatcttcattcaaccggtgaagggaagcctgcgcgttatcagaagatgcttgatctaattggttggctgaaagaaaatataccagaagaagattcatcaacaggattgggaactggccttgttcatggtgattatcgtattgataaccttgtttttcacccaactgaggatcgagtgataggtgtacttgattgggaattatctactttggggaatcagatgtgtgatgttgcttacagctgtatgccatatattattgatggagcactcagtgaaaatagttcatatggaggatttgaacattctggcattccagatggcattcctcaactggaagagtacctagccgtgtactgctctatgtctgcacgaccttggcctgcagaaaattggaagttctacattgccttttcactgtttcgaggggcatctatctatgcaggagtataccacagatggactatgggtaatgcttcaggcggtgagcgtgctagatttgccggcaaggctggcaatgttatggttgactgtgcctgggattacattaatagagaaaatgtcctgagagcacaccctgctacaggtatgcatgtctcgaaggctccccaacaaggtttccatgtagagcaggaagattcaactttgacaagtggtcaaggcaaatttgttcctagcgaaaaggttatgaagctacggcataaaataatgaagttcatgaaagatcatatataccccaaggaagatgagttatacaaacatgcacaatcaacctcacggtggacaatccatcctgaagaagaaaatttgaaagcattagcaaaagaggagggattgtggaacttatttattccgcttgacagtgcagctagagcaagaaagctactccttgaggaccgatcttatgtttctgctggaagttcaaatgatcttttgctaggtgctggtctcacaaatcttgagtatggatatttatgtgagattatgggccgttcagtttgggctccacaaatatttaactgtggtgcacccgatacgggtaatatggaggtcctgttgagatatggaactaaggagcaacagaagcagtggcttgttcctttactggaagggaaaattcgttcgggatttgcaatgacagaaccacaagttgcatcttcagatgcaacaaatatagaatgttcaatatccaggcagggagatttctatgtgataaatggcaggaaatggtggaccagtggggctatggacccgaggtgcaaaatcctgatattaatgggaaaaaccgatttctctgcacctaagcataagcagcagtcaatgatcttagtggatatcaacactcccggagtgcagataaagagaccattgttagtctttgggttcgatgatgcaccgcatggacatgcagagattatttttgataacgtccgtgttccggtcacaaatatcctcctcggagaagggcgtggtttcgagattgctcaaggaagactaggtcctggaagattgcatcattgcatgagactaataggagcagctgaacgtggcatgaatatgatggttgagagggccttaagtaggaccgcctttggaaagaagattgcgcagcatggttcctttcagtcagacctggcaaaatgccggatagaactggagcaaactaggcttctggtgcttgaagcagccgatcagctcgaccggcatgggaacaagaaggcccgcgggattctcgcaatggccaaggtggcggctccaaatatggccctgaaagtgcttgacatggcaatacaagtccacggcgctgccggggtctcatccgacacggtcctatcccatctatgggcaaccgctaggacactgcggctcgccgacggccctgatgaagtccatctcggcacgatcgcgaagctggagctgcaaagggcaaggctgtaagatcaggacgaggtccagattcaataagggggacggcaaacctttggagaaggtcagttaaggatatcatcacagtcacgggtagatagaatggtgaataagtggcgttagattcctccatgtacactccctgtttggtaccttt

SEQ ID NO: 313 - DNA, 983 bp, Hordeum vulgare
gaaccatgagctctcggatggccggagccacgcttctgcgccacctgggcccccgcctcttcgccgccgccgagccggcctccgggcccgccgcgagcgcaaggggcgtcatgcccgccgccacgaggatcttcccggcgcggatggccagcacggccgccgccccgcacgccaaacaagaagaagccactgagaagccccagggcgcgacgacgccggagcaggcggtgagctactggggcatcgagccgcggaagctcgtcaaggacgacggcacggagtggccgtggttctgcttcaggccgtgggacacgtaccggccggacacgtccatcgacgtggccaagcaccacgagcccagggcgctgccggacaaggtggcgtacctcatcgtgcggacgctgcgcgcgggcagtgacctcttcttccagcgccggcacgccagccacgcgctgctgctggagacggtggcggccgtgccgcccacggtcggcggcgtgctgctgcacctgcgctcgctccgccgcttcgagcacagcggcggctggatccgcgcgctcatggaggaggccgagaacgagcgcatgcacctcatgaccttcatggaggtgacgcagcccctgtggtgggagcgcgccctcgtgctcgccacccagggcgtcttcttcaacgcctacttcgtcggctacctcgtctcccccaagttcgcgcaccgattcgtcggctacctcgaggaggaggccgtccactcctacacagagtacctcaaggacctcgaggccggcttgatcgagaacacgccggccccggccatcgccatcgactactggcgcctccccgccgacgccaggctcaaggacgtggtcaccgccgtgcgcgccgacgaggcgcatcaccgcgacgccaaccactacgcatccgacatccattaccagggaatgacgctgaatcagacgcctgcgccgctcgggtaccactaataa

SEQ ID NO: 314 - DNA, 1780 bp, Hordeum vulgare
cggcccatccatccatccatccatcgccgccgtccgccggagatgctcggtcggctggccgcgcggcggccccgcccaggcagcgcccgcgccgcagcagcctaccgctcctcggcctcggtcctgcccgacgcgctcgaccggagctccgacgcctacgcgcgcaacgccgccgccgtcggcggcctcctctccgacctgcggtcccgcgtctcccaggtgctgggcggcggaggcgcgggggcggtgaagcggaacgaagggcggggcaagctgctccccagggaccgcatcgaccgcctgctcgaccccggggcctccttcctcgagctctctcagcttgcaggatctgatgtttatgaggaagcattaccatcagctggaataattactggcataggacctgttcatggacgactatgtatgtttgtggccaatgacccaactacaaaggggggtacatactatcctatcactgtcaaaaagcatctgcgggcgcaggaaatagcttctgaatgtaaattgccgtgcatatatcttgttgacagtggaggtgctaatctcccaaagcaggcagaagtttttcctgaccgtgataattttggtcgaatattctacaatcaggctaagatgtctgcagatggtattcctcagattgcagtagttttaggttcttgtactgctggcggggcttatattcctgcaatggctgatgaaagtataatagtcaagggaaatggaacaatatttctagctggtccaccccttgtaaaggctgctacaggggaggagatatctgctgaggaccttggtggagcatcagtgcattgtaaaatatcaggagtctctgatcattttgcacaagatgaacggcatggtcttgcgctgggaaggaacattgtgaagaacctccatttggctgctaaagaaacaaatatacacaattctgcttgtgattaccaagaaccattgtatgatgtacaggaacttcgctcaattgcaccagctgatacgaagcaatcttttgatattcgctcaataatagctcgtatagtcgacggaagtgaatttgatgaattcaaacaattgtatggaacaacactagtgactggttttgcaaggatatgcgggcagccagttggaattattggaaacaatggcattttatttaccgagtcagcactaaagggtacccacttcattgagttgtgtgctcaacgcaatattcctttgatattccttcaaaatatttctggattcatggttgggtcgaaatctgaagcaagtgggattgcgaaagctggagcaaaaatggttatggcagtttcctgttcaaaggttcctaaaattaccataattgttggtgggagttttggtgctgggaattatggaatgtgtggacgtgcatacagcccgaattttttgttcatgtggccaactgctaggatatctgttatgggtggtattcaggcagctggcgttcttgcccaaatagagaagaacaacaggaaaaggcaaggaatggagtggaccaaggatgacgaagaagccttcaaagccaaagtcgtcgaggcttatgacaaggaaggaagcccgtattactcgaccgctaggctttgggacgacgggatcatagaccctgcagatactagacgggttctgagcctttgcctctctgcttcggccaagccggttccagaagacacgaaatacggcgtgttcagaatgtaaaatcatgcatgtatagtgcacatccctgtaaaataaaactcgcttcgat

SEQ ID NO: 315 - DNA, 1608 bp, Hordeum vulgare
gtggagacgatggcccccgccgccgcagcgccggcgccggccgccaccgcctgctcctcgtccgcgagctccgcgcgcccgccctccaccgcctcctcctcccagtcgccgcccaggcgcacggtcccggcgctcctcctcttcatctccctcgccgccctcctcatcctctcctccggcgaggcccacgaccccgacgccgactccgggcgccccctcaaagacgttagcttggaatatccggaggtgacttttgctccctcatccatgggtggaattttctgtgagcgaatccgcatatctaaaataccaaggtggcagtttcaaagctatgcaaatcaaatacatataagaatgaatgtctcgcattcattgccagaaaagttccattggaaaatacagatttgctttcatgggaatgtttctaccggtctgtgccaatgtgagatgggtgaatggcaagctctgcaaggtggcacgtggaatgctgtcaagtctccgtataacagcagatatgttgatgtgaaacttactgataagaaatctgctgtcttcagcctttccattcaggaagagcttcagaagtggcgtttagcttgccttggtattggatttgttctgctattcctgtcacccatcgttagtaaatgggcaccattttactatagcagctctatggctcttggaatcctacttgtggtgctgattgtccttttccaggggatgaaactgctaccaatgggcaagaaaggtttattttaccttacaatttacggatctgttttgggtgttggctcttacgctgcacactacttctcctcagtggttgcttctattctggaaaactttggcttgagtgaggagatgcacaatcctgtgtcaatcttcctgctggtagcagttgtcttgactggagctggttttggctattggatggtgaggagatatatcatttcaaaagatggctgtgttgatgccgggatatcacagtttgtcaagtgggctatgcgtgttgttggaatgttctttgttatgcagagcacactcgaccctattctagcattcgctgctctagctgctacctcgtgggtttgctctgtattgacaacaaagaaagttcacaagccaacggcaccgaagcgaaaacaatcaaatgtttcttctcatccaaggtttactcaagtatcaccgaacactcgccaggtccagttcttaagtccatcatcaagggcgggtactggaagagccacaacaacacagtatggttggaactatttagccaatggaggtctggcctcctcagcactggtaaagaggctagcacccaatcaagacgaagactactactccaccttccacaacatcgaaccacggaagtactcaaagagagaatgggaggagttcaccgaggaatcgaccagaaacgcactgatggagcacacagccaccccagagtttgcccaatgggctgctgacaacgctcaccggctgcgggtggagcgggacgactcgtccgaggacgagtcgatcgagacctcctcaggctcttccgaagaggccgagaaaggcggaaaagcttctagtctgttgggcaggttcatgtgatga

SEQ ID NO: 316 - DNA, 1200 bp, Hordeum vulgare
acaagtctctgcacggctgcaccggagcaggaaccgagagagagagagaagctctgcccctgagctcctccgccggcatggagatccttcaacaaggcactatgtcgatgttccctgggatggatcttacgaaaatggatcctccaactcttaccctccttggagcagcttgttgtgtaatgttgtctatgcatttcacaatacagctggtatcacagcatcttttttattggaaaaatcccaaagagcagaaggctatactcattatagtgctgatgcctccattgtatgctatgacttcctttgctggtcttctggatattaagggaagcaaaacgttttttacatgcttggagtctgttaaagaatgttatgaagcactggttattgctaagtttctggcattgatgtacagctacttaaatatatctatcagtaaaaacatcgtacctgatgaaatcaaagggagggtgcttcatcattctttccctgtttctcttttcctgccccgtaatgttcggttggagcacaagacacttaagcttctgaagtactggacctggcaatttgttgttgttaggcctgtatgctccattctgattattgtacttcagcttcttgggttgtaccccagctgggtcagctggacgttcacaattatattgaacttttcagtctccatggcattatatgccttggtcatattctatcacttgtttgctaaggagctggcacctcacaagcctcttgcaaagttcttgtgcatcaaagggattgtcttcttctctttctggcagggctgtgccttggatgttttggctgctgtagggtttattcaatctcaccatttctggctggacgtggagcacatccaggaggcaatccagaatgtcttgattatcctggaaatggtcatcttctcagttctccagcaatacgcatatcacgttgctccgtacagtggcgctgacaaggcaaaattcgagaagaagaatgaatgatccgccaagcaacataagcagcttgttcttgtatggttttgtgtgtttgtgctgggaacacggattcaacatgctataggacatgcatttccttttgggcatgtgtagagtgagtcgttatacgttgaacaatagaataccgagatgtccaggattcaggaacatgcaggaatggcactgttatttgcgctgtgaaact

SEQ ID NO: 317 - DNA, 1813 bp, Hordeum vulgare
ctcgtctctgattctccaaagcggcggcgcggtgggcatggacggcgccggcatggcgacgccgccggaggccaacacgtcgcccgctcccaacggcggcggctgcggctggatcagggttgagaattgctacgtcttcaagagcaggctgcaggagtacgtgcagaaagccggcctcatgacgccagagtaccaaaccctcaaggaggggccttcccatgcgccaatcttcagctccaccgtggtgattaacgacgtcaagtacgactcgctgcccgggttcttcagccggaaggctgcagagcagtcggctgccgaagtagcgctcatggaaatcggcaagtctatggcgttaccaaccaatgcaaccatccctgcagtccaagaaactggtctgtgcaagaatcttcttcaggagtatgctcagaagatgaattatgctattccatcttatatttgcaacaaacaaagtccatacatatgcaccgtagagattggtggaatacaatacattggtgctacagcacggacaaagaaagaggcagagataaaagctgcccgaactgctcttcttgcaatccaaggccaatcagagggttgcgcgaatggtaccacaaaatatattgttgtgcctggaaaaaggcaaggtaaggacaccgagaaaaagcccgttgaaactccaaaatcacttaagaccaagaaaggtggtttcaagaagcaacggaacaagaataaattcatcaagaagaatggccaagaagttaacgagggaaaggatgagactggagtgcctggagatgctcatcattcagatgtccctatgaagccagctgtaacaacagaagatccatcggccaacactgtaatgatgcaacctgatgaagaagcttggtcattcgaacatgaaccagccagtgacactgcaatgctgcaacctgatgaagacgctttgccattcgaacatgaaccgtccggtaacactgcaatgctgcaacctgatggcgaagctacaaaagtaggacaggagcacctcagtgacacagcaatgctgcaacctgatgaagacgcttggccattcgaacatgaaccggccggtaacactgcaatgctgcaacctgatggcgaagctacaaaagtgggacaggagcacctcagtgacacagcaatgctgcaacctgatgatgaaggtagaagaggaaagcaggaaccactcatcggcactgcaatgccccaacctcacatggaagatagaagagtgggagcagagccacctagagatgctgcaatggtgcaacctaatgatgaagctagatgtgtaaagcaggagctactaattgacactgcaatgcctctccccaatgaggaagccggagcaggtgcaaatcctgtgccaccgagtgactccacaacagcgcaacctaatgcagagactacgaatataaatggggagtcactgaggaatgcagcatcagcgcaacataatgaagaagctaggaccctaaaccaggagccacccagcagtgcttcactgctgcagccaaaggaacccagagtcgagaatggtgaatttgtttctgaaaacaaggaccaaactccgggagatgcatctcgtgaggcaaataggtccatcgaagatatgccagaaaagagctcaaataattcatctgcttttacaagcgcggaataatatgtgctgtttgaatcaaaatgcaatggccttccagttttacatcttgatttgcaaactggtaaaactcgaatagctggcttcgcattttagaaatataattgcataacagatggaagcacatgg

SEQ ID NO: 318 - DNA, 778 bp, Hordeum vulgare
gaaggagatggagctggtgtcctcctcccgctccgtcctatcctcttgcaaccgactggttgctccctccacatccaggacggcatcagcagctgctaggcgccacgggaagagtctagtatgtgtcttgggtggagacacgaatggtgagttcaagatcgggaagcgggcagctcttgctctgttctttgctacacccacgctcttactcgccttctcggcccactccaagaccaaaaccataaatccttatgaggaaagacgcttgcttcagcagaacaagaagattcaggaagccaaccgtgcacctgatgatttcccaaacttcatcagagaaggttttcaggtcaaagtagtgacacccgacaactacataacacgggattccggattaatatatgaggatgtcaaagttggtacaggcgattgcccgaaggatggtcagcaggttatatttcactatgtgggctacaacgaatcaggacgaaggatagatagcacctacatccagggttcgcctgccaaaattcggctaggcaacaaatcattagttccaggttttgaagaggggattcgggacatgaaaccaggggggaagagaagactaattatacctcctgagcttggtcctcctgttgggccatcgacgttcttcagcgcgaaacagtttgaagtattcgacgtcgagctactctcagtgcaggactgccagcggaggacaatagctttttactctgatgttgtttgcacttgatcatctggtctgttagtgctgtga

SEQ ID NO: 319 - DNA, 523 bp, Hordeum vulgare
aagaacgtggctgcacatccacgcagagcactgcctcatggcctgcgccttcttcttcgacgcggagccgctgggcgagcccggggtgcgcatgcacgggccggagctggagctgcacgcctgcgcgctctgcaccaagccgctgcagagcaacagcgacatcttcatgtacaagggggacacccccttctgcagcgaggactgccgctacgagcagatgcacttcgacgccgccatggccaggcagcaggccagcgccaggcggaagcagcagcagcagcagcaggcacaggcgccgctcggcgtgcccggagcgccggcgcccgtgtccgccaaggccgacgtgtccgtggcgagctaatcgggccgcgccgcgccgcgtcggggttagctagtaggaactatgttaccctttttgccttgggttgaaggaggaggaggaggatgcggggattcttggatcgacggccagtgtttttgccctggcatccggtgcaggtcgagctgttgttgatctgcacat

SEQ ID NO: 320 - DNA, 1129 bp, Hordeum vulgare
ttactagacctgacccgacctgcagccgcggccccactcgcggtgccccgtcacgaagccggttccctgacggtgccacgaaggccgtgcccgaccccaatggaagcagagtacccccaaataaaccctctcctcctctgctccaggcgccggaaaagggaggaggacgagggagggctcgagctgctgctgtccatggatctcgacgaggaggagacgcggccggagcagcaggcgccgcctcgggtcccggagaagctgaaagcagtgggacaagagcttggacatgagatccggatattttcaagcacaacatttgagctgatgactagcaaattgcccagggcagatcaggaggaagacgatgacttttatgagcttcagcctggtgattattacaagttgatttccaataggcttgcagaacaatcgaaagttctgaagactcgtaaaataagggaagcagaacttgctgctcaacgagcaaggctaacaaaggcagtgatgagggttcgattccctgatggttacattcttgaggttgagtttcatccatcagagacagtacatagtctgttggatcttctcatgaaagtaattgctagaccagacctgccattctatctttacacagttcctccaaagaagcgaataatggacacctcacaggacttctacacaattggctttgttcctggagctaatgtcttcttttcttatgatctgccagaagggtcggagttaaatacggatggtgtaaaatccggaccatatctccgtgaagaaattcgaactttggatggtctgtcacttcactcggaaccttctgaccagcctgatgtttcaaagacaaattctgattcagctcatcagtctgaagcattccgacctgattctgcaccaccaccagcaaataagaaatcagccaaaccgaagtggttcaaaaggtgagaccaccatcagagcgtcaatgctgcaccatgggcgcaatagcacttgattaggccttccagcaatcccaatgcatgattgatcatatttcatggttcaacgacttcagacatgccgcccatagtagtgcgagagttcatcctgtgttacataggagttgtcgaaccatcggaattag

SEQ ID NO: 321 - DNA, 1655 bp, Hordeum vulgare
tgagctttgcatttggtgttagacttgcgcttgctcaccctgccatgacgtccaaggtacccaacagctccggcagcagcgacagtgcggagcccaagctatcgccgtcagggctctcggtccgggaggtcccgggcggctacggcgttcccttcttctcgccgctgcgcgaccgcctggactactactacttccagggcgcggaggagtacttccgctcccgcatcgcccggaacggcggcgccaccgtgctgcgcgtcaacatgccccccgggccgttcatcaccgccaactcccgcgtcgtcgccttcctcgacgcgcgcagcttcagcgtgctcctcgacgacgccaaggtcgacaagaccgacacgctcgacgggaccttcatgccctccctcgtgctcttcggcggctaccgcccactcgccttcatggacgccgccgacccccgccacgccgcactcaagcgcgtcatgatcagcctcgccgccgcgcggatgcaccacgtcgcgccggccttccgcacagctttcggtgccgtgttcgacgccgccgacgccggtctcagcgacggccccgttgaattcaacaagctcaacgagcaccacatattcgacttcacctgctccgcgctgttcggcggcacgccgccgagcaaggccatgggcgacggtgcggtgaccaaggccatcaagtggctcggcgtgcagctgcaccctctcgccagtaagatcatcaagccgtggctgctcgaggatctccttctccacaccttccgcctgccgccgttgctagttcgcggagactacgccgccctgacggcgtacttcgccgacgctgccgccggcgtcctcaacgacgccgagaaggcgcagtccggcatctcacgcgacgagctcctccacaacctagtcttcaccgccatcttcaacgcatacggaggcttcaagatcttcctgccgcacgtcatcaagtggctagcccgcgccggcccggctctgcacgccaggctcgccagcgaggtccgcgccgccgtgcccaacgacagcgacatcaccgtgtccgacgtcgataagatgcctctggtgaaatcggtagtgtgggaggcgctgcgcatgaacccgccggtggagtttcagtacggccgcgcgcgccaggaccttgtcgtagagagccacgacgccgcctaccaggtacgcaagggcgagatgctcttcgggtaccagcctatggcgacccgcgacgagcgcgtgttcaagcaagcgggcgagttcgtccctgaccggttcgtgggcggcgaagggcggctgctcgggaacgtggtgtggtcgaacgggcctgagaacagcgagccggcggaggggaacaagcagtgcccagggaaggacatggtgacggcggttgggaggctaatggtggccgagctgttccggcggtacgacacgttcaccgccgacgtgaaggagatgccgctggagccggtggtgacgttcacttcgctgaccaccagggccgagtgactatagtagtagcagactgtactactatagtgcaactgccaagtggcgccagcgctgccacaataataattgctatagtagactgtgctactggccaggccggatgtttgttgcatctctggtcaaatctgcatg

SEQ ID NO: 322 - DNA, 1173 bp, Hordeum vulgare
gtcaaagccgcaagaagcagaggagggcaaggcggcggagcagagcagagcagaggaagatggcgccaccgcgcccgcgcccgcagccggcgctgctcctgctgctcctcgtctccctgctggccgcctccgcgccccgccgcgccgacgcctggggcaaggagggccacatcatggtctgcaaggtcgccgagaggtacctgtcggaggacgcggcggcggcggtgcaggagctgctgccggagtcggccggcggggagctgtcgacggtgtgcccgtgggcggacacgatgcggttccggtaccactgggccagcccgctccactacgccaacacccccaacgtctgcaacttcgacttctcacgggactgccacaactcccgcggggagcaggggatgtgcgtcgtcggggccatcaacaactacacggaccagctctacacctacggggactcatcatcaaagagctcatacaacctgacggagagcctcatgttcctggcgcacttcgtgggggacgtgcaccagccgctgcacgtcggctacgaggaggacgagggcggcaacaccatcacggtgcactggtaccgcaggaaggccaacctccaccacgtgtgggatgtcagcatcatcgacacggtcatgaaggacttctacaacaagagcctcgacaccatggtcgacgccctccagaccaacctcaccgaaggttggtccgacgatgtcggtcgctgggagagctgcgccaacaagaaggcgacctgcgcaaacgactacgcgatcgagagcataaacctggcgtgcaactacgcatacaaagatgtggtgcagaacattactctgggagatgattattacctcacccggtacccggttgtggagaagagactggcacaggccggcgtcagactcgccttgatactcaacaggatatttgacaagaagaaagcagatgctatgccgttatacatacagtaaaatagctatacttgtacaaacatagatatactgatgactggaaggtattattgtagctaccgcaccacgccagtttgatcaattaccgcttcaataggtgatatgcaataagaatcaaacaaccttggcacaccattcagaaattcaactgttgtaaagttccataatatactactccctccgtttcacaatg

SEQ ID NO: 323 - DNA, 3229 bp, Hordeum vulgare
gctctcacccgctacacccccgccgctcaaaaccctaaccctagatcgtgagggcccgctgacatggccagcaagttcgggctcgccggcggaatcccggagcggcgggtgcggccgatctgggacgccgtcgactcgcgacagtacaaggccgcgctcaagctctgcacctcgctcctcgccaagcaccccacctcaccctacgccctcgctctcaaggctcttactttggaaaggatgggaaagcctgatgaagcactgactgtctgtttgaatgccaaggagctattgtactcgaataacattttccattttgacgatctcacccttagcacactacagatagtgtttcaaaggcttgagagattggaccttgcaacttcatgctatgagtatgcttgtacaaaataccctaataacttggaattaatgatggggctctttaattgctacgtcagagagtactcatatgtgaagcaacaacagacagcacttagaatgtacaaaactgtaggagaagaaaggtttttgctttgggctgtttgcagtattcaactgcaggcatattttagcagcggaggtgagaagttgttagcatttgctgaagcattgcttaaaaagcacataagttcacatagtttacatgagccagaagcactttctctctatgtttcaattctggaacaacaggcaaagtatgatgctgctttggaagttctatctggagacttggggtctcttatgggaagggaggaggacaagcttcgtttgcagggacaccttcttactcaagcgtgtaactatgtggctgcttctgagatatatcagaaggttcttgaatcttgtcctgatgactgggagtcctttctccattatttaggctgtctgctggagcgtgacgtgaagttgcctaaaccaaccactggtgaacatacttgttcgtcctgctctgtagattcgactatgttgagcaagacttctctcagtgaggagctggtcgaatctcgccttgcaagtgcattgttatttgtgcaaaagctacaaaaaaatgactccagtgactctgttagaggacctcatctagccaatattgaaattgaacggcaacaccgcctcagtggaaactcaactaagttcatggaagctttggtaaactatttccacagatttggtcacttgtcttgttcatcgtcagatgttgaaatatacctccacatgctatcgggtgatgaaataacggagttgctagatacaatttccagatcttttgatgcatcatcagtttcagtaaaagcactgggtttgacaataactacgtttaaggttcaagaacttttgggaactttattttcaaagtcaactacagatcttcaacgcattgcaaaaggaatggtcgagacattttacaaaaacctgtctctctcaagagacttagatcctcaggaaagcatccatggagaagaactgctgtctatggctagcagtattcttgtgcagcttttctggcgtacaaggaaattagggtacttacttgaagcagttttggtgctagagtttggattgactgttcgcaagcatgtttggcaatacaagatttctttggtgcatttgtactcttacttgggagctcttccgttagcacatcgatggtatgtaagcctggaagtcaaaaacattcttctagaatccgtctcacaccacatcttgccacagatgttgagttctcctttcttggaacaaacagccagtcttgtgaaggattatcttaggttcatggatgatcatttgaaagaatctgctgatcttacttgtcttgcatataggcaccgtacttactcaaaggtaattgaatttgtgcagttcaaaaatcgcttgcaatgctccatgcagtatcttgctgtaaaatctgattctgtaatactgagcctgaagcagaagtcggagtctcttgaggaagtggagtccgttcttgaaaatgtgaatcacggaggaggcttggttgatctatcaaatgaagacaacatgaaacatttaacttttaatgaagatctcgaggcacgcccttggtggacaccaaccaccagtgtaaattttctttcagaaccaattgatgaaagttcaacacctgcgtgctttagggccaaagtgtgcaagcacaaatctactgagaaggatggccctaagatgggagatgctgagagaaaatgtcttgtcccccggcttgtttatctttccatgcgtggttgtgtatcttccctcagggagactgagcacaacgggtctgtttctgatatcactgttggggaaatgaaaaccttacttgagaaatatgctaggactattggttattctatggatgatgctctaagcatgattcttggtatatcttcaggcaagaagtctatgaaggattttgctcctgatattgtgagctggatgagtttcgctgtatttattaatgcgatgaacctgtggtcaaatgaatcagtgatccccagaactgaaccgagcagcccaagttcttgggagattgtggacagcttggtgaaactttgcatagaggagcacctgactgatgccaatcgaatcctgacttgtcctggaaataaaattccactgttagtgcagatggttacggagcccatttcttggcatctcatcataattcagtcctgcacgagagtggtggctccgcaaggaaagaagaaaaagaaaagcggcccatcgctgcgaacaaacatgcctcagttgcaaggaattcaaagatctgttcagtgcttgattgaaacgctccaaagtgtccaaaaatggctatctgatcagatgagtccagaggagcaaggtttggatatcttgctgtcatatttccaaggaactggcgatgaaggtccaggacagacattccgagtcttggaagagaaaccagcagcacatgcctctgagcttggtgatcgaattgctcagtctctggaagcatggagttctactagtgtggtaagaagaattgttggagcagaacatgaggtgctagccgagttcaagaaaatggtcgactctaaactaaagctgctcatgtcagaatcggcttctctatcttcggtgttgcactagagttgatgaaattttgcacatgaattttgttctattcttgttgtggtgttccattatacatatgttgtaacagtataacagaatggtgttgcactagagctgttcgttgtttgacttg

SEQ ID NO: 324 - DNA, 1388 bp, Hordeum vulgare
ccgccatggctttctcggcgcggaggagcctcgccaccggcctctccagccacctcacccgccgcctccacccctcgctctcccacctcctcccctcctcccaccacgacaacaaccacgagaacccctcctcctccgcgcccccgttccccacccagcaaaccccgcactttccctccggcgacctccgtcggcgcgcgagatcccagggcctggccctcccgctccccttcggcgcgcacctcgcggcccaccgcggcttctccacctccggatcctcccccgggccgcagatcgatggtatcctcaccgaccccgccgctggccagatggacgtcgcggctggcgtcctctccgacgccgcggcctctgtcgcgcccgcctttccgttgccgttcccgggggaagtggccgccgccgccgcagactcgtttcccccggtcgccgccttgcagtacctcatcgacgccgtccattcgttcaccgggctcaactggtgggcttctattgcggtgacgaccatcttgatccgaacggtgacgatcccgctgctcgtgaaccagctgaagtccacgatgaagttgaatgcaataagaccagaaattgaggcaatcaacatggagatgcaaaattcaatggatccacaatcaatgttagaggggaagaagaaattgggcgagctattcacgaagcgcggtgttaatccattgacacccttgaagggtctattcatccaagggcctatattcatgagctttttctttgctatacaaaacatggtggagaaagtcccttctttgaaaggaggtggagcatattggtttactgatttgacaactcctgacgaactttatatcctcccagtgttgacatcggcgacattcttggctacggtggagctcaacatgcaagaaggcatggagggaaatcctatgctgcaaacaatgaagaagttctctagaatattggctcttatgactataccatttacaatgcactttcccaaggcaattttctgttactgggtgaccgcaaacttgttttctcttgggtatggttttgctctccggaagacagccgtgaggtatttcttgaatcttcctgagatagtaccacagcccgcacctgcggaagtgtcgaccttcaaccttttcaaggcaccaaaggcagtcaatacacccaccggggacaacggtgattcatccaccgtagtcaacagtgattcaaccaccgcagtcaacgggtcagagcagtctaatgctgagctaagcgaccgggttgtgtttcttgagaagaagattgcagaacttgagaggcgggctaaagctagaggtgaatctcaggaggaataaactaacaagtaagtttctgaccgagcacgcgaaatc

SEQ ID NO: 325 - DNA, 1319 bp, Hordeum vulgare
gcagcaccacctacctcaccgcggccgcatgtgggccgcctccccggccttccgcaggcagctcttcctgctccgctctctcgcgcccacctgcgtagacggcggccgcgtctcctcgagctctcttcggctccacgcgatgtccgcggcaccggcggcggccgggccggtgtacgaggcggacgcggaggcggtggtccggcgaatcacgccgccgctcgaccgcgcaaggcacaagggtcaggcagggaagattgcaataattggtggatgtcgcgagtacactggtgctccttattttgctgctatctctgcgttgaaagttggtgcagatctctcacatgttttctgcacaaaagatgctgcaacagtaatcaagagctatagccctgagctgattgtgcatccaatattagaggagtcctacagtgtaagggatgatgaaagagaatctgtttcttctagcattctcactgaagttataaagtggatggagcgctttgattgcattgttgttggccccggccttggaagggactcatttcttatggattgtgtcagtaatatcatgaggcatgcacgacaggctaatatcccaactgttgttgatggggatggccttttccttataaccaataacattggtcttgttgaagataactctcttgccatcttaacgccaaatgtatacgagtacaagcgtcttgtccagaaggttcttaactgtgaagtaaacgaggaaaatgcttctgagcaactgactgcactttgcgaaaaaattggtggcgtaaccatcatgaggaaaggaaaagcagatctgattagtgatggtaaaaaagtcacacaagtgagtacctttggttctccaaggcgatgtggtggtcaaggcgacattctctctggaagcgtggcagtattttcatcatgggcatggcactttctctcgtcaaatgagcaacctaaagagaatagcgtgaatcctatggttcttggctgcatagccgggtctctgttgctcagaaaagctgcggcgcttgcattcgagaagaacaagagatcgaccgtcactactgacatcattgagttcttgggccaaagcttggaagatatctgccctgctgggcggtagtttattgtgggtttcttaccataatactggaactgcgcctccgcactctacaataataccgatcctgttatcaggatgtatcatcaccgtgtttatgtacatatatctctagtaaaagaaggggatgctacaatgcttggataatatgctgtgttgtgtgtcgctgctgtccagaaatcctcagggaatt

SEQ ID NO: 326 - DNA, 482 bp, Hordeum vulgare
aaacacacaccagcagaagaagcttttcttccaaggagctagcgagcggcgaggatgcagacggcgaaggtgaaggtgaaggacgcggtgagctcggccaaggagaaggccaaggaaggcacggccaaggcgcagggcaagacgggcaaggccacggcgaccacgcacggcgagaaggagatggccaaggaggagacgcgggccaacaaggcccaggccaaggccgagatgcaccaggagaaggcggagcaccgcgccgacgccgccgcggggcgccacggcacggcgcacgtgcccctcaccggcccgcacggccaccatcgcccggcggccgccgcgcccgccgaccccgcgtacacgggcaccggcgcgggcgcgtacccgaccacggacaagtacgtctagacgttgagatgatccggggatcagaaggagctagcagatcaagtagtgtttttttgttgttgtggctagtgatcctg

SEQ ID NO: 327 - DNA, 1951 bp, Hordeum vulgare
tgggtttagtagggtttggactcgccgctcggctcggctcggctccgctcccatggaggcggcggaagatgccggcggcgcccgctccacggcccggaagctggtgccgtggtcgagctgggcggagtggcgcctcgtccgcgacgccatcttctccccctaccctgaccctggcgccgctcttcgcaggatagcggcgtggcggagcaggggatgcctccccatccccgtggaggtcaccgcggccctcttcgagataaggctgcgggatcccttcttccggaatggagtggcttcggatgataagctggagtcagacgagatgctcgccttgctgtacagcatggcaatcatcaggcttgtaaatggttttatggagagcccgcacaaggaaactggtcgttcaatatctgatttagctgagactgttggagtaccacgaattctcgttgacattcgtcatgaaagttcacatcgcggcatcccctctctgcgactgctacatttggcagccattaaggcatttgattggttgaagtgtaattactgggattcccagactagtgcaattcctgatgttcgactagaactaagctcagtattgcatgatattgctcaattcctgaagggaaaagattctgaaaatgcaaaatcaggttccaaaaggaaacgttcccaaaaacatattttaaatgccataaaatatgtacgtcgactttactacacatgtccctctgaggctatctctgttcttttggagttctttcagctcgatgccccagaaatctctgacagcgatgtacatcaagctgatagtttggatggaaatccctcatctgatgttcaaagtcagaatcaaatatcaaatggagatatgaaaaccataataacaaaactatcagaaaaagaaccaagagtgcttcttggcttactaaagtcaataattgaaatgattgaggccaggaatgaccttgaacacaaaggtggatcatatgcatgcctgccagctgagtcaccaacaatgaaaagcttgtgctccctcgttctatggattgtcgcaagcataaaagagttaaaggattccggccgtattggacttgtccacgagataggagtactctcttcagacaagaacgctgtccctcgtttctgtctcgcaaaacttctgcagaagttcttgactttgcccgttataggtgaaagatgcattgcagatgcagcactattgctgattgagatggccagcaataataacgtgaaggagaaactgaggaagcttcctttgttgtccctgcgaaggtcacccaaagattgtaccctcattgaatccagaatcttgtccaatggacaagaatcggttgaaagcgcaacacagaagctggaagcgttcaagttgcagctgaggaaaccagataatgcgagtatagctgaaaacggcaccgagggtactttcaacacaagcgtgccagagaaacgtaataggtggtctgtagcgaagtcctggaccccctgtccgttaggcatgataccttgttcatatagttcaactgctgttcttcctgtccttgatatcattgatgatgaactggagcatgacacagctgaacatggaaattttgaggatgatggtcagattgaaattgctgaccccgagaagcagttggatgatgaaggctttctagaaatatcaagatcgccacctgaacatgggatttctgttatgccagaactgatccatggtctcaagggtacattactggttggtggcgtgtggaaaaaggtgactgaagaagagttgctctccataaagtcaagcatgaaaattttgttgtgatattggctagttattctcgcccctctgcagtaaaatatttttcttctgtaatcgatcgaatggtagctttttcttggggtataagaaaaccctctttaatcagctctgctcagttcc

SEQ ID NO: 328 - DNA, 1726 bp, Hordeum vulgare
agtcccagtcctctgaaccagggggattagctagggtttaacgagccgcagcgaccaccatgacggccgcagacgcggcggcggagtcggacgcggaggccaggagcatcctcgagcgggccgcggcggcatccttcccgccgctccacgccgtccaccacctcctctccgtcggggtttgtgtgcgatgcatctttcgcatgtttggagcctttagccatgcctgctcatgtgcgtctcttacggtgtccgtcttgcattcgtttcttgaagagcatgatgattccgcaaaagacgggtcttgctcatgtttgtcaatggatgaagcatgctgctctatttgctttggaatattgctacccacctgccatcaggatgagggtgtagcaccgtttgaagacatttctcgtattgacataattacttcaatggtgtctcaagcaatacaaagagagggttatcaaatcggtgagttctctacagaaatttcagtgcctgcagttgtagcagcgaatgaacgtgccatcaggttatatatgaaaggaaaatatggcagtgaaaattggttcaaggacgaaatatttactcaacaaaccatgtcagtgaaggaggctctgagactattgatagtaccatcgctcgagaaacaactgggtgttaagcatagtaacaattcatttcgaattcgcttaacatatacccatgatgatgcttcactgaagctcaaaagtttattgccaaatgacagtaatcgcaaaaggaaagcagagtcaagagaaggaaatgatactagaaggaactcaacgtatgatgataaacagatattaactgaaacagatacattcatccacaagagtctcgagggtattcaagatcaagaattctgtactttatttaagctgcctcctgaaaaggtgttaaaaccttgccaacttgtgatatccttcctaaggtcacccatatatattggtggaagatacttgaagctttccagaaatgtcagtcagtcatgttggataattgatgatgaaagaatgggggaagcatcagttgaggaaataattaaagagaatgtctgtgccatctccagaggcgatggctacaagttccatgctgctggaagagaagatatcgatgtacggatgcttggatctggtcgtccatttctaattgaagtcttgaatgtgcgatcaattccgactgcgattgaaattcaacaaatctctgacaagatcaatagctccgaaaagaaatatgtcagagttagaaatctcaagttggtagacaatgaaatatgggccatgatgcgtgaaggagaatcggagaagcagaagcagtatgctgccctcatatggacttctaatcctctgacggatgatgacctgcagaaaatttctgttgttaaggatatggaaattgtgcagaataccccagtaagggttcttcatcgaagaagcccgttggagcggaaacggattatacattggatggagattgagaaagttgaaggcagctcaaactattacttgctgcatctatgcactcaggcaggaacatacattaaggagtttgtgcacggtgatcttggacgcacaaatccaagtatcggttccatgctacgttgcagagccgagatattgcagctcgatgtcaccgacgtaaagatggacttgctgcaataatatgctgctgccacgtgataccgttccgggcaagtattattggt

SEQ ID NO: 329 - DNA, 1611 bp, Hordeum vulgare
gaaaccgccaaatcctccaaaatatgccgccctcccgggagcagcccgccgccgccgatggcggcatcgaggagaatgcgatggccatcctcgacaccttcggcatcaaggattcccgtgacctccacgacgaccgagccgcttttttggaggccgtgcgctctgccggcctggctggcgacaaaccctcgtcccccactcggagaatgtacgatgctgtctttcagattcttcaaagcagcacctctttggagctaaccattgcaagtttccatctcttaatggagctgggcaagcaatatccaagagtatatttgacaaattctggttcccgtcaagctctagttacagttaacgagtcatggtcaccatttctccttggcaataatgtagcttctggtgagattgggagaaacaccagtcgctcagatcacctctttgattctttgagattttctttgttgaccgaggccatggttgaagcatcgaatgccacaggtgctcataatgggcttaagcatatagagaacatggtgctgttccaatatctcgtttgcacacttgaggctgattttgtacctcgtcatattgcatataaagagtcattagactgggtgattatcagggaatctgttttaaatgtgcttctgggatcgcgaaaactggtattcaaaatgtttgtcaagaactgcatatcccttctgaaccaacaccagcgggaagtcgaagatgacatatcttataaatcagcatctgatttagattcttccttaaccttttcatcgcttgagtttgaaagagaggcgctcacatctgtgaaaaaacttttcattatggttataaaccttgacttgattaggaaagaagcagataaattgggcctgacttcaagagctgatggtctcaggaatcctatcctggaagttattctagaggagctaacttataaccaaatctacttatccccatttcttttggccttcacggagtggaagtggaaattgcagattatcctgcagtacttctcaagatatcaagttaagcctgcagtccgtactcggaggtcagataattctcaacaagatttgacagtggaaagtgctctgagtatgttttcaacagaagcaagcgcaaaggccatggttaagatgatgtgtccagaagttgctcagcttctcttagcacatgcataccaggtctgcctatcccttgatggtgattctagcaaagctaatgatgcagcaaaaatgatgggagcgtctcttctcgagatatcttgcaagtttgtgtccgctttccagaatctgagaaaaatcaacacgagcattcagatttcacagtttgagaaagaagctttgttcactgcagcaacgctgacaagaaaactgcagaacgagtgaagattggagacttggaagtattcattttagattttgaagacttggaagcgatgggatcaaatggtttatcttaagagaacgatagtatctgtctcatctattgtacgacaaaatatgttacctgtgtacatatatgttttggcatctgggttgctcatctcagggtggatatcaaattcactagtttaccgttcggcaaatgtactaaagg

SEQ ID NO: 330 - DNA, 3361 bp, Hordeum vulgare
gagtcgagggttctggagagcggagggcggctctaaaaccctaaccccctccggatccgcgccgcgccggcccatggaggtggacccgtcgccgtcccctcctacaatgtcgacgccgggctacttcgacccggactcctcccgcctccgggaggagtaccgccgctacagaaagagactatcttcttcaaatgactccccaattttggggacctcagtctccagattctcagaagcaaggtcgttgcatgatggaagcagcatacctaggcggcccaatgctggtctactacttgaagacgtcaagcaggaggctgctgattattccgacattgatggcttgaatggaccgaaactgttcggatcagcaaaaaggacatcgctgaatggtggttcaggtaggagggcggcaagatcagcgttgaatctggtcaagctggaggacgatatgccaagggaaggagaaacaacttctacaacgtttgcatcccttcttgattcagcgatacaaggattgatgcccttcccagacgtgattttacaatttgagaggacatgtagaaacgcttcagagtcactaaggtatgccgccacaggaaacattcggatggcggaggacaaacttatgcaacaaaaagcaaaactattactggatgaagctgcttcttggtcccttctttggtacctctatgggaaagcaaatgaagagcttcctgaaggactattcatgtcaccaactacatcccatcaggaggcttgccgctatgttgcaacggatcttacagcacaattgtgtctgcggattgtactttggcttgaaggacttgcttctgaaagtcttgatttggagaaaaaggtgagaggatctcatgttggttcatatctaccaagttctggtgtttggcatcgtacacagaggcacctaaagagaaggaataatgattctaatatagtgaagcatgtggatttcgatgctccaactcgtgaagtagcccaacttcttcctgatgacaagaagcaagatgaattgcttttagaagatatctggactctcttaagagctggaagattagaagaggcatgtgaattgtgccgatctgctggacagtcatggagagctgccactctttgccccttcggtggcgtagacctgtttccttccctggaggccatgctcaagaatggaaatgctagaacactacaagcaattgaactggaaagtggtattggacggcagtggcgtctttggaaatgggcatcctattgtgcttcagagaaaattgctgaacacgatggtggccagtatgagatggctgtatatgctttacagtgcagtaacttgaagcgtaccttgccaatctgtactgaatgggagtcagcttgctgggcaatggctaaatcctggctagatgttaaagtggatatagaattatctcgatatcaaaccagcagaccagaagagaaagagtttgatgatgatatgaatgggacccagcttggcccagaaaattggccatatcatgttcttgatcagcaacctcgtgatatagctgcacttctgcagaaactccactcaagtgaccttgtacatgaaactgtttctcgagcatgtcgggagcagcatcgacaaattgagatgaatctcatgagtggaaatttagctcatcttcttgaccttctatggtcatggttgtcttccatcgaagagggtcaaaatgtctcgaggtcccgtgatgattccgacatgatacgtttcggggcacatattgttcttgttttgagataccttctcagcaatgaaatggaagatgagtttgaggaaaagctggttactgtcggtgatctcatcatcaacatgtacgtgaggtacttgttttcagaggggcaggaagagttggttggagtatatgcctctcagcttgaccgtgatgtttgcattgatttgtttgtggacatgatggaactaaggttaaatagcagcttgcataccatgtacaagcttttcctctctgctgtggagtatctgccattctcctctggagatgcatccaaggcttgttttgaagagatacttgagagggttctttcaaggtctcgagaaataaaactccatcagtacaatgaagatttttctgatgtcgcggaacagcatcacctgcaagcacttcagaaggcaatgatcattcagtggctttgcttcacaccaccatcctcaattccaggctttgagatgatcacagggaaacttctgatacgggcattgatgcatagcaacacactattcagagagttttccttaatatcaatgaggagagtccctgacctaccagtaggaccacataagttgcttgccatccttgctgaaccattgaaacaaaaggaaaatttattttcgctggaagatcaagaggtttctgataacttagaagagtttgaagattggcacgaatattactccctggatgcaacataccggggttggcttagatgtgagatggagaattattccgtcccccctgaaatgctttcggcagaagaaaaggatcaagctgttgctgcagcgacacaaactctggagttagcattcttgttattagaaagggaagagagaccatggttaaatgctatcgagacaagcccatttgagtcgtcagagcttgttttccttgagttgcatgcaacagcaatactctgtctaccttctggggaatgcatgacaccagatgcaacatcatgcacggctctgactagtgcactttattcaactgtcagcgaaggggatgtgctgcatcggcagctgaaggtggaagttaaggtctcgtctaaagatccttgctgtattgaagttgcgctccgttgcttagcaacagaaggtgatggatttgggcttcatgaagccaatgatggaggtcttcttgctgcaattatggctgctggctttaaaggtgaactcaatcgttttcaacctggagtttcaatggaaatttcacgacttgatgcttggtattctgattgtcatggttcggttgaaagtactgctgcttatatcattcgagggctttgccgaagatgctgcctgccagaaacaattctacgatccatgcaggcatccatctccctttccgaagctggcgattctctagaccattgtgataaacttatcgagttagttgcttcatcagattctgggatgatgcacttgttcagccagcagcagttacaggagttcctgatttttgagagggagtgcttcatatgtaaaatggagcttgaggaagagcagatgcctgctgatggctaagccactcatggtttaaattatcagtttattgaagcctgaatctcttccacggtcttgcct

SEQ ID NO: 331 - DNA, 1525 bp, Hordeum vulgare
aaatggccggatagctcctctcgcgcaaagcttttcgtctccgtcccctgcccaactactcctccacctcgatcgagagaagctcggatccgcggaggagaggagaggtgcccacgagctatcggttgcgccgcggcgatgggtagcctgcgaggcggagagggaaggaacgaggacggagggaaagtcgggctaccggcgctggaggtggcgctcgcgttcccgcaggccacgccggcgtccctgttcccgcccgccgtgtcggactactaccagcttgatgatttgctgaccgatgaagagaaggcgcttaggaagaaagtccgtgctatttcagagaaagaaattgcacccattatgaccgaatactgggagaaggcagaattcccatttcatgccattccgaaacttgcaactcttggcttagctggaagtacaacgaagggatatgggtgcccaggactctcgcttacagcgagtgccgtttctatagcagaagttgcacgggttgatgcaagctgctccacatttattttagtgcactcctctttggcaatgtccacaattgctctttgtggatcagaggctcaaaagcagaagtacctaccatcgttagctcagtttaaaactgttggttgctgggctttaacagagccagattatggaagtgatgcaagctccttgaaaacttcagcaaccaaggtacctggcggttggcaattagatggccaaaagcgctggataggtaacagcacgtttgcagatgtgcttgtaattttagctaggaatgcagacacaaagcaactaaatggattcattgtgaagaagggagcgcctggtttgagagccacaaaaattcaaaacaaaattggacttagaatggttcagaatggcgatatccttctgaataaagtatttgtcccagaagaagacagattaacaggcatcaactcatttcaggatataagcaaggtcctagcaatgtcacgtattatggttgcttggcagccaattggcatatcgatgggcgtctacgacatgtgccatcggtatttgaaagaaaggaagcagtttggagctcccctggcagcctttcagatcaaccaagaaaagcttgttcggatgcttggtaacatccaggccatgcttcttgtcggctggcgcttgtgcaagctctatgagtcaggcaaaatgacaccaggccatgctagtttgggcaaggcatggacgtccagcaagtcaagggaggtagtttctctgggtcgagagctattgggcggcaatggaattttggctgattttctagtagcaaaggcgttctgtgatctggagccgatttactcatacgagggcacctatgacatcaacagccttgtgaccggaagagaaatcactgggatcgcgagcttcaaacccgctgcagtagcaaaatctcggctgtaattcttcttctgcctccagctacgatgaacagcaaagtatgaccccccaccttgtattctggtgggtacgagtaagatcggaa

SEQ ID NO: 332 - DNA, 2806 bp, Hordeum vulgare
gctccaactcctgccaccgccaccgccaactccctccgcgccgcctctgacgggtcgccgcagctgcggagcgcgcgctagagggagagatggggggcggcaggaagcgcgggcgctcgcagcgtcgtcacttcaagcaggagcgcgagaacgtctggaaggacaaccccaggcgccctcccgcctccgccggcgaaggaggcgagggcaacggctggcagcccttcgccacggagaacctggccttcgaggcttactacaaggggcagcaaattgttcctgaggaagagtgggatgccttcatgagcatgctccggaagccattgccagccgcttttaggattaatgcgagctgtcagttttttaaagacatttgttcacaattagaaaatgacttcaggaagtcgttagagactgaggtcagtgatgaccatgaaaaagaggctattcggcctttgccttggtaccctggcaatcttgcatggcatttgaacttttctcggatgcaactgaggagaaaccaggcacttgagagtttccatgaattcttgaagcaagagaatgaagttggtaatattaccaggcaggaggctgtcagcatggtcccacctttgtttctgaacgtgcaacctgaccatcatattcttgacatgtgtgccgctccagggtctaaaactttccagttacttgagatgatccaccagtcaacaaagcctggagtgcttccaactgccatggtggtagctaatgatgtcgatgtgcaaagatgtaaccttcttattcatcagacgaagagaatgtgcacagccaacctggtagtgacaaatcatgaagcacaaaattttcctggctgtagtgttgcaaagttctgtccagaagcatgcgtagacgagtccaagctgcagaggttggaatttgatcgtatactgtgtgatgtgccctgtagtggtgatggaactgtccgtaaggctcctgatatgtggagaacatggaatattggcatgggtaatggacttcatcgtctccaagtggaaatagctatgcgtggcattgcattgcttaaagtgggcggaaggatggtctactcaacatgctcaatgaatcctgttgaaaatgaagctgttgttggtgagattctgcggagatgtggggattctgttgaactccttgatgtttctaatgagctacctgaattgatccgccgtcctggacttaggacctggaaggtacgggatagagcgtcttggttgggcagtcataaagatgtacttcactacaggaagaatgtgatattgccaagtatgttcccctcgggtaaaggtagcatggatagctgtacggcgggtggcagtgttgaggtcagcatagatgcagttgatgcagatatgaatgagtcaggggatatggtagagggaaaacaagaaacgaaaatagcaattgatgacagcaagaacggcgacaatgccaatactgaagagataaaacaaggtgaatctgagtctgttaaactttcaaggggctcagatgagaaaacagattcagcctccattgttacagagcattcaaatttaccgctacatcgttgcatgagaattattcctcatgaccaaaacagtggagcattttttatagcagtccttcagaaactctctccgctgaatgagagtcaggtggtagaagcgatgaaaggtgagcgcagtacctcgaaagacaagactttaaaatgttctaatggtcaggggtcagataaggtgccggctgaagaaatttcagttcagcagccaggggttgttgacagccatgatctcgttgagcaacaaaacagagacatggatactgaaatttcaaaagataaaagctctgaggaagctaaggtgattgctagtgaggtgcaaaatgatcaagcgacaaggagggataagagaaagacccagaaccaaggcagatggagaggggttgatcctgtgatatttttcaaagacgaagcgacaatcagaagcataatatcctactatggcatcaaggattcttttacccttgaaggccatcttgtgactaggaaccctgatactaatcatgttaaaagaatatactatgtctcaaaatcagttaaagaagttttggacctcaatgtgaaagttggcgagcggctgaaaatcacctcacttggcttaaagatatttgaaaggcagtcgtcaaaggagggttcgccatgcacatttaggttgtcatccgagggattgcctctgctgcttccttacatcaccaaacagattctatatgcatctgcaatagactttcagcacctcttacagtacagaatcattaaattccctgattttgtggatgcaaaattcggtgagcaagctgcagctttgctacaaggttgctgcgtcgtaatattacgtgaagggcatgaggatctagagtccataggcatggatccctctgcaatcgccattgtttgttggaaaggaaagaccaatctgtgcgtcatggtcactcccatggatgggagggagctgcttgaaaggatctcatttcgtttcgggctcaaaatcccaaaaatcgacgatgggaagcccgacctgaagagtgatgatggatcagacgagcagcctgatggtggcgccgagacggttgatccagaatgcgtgcctgagagcaaagcaccagaagacatgtatatcacagacgtcaaggacgctgagtagctcggtttgacaccatgcgaggaagcatgtcatgtctggttatgatgatgcatcagagccccgctacctggcttacgagttgatggttgcta

SEQ ID NO: 333 - DNA, 581 bp, Hordeum vulgare
cccaagtgtaacacgcacgcgagcacaaaaccgcacaaatatgtcgacggtggaggaggaggagctgtccgagtgcgaggtgctgtggccggagacgcgccacggagctccggggagcccgtatgggccatcgacggcggctcccggaggagcctccagggatcaccgccggcagcgctctgcgcccgtggacattcccaggcccgcccacctgccccgcgggcgcgccgacctggacgacgacgaggaggaggaggagcacgacggcgccatggtgccgccgcacctgatggtgtcgcgcaggtggtcggaggggaaggcggcggcgttctcgctgcggtcggggcccgggcgggcgcaccgggacctcagccacctgcgcaactccgtgctgcggatgaccggcttcatcgaagggtgacagtgacagagaaggcgggcccgccgtcgtctgtgcatacgtgcgagcgaggaaagtagacggtggcaccacgcgtcttcgccacggtgttgggctgttggtcagtcaattttgttgggctcatcttccccgtggctgccagtcgaaatgatcagtctcc

SEQ ID NO: 334 - DNA, 1147 bp, Hordeum vulgare
ccgagcatcgaccatgtcggcctactgcggaaagtacaaggatgagctcatcaagaacgctgcctacattggcacccctggcaagggtatcctcgctgccgatgagtccacgggcaccatcggcaagcgcttcgccagcatcaatgttgagaatgttgaggacaaccgtcgcgccctccgtgagctcctcttctgcacccctggtgcccttcagtacctcagcggtgtgatcctctttgaggagaccctgtaccagagcaccaagggtggcaagccgttcgttgacatcctcaaggagggcaatgtcctcccaggcatcaaggtggacaagggtaccgtcgagctcgctggaaccaacggtgagaccaccacccagggctttgatgaccttggcaagcgctgcgccaagtactacgaggctggtgcccgctttgccaagtggcgtgccgttctcaagattggcccaaccgagccatcacagctttctatcaaccagaatgctcagggtctggctcgttatgccatcatctgccaggagaacggtctggtgcccattgtcgagcctgagatccttgttgatggacctcatgacattgaccgctgtgcttacgtcactgagatggtccttgctgcctgctacaaggccctcaacgaccagcatgtcctccttgagggtaccctcctgaagcccaacatggttacccctggttctgacgccaagaaggtgacccccgaggtcattgctgagtacaccgtccgcaccctccagaggactgtccctgctgctgtccctgccatcgtcttcctctccggtggacagagcgaggaggaggcaaccctgaacctgaatgccatgaacaagctccagaccaagaagccctggaacctttccttctccttcggacgtgccctccagcagagcaccctcaaggcctggtctggcaaggcggagaacgaggagaaggccaggaaggcgttcctggtgaggtgcaaggccaactccgaggccacccttggcacctacaagggtgatgccaccctcggcgagggtgcctctgagagcctccacgtcaaggactacaagtattgacctgccttcggtggtatggcccgtttgggcgtcctgcttaccagtattatcgtttga

SEQ ID NO: 335 - DNA, 1941 bp, Hordeum vulgare
ggccaagaagaacctccgcgccaaccgccaccaagccgcccaccccaccccaccctcgccatggacatcggctcggtgccttccccggctgacgccgcggcggccccctccgcggccgccatgccgcgggaggccacgctggggcaccacctcgcgcggcgcctggctgaggtgggcgcgcgcgacgtcttcaccgtgccgggggacttcaacctgacgctcctcgacgagctcgaggcggagcagccgtccggcggcggggtgcggctcgtcggctgctgcaacgagctcaacgccgcctacgccgccgacggctacgcccgcgcgcgcgccggcggggtcggcgcctgcgcggtcaccttcaccgtcggcgggctcagcgccatcaacgccgtcgccggcgccttcagcgagaacctccccgtcatctgcatcgtcgggggccccaacagcaacgactacggcagcaaccggatcctccaccacaccatcggcatccccgatttcacgcaggagctccgctgcttccagaacgtcacctgctaccaggcagtggtgaacaacttggaggatgcacatgaacagattgacactgccatttccactgcattgaaggagagcaagcctgtttacatcagcatcagctgcaacctcccctcgatcccgcatcctacctttagccgccatcctgtccctttctttctctccccaaaactgtcaaaccagatgaacctggaagcagcagtggagactgctgcggcttttttgaacaaatcagtcaagcctgtccttgttggcggaccgaagatgagggtggccaaagcatgtgaagctttcgtagagctggctgatgcatgcggttatccggttgcagtgatgccttctgcaaaggggcttgtgccagagcaccattctagatttattggcacatactggggtgctgtgagcactccattctgtgctgagattgtggagtcagctgatgcctatttgtttgctggcccggtatttaatgactacagctcggttgggtactcacttcttctcaagaaggagaaggccatcatcgtccagcctgaccgagtagtgattgggaatgggcctgcatttgggtgtgttctgatgaaggacttcctgcatgcacttgcaacccggctgaagaagaacacagctgcctacgacaactatagtcggatttttgtgcctcagggcgaacccctttcctctgagcatggagagcctttgagagtgaatgtacttttcaagcatattcagaaaatgttgtctggcagctcagctgttatagcagagactggggactcatggtttaactgccagaagctgaaactgccggaaggctgtgggtatgaatttcagatgcaatatggatcaattggttggtcagtgggtgcaactctgggatatgcgcaggctgccaaggataagcgagtcatttccttcattggagatggcagctttcaggtgacggcgcaagaagtgtcgacgatgctccggtggggacagaacaacataatcttcctgataaacaacggtgggtacaccatcgaggtggagatccatgacggcccttataacatcatcaagaattggaactacactggcgtggtggaggcattccataatggcgagggcaagtgctatacagccaaggtccgaacagaggaggaactgaagaaggcaattgaggcatccctaggacctaacaaggacagcctgtgctttatagaggtaattgtgcacaaggatgatactagtaaggagcttcttgagtggggttctagggtttccgctgcgaatagccgcccaccaaatccccagtgaacacatcaggtctcgacaagatcctcaagttctgaatagatgttactgatctctgaataaatcatccatttgagtccactgttgttgcacgtgctcatg

SEQ ID NO: 336 - DNA, 698 bp, Hordeum vulgare
cagactcctagctctagctctctcttcgcctccgtgcaaatgggctcctcgcctgcgtcttcgccttcgccttcgccttcgccgccgatgcccatgatagggagggccggcaacctcaccgtcttcatcacgccgccgtcgccggccagcaacccgcgctcctcgcgcccgtccggctccccaacgccggacttctccacccctacctcccgcacgggcacggcaccgcctccgctgcaggagagcgctagcccgcccgcgccgccggtcaagttctcgccccccgcaccgcccgtgaaggtgtccccgcctcctgtgcaggtgcccccgccgcagtacggcaaggcttctgcggggggcaagcacgacggatcggcgttcggcttcttatgggacgccgtcgcgcgcgtgcaggaagcgcacgcgagcctggacgagtacgtcgccaactggttcggattggatcagtctaagtaccagtgggctctcaacgactactacgacaccaccggcaaggaagtggaatatggcaaagctgggaagccaaaggagcttactactactactaaagtgcagaaagtttagaagcaacttcgttccaggttgtatgtgtagtgaagtgaagttctatttgttagatcttgtcattggggcttcaagagtttttgcctctttacctgcctgatgaagtacgatct

SEQ ID NO: 337 - DNA, 2679 bp, Hordeum vulgare
gaaacatctaaaccctccttctccccccaaccgccgccgccgcggtgaactatcgcgatgtcgcccgctgccgccgcccccgcgccacgcgatgaccgcatccgcagcttcgaggacttcgcgagggtgcaccagttcctgctgattgcggccggcgtgccgccgtcgctgcatcggcggctgtaccgcaagctcgccgacgaggtgttcgacggcggggagagcttctccgtcgagccctgcgaggaagggaggcagcgccgcctcgtgctcgcctccggggcgcctcttgggagcgaggcggacgtcttcctcgtcgaccacgcgtggtccttccgcctctccgatgcgctcaagcagctacgtgaagtaccaggattggccgagagaatggcagctctaatgtgcgtggatctggataggagaattgaggtcgaagaggcagatgagcaagacagtgaaaagggtggtggtttggagcatgtcttgcaggttgtggagaaagaaaggattagaatccaggagtcgggaggtgattttgcagcatggctggagcttgaggagctcggaatcgatgatgatatgttagttgcactggatttatctgccaattttccgaatctggtagccctcaatctatgggggaacaagctgcaggatccagaaaaagtaatgcgagaaatcggaaagtgtggaaggttaaaggcactttggttgaatgagaaccctatccttaaccaatgcactgagaaagatgttcttgatggtcttcctgaattggaaatctataattcacattttacaatgaaagctagagagtgggctttaggtttctgcggagatatgattggagcagaaaatccctgtttgtctgtgggaaacataccattggataatattgtgactcttgacctttctgataggtccatccacaaactacctgaggtgttctcctctagtaaactgtcatctctttcaaagttgaacatccgtggcaatcctttggaccaaatgtctggcgatgatctcttgaagttatttagtttgtttacacagttacaggagttggaggtagacattcctggccctcttggaaacagtgcaatttccattcttgaatctcttcccaatataactttgctgaatggtgtcaatgcgtcaagtatagttgagagcgctaagcatgtagtggactctgcacttaaaccacgtgttccagaatggtcacctgaagaatccctggctgaaagagttattggtgcaatgtggctgtatcttatgacctaccggcttgctgatgaagaaaagtttgatgaaacacccatttggtatgtcatggatgagttgggctcagccatgcgccatagtgatgatgctaactttagaatagctccttttttgttcatgccagaaggaaaattatcttctgctataagttacacaattctgtggcctatttgtgatgttcatactggagaagaatgtacccgagatttcttgtttggtattggcgaagacaaacaacgctcagctaggcttacagcttggttccacacaccagagaactattttattcaggaattcaggaagtaccaggagcagcttcaatcaactagtatttgtcctacaaaagagacgccctcaaccagaagtgtacgtccaagtgatggccgtccacttcgagtatttactgatataccccaagtagaggagttcttaacacgcccagaatttgttctcacaactgatccaaaggatgcagacatcatctgggcaggcatgcaaattgattctgaattaaagagttcactaggtctcacagaccaacagtacatgaatcagtttccttttgaggcttgtctggtcatgaagcaccacctagcggataccatccacagggcatggggctcacctgagtggcttcaacctacatataacctagagacccatttgtctcaactaattggtgaatactctgtgaggaaacgggatggtatggataacttatggatcatgaagccttggaatatggcaaggacaattgataccactgtcagtggtgatctatctgcaatcatcagacttatggagacgggtcccaagatatgccaaaagtatattgagtgccctgcgcttttccaaggaagaaagtttgatctccggtacattgttttggtccgcagtatatgccctttggatatacttctttgtgatgttttttgggtcaggttagcaaacaatcagtacactttggagaaaactagcctttttgagtacgagacccattttactgtgatgaattataatggaaggatgaaccatatgaatactccagagttcgtcaaggagtttgagaaggagcatcaagttaaatggctggagattcatgaaagcatacgtgatatgataaggcgtgtctttgagtcaacctcagctgtccatcctgagatgcagaattcattctgcagggccatttatggcgttgatgttatgcttgataatagattcaagccaaagattttggaggtgacatattgtccggactgcacgagggcgtgccaatatgacacacaagctctcgttggaagccagggccccatcaaaggcagtgattttttcaacacggtgtttggctgcctctttctcgacgacttgacgaatgtgtcaccactgtaatag

SEQ ID NO: 338 - DNA, 873 bp, Hordeum vulgare
catatcctacccgtttaccagccatagcctgcgggctagttgcgcaatggcggcgtgttccttcgcgctccgcctggggccgcgcttcgcggcgccaacggtggcgagtgcgacgaggggaggaggaggaggaggtgtccgccctaccggcagccgagcgctggtgtcaaagaagccaaacaaggaccaccgtttgtggatcagaaaagattcggctgggtcagggaagaaggctctttgtcttgttaatactgtttcaaaactaccgaatgaaaaagaagctgtttatggtgcattggataggtggactgcttttgagcctgaatttcctattatagcagcagcaaaagctttggaaatgttgaaaaaacgaagaaaatggctacagattatccaggtaaccaagtggctgatgagtaaaggtcaggtgctgacatggacaacctacgatacactgctgttggctctttctatggatggaagagtagacgaggctgagtcaatttggaatactatcttacaaacttatacacgctcagtgcccaagaagttgttctctcggatgatccagatttacaacacgtgccatcttccggacaaagttttggagatatatgctgacatggaggaattgggcgtgcgtccagacgaggatacaacaagaaggatcggacgagcgtttgcaacttcaggccaggaagataagcagaagcctgtccttgaaaaatacttgaagaagtggaagtacatccatttcaatggcgaacgcgttcgggtacggagggcaggacctttggcctagtaaacgtcgtctgaatagcttggggcgaacaatgtgagtatcacctcgtctggacatatgcgattgctatc

SEQ ID NO: 339 - DNA, 1046 bp, Hordeum vulgare
catacgtacgtgcccaagcactcgaacgtgtagaaaacatgtcgaggcccctgtttggtgtaatggccgcggcggcgatcgtcgtcgtgggttgctgtttcgcggcgtgtccggtcggcgccggcgcgagcgctggtggcttctacgagaacttcgaggtgaagtggggcacggacccggaccctgaccggcgggtggagatcgtcgacggcgggcggctggtgacgctcaccctcaacaacgtctccggctccgggttccagtcccgggacgccttcctcttcggcgagttcaccatggagatgaagctcgtgccgggcgactccgcaggcacggtcaccaccttctacttgacatccaaggacccgacggcggtcggggacgggcacgacgagatcgacttcgagttcctgggcaacgtgagcggggagccgtacctgatgcagaccaacgtgttcgcgcagggggtcgggggcagggagcagcggtcctacctgtggttcgacccgacagaggacttccacaactacaccatcctctggaaccctctaaacatcatcttctcggtggacggcgtgccggtgcgcgtgttccggaaccaggaggcgaacggcgtgccgtacctgaccaggcgggcgatgaaggtgcacgccaccatctgggacggcgacacctgggccacgcgcggcggccgggtcaagatcgactgggcgcacgcgcccttcgtcgcctcctacgggacctacgcctccagcgcctgcgtctcggcggccggcgacggcgacggcgatgaggacgtcccgtcggccttctgctgcccgggcgacgccgcgtcgtggatggcccggcggctgggtcccgacggcgagcgcgcgctggcgtgggcgcgggacaagtacatggtgatggactactgcgacgacccctggaacctgggccgccccgccgagtgcgacatggaccggctcgcctcggccgtctgattgttttgttccgtcggccataccggttccacacacgtgtcgtcgtgtattaggcagacatag

SEQ ID NO: 340 - DNA, 1487 bp, Hordeum vulgare
aatttcaggcggcgacaatggccaccaacgacaagccgcacgccgtcttcgtgccgttcccggcgcaggggcacgtcacgccgatgatgaagctagccaaggtcctccaccgcaagggcttccatgtcacctttgtcaacaccgagtacaaccagcgccgccttgtccgctcccgcggccccgacgccgtggccggcctcccggacttccgcttcgccaccatcccagacggcctgcccacgtccaaagcagacgccgacgctgacgccacgcaggacccgccgtccctttgctactacaccatgaccacctgcctcccccatttgaagaacctgctccgcgacctcaacgccgccgttggggcgccgtcggtcagctgcgtcgtgggtgacggcgtcatgagcttctgcgtggacgcggccgcggagctcggcgtgccgtgcgcgctgttctggactgccagcgcctgcggcttcatgggctaccgcaacttccggttcctcctagacgagggcctcacccctctcaaagacgaagagcaagtgaagaacgggtacctggacacgccggtgacgcaggcacgtgggatgagcaagcacatgcgcctccgagacttctcctccttcgtccgcaccacggaccgcagcgacatcctcttcaacttcctgctgcacgaggtcgagcagtcggatcgcgcgaccgccatcgtcatcaacaccattgacgagctcgagcagacggcgctcgacgccatgcgcgccatcctccccgtgcccgtctacaccatcggcccgcttaacttcctcacccagcagctggtctcagaaggcgatggcggcggaagcgagctcgcggcgatgcgctccagcctctggagagaagatcagtcatgtctcgagtggctccagggcagggagccgcggtccgtggtgtacgtcaactacgggagcgtgaccaccatgtcgaagcaggagctggtggagttcgcgtggggactggccaactgcggctacgacttcctctggatcgtgaggaacgacctggtgaagggcgatgccgccgtgctgcctcccgagttcatcgaggccaccaagggcagatgcctcctggcaagctggtgcgagcaggaggcggtcatgcgtcacgaggcggtgggcgccttcttgacgcactgcgggtggaactccatgatggaggggctcggcgccggcgtgccgatgctctgctggcccttcttcgccgagcagcagacaaacagccgctatgcgtgtgtggagtggggcgttgggatggaggtcggcgatgatgtgcgtcgggtggtggtcgaggcgaggataagggaggtgatgggagggggagaagtaggaagggagatgcggaggagggcggcagagtggaaggaggtcgcttctcgctcgaccgcgcagcctggtggccggtcgttggccaaccttgagagtctgctcaaagatgtactgaagtgatga

SEQ ID NO: 341 - DNA, 2857 bp, Hordeum vulgare
gcacagagcacagagagcaggatgagggtggcggtggtcggcggcggggtgagtgggctggcggcggcgcacgagctgctcgccgccagcggcggaggcgacgtgcgtgtcaccctgtacgagcaggaggagagcctcggagggcatgccaggacggtggccgtcgacgacggcgccggcggctgcgtcaacctcgacctcggcttcatgagcttcaaccaggtgacatatccccacatgacggagtggttagaagggctcggtgtagaaatggagagatcagacatgtctttctcagtcagtaaacaaccggaaggcaacggaagaggatgtgagtggggaaacggcaacggtatctcaagcctctttgcgcaaaaatccaatatattgaaaacaagtttttggcgcatgctcggcgagatactcaagttcaagaacgatgctctggcgtacctggagtaccatcaagataaccctgatctgtactgcaatgagacattgggacaattcattcagtcacatggatattccctattattccaagaggcctatcttattccagtctgtgcaggcatgtggtcatctccatcacaaggcgttttgagcttgtctgctttcttcgtgctatcatttttccgtaaccatgatcttcttcagctatttcgttacccgcagttgcccactgtcaaggctcgttcgcactcctttgtagaaaaagtaaagggagaattggagagcctgggctgtcgaatgaaaaccagctgtcgggtcaaatctgtttcaagccttgatggaacatctggctacagagtcttggagaatgatggttcagaggaaacatacgacagtgtcatctttggggtccatgcacccaatgctctcaaagtgttaggagctgaagctacacatgatgaactgagaattctaggtgcctgtcggcatgtccaaagagatatataccttcactgcgaccaaaatctgatgccccaaaattcgttcgcatggagtgcctggaattttatgggaataactagcagcgttttttctgttacttactggctaaaccatatccagaaaattgaatctgtcagacctttccttgtgacactcaaccccccttgtgttccggatcgtgtattgcttaaatggtctacaagccttcttgttccgtctgtggctgctacaaaggcttatcttcagcttgatcagatccagggaaagagaggaatatggttctgtggggcatatcaaggtcacagcttccatgaagacggattgaaggatgggaaagcagcagctcaaggtttgcttggaaagaaatgtgagcttttgctgaaccgaaagcagattattccatcatggaccgaggctggggcgcgccttatggttacaagatttttcaacctatacgtatccatcggtaacttgatatttgtggaagaaggaggtagtgtgttcagttttggtaaagcttgcgacaagtgccgtacaaaatctgtcatccgagttcatgagcccttgttctattggaaggttgcaatagaaggaaatcttggcttggcagaagcctatattaatggttgtttctcttttcttgacaagagagaaggccttctgaatcttttcctgattctcattgctaacagagatgagcgtaggagcaaccggattgctagaaaagggggtcggtggacacccttgcatgtgatagctaggttggcacacgctagatacattttgcgcgaagtctcaaggaagaacactgtgacacagactcgtcgaaacatctctctgcactatgatcttagtaatgattttttctcgcttttcctggataaatccatgacctactcttgtgcagttttcaagatggagaacgaaagcttagaagtagcccaacatcgtaaacttagccttctaatcaacaaggctaaaatcaagaggggagatcatgttcttgatatcggtagcggctggggaagtttagcaatacaagcagttaagcaaactggttgcaaatacactggagtcactttgtcagcggagcaacataaatacgcagagagaaaagtcagagaagctggcttagaggaccacataacgtttctgctgtgcgactaccggcaaataccaccttgcaagtatgatgcaatcataagctgcggtatgattgagcatgttggccatgaatacatggatgaattttttgcttgttgcgagtcttacttggctgaagatggcatattggtccttcagttcatctcagccccagaggaacggtacgagcaatacagaagaaggacagacttcataaaagaatatatatttcctggcggttgccttccttcattggcccgtgtaatgtctgccatgaccacgtcatcaaggttcagcatggagcatattgagaatattgggcccaattactatacaactctgatgcactggagagacaacttcattgccaacaaagacaaaattttggccctgggctttgatgacaagtttatgcgtatctgggagtactacctcatattctctgcggcttgtttcaagttacgagctcttggagattaccaggttgttttctctcgtccaggcaaccggcggctaggcctgccttgatggctgaacgcaacatatcgttctccggtcagctgtagaatggttgctgctcgatagcctacgatcttctaatcagtcaaccctcgaatggtttcttcatacgggcagcctaatcatgaaatgtttagttttcatggctatcaataaactgtatgtgcgtatgcaagtgctaccttagccttgtcaatagaatttgagaattgtacggaaggaactggtttgttgctttgat

SEQ ID NO: 342 - DNA, 1129 bp, Hordeum vulgare
ccaacagccagcgctataagccaaacccggcgggcagcgcgaagcagcatacgcgcatgcgccaccaccaccgcgtcctcctccgctgccgcgcgatgcctctcctgccgtcgccgccgaggacgctgcgggttgagggaggccttgtgcgccaccgcctcgtcagatgccgtgggttgcctatcccgccgaagacgccgggggtctcgggcgggcgcctgttctcctccctgccgctcccgccgcctctccagtccccaagagaggtgcatgtttggtatctttgtcccgatgagctgaaaaatcagtcccaactgaatatgtatgaagaactcctgtctccttctgaaagagagtatgccgactctatgaaagcaacaatgttgcggaaagatgctgttttgtcccgtgcattgctgcgcaccaccctctcaagatatacaggttataaaattgatccgaggtcattcgagtttaagaagaacaaatttggcaaacctgaggtattgtggccacaggatgataactctgcggagcaacctttgcatttcaacatttcacacacaacttctttgattgcctgtggtattgccattaatgctcgtattggcattgatattgaagagaagaagcgaaatacaaccaagaatattttatctcttgctcgccgttacttcaccccttcggaagttaattatctagctgagatttcagattcagatgctcagcgaaaggaattcctgaaactatggactcttaaagaagcatatgtaaaagctcttggaatgggtttctcaggtgctcctttcagtacattttcgatcatgctggatacaagtatgggaattcggatttctaaggcatcgaatgcttccaggtctgattgccacctgtccgagaactggctgtttacactcgcggagctaaatagctctcactacatatcagtttgtatagaggacagctccagaagtcaaggtcctgaagacagtccagcaccagtagggttgaaagtatggaagaccgtaccgtttgtcgaagatacactcgtctctggaacagaagctgtaaaacttattgcctgactactgaaacattgttgtgaaacacacttggtccagtagcgata

SEQ ID NO: 343 - DNA, 1242 bp, Hordeum vulgare
agggaaatgagcagcgagacgagcaagcgagatcatgcacgggagctcctcgccgccgacaggaagttgatgaccgtggcccgcacagcgcgacgacgccggctcgaggtccggcggctgggacgtactgcgtctgcggctgcagaggacgagggcgcgaagcgggtgcggccggcgccggacagctcctcggactcgtctgactccgcgaaggtggcgccggagccccccttggcggcgtctaggtgctcggcgtgcgtgtcgcacggggcggtgtccgtgatcgggcgccggcgggagatggaggacgcggtggccgtcgccgcgccgttcctggccgatacggcggcggtggaggggagcggcgacgtggagcacggggcaggggaagagggcttcttcgctgtgtacgacgggcacggcgggtcccgcgtggcggaggcgtgccggtcgcggatgcacctggtgctcgcagaggaggtgcggcttcgtcgtccgcggcctgagggcggagggcagggtcgggccgtggacaacgaggcagacggcgcgcggtggaaggaggccatgacggcctgcttcgcccgggtggacggcgaggtcggcgtcgacgacgggaccgacaccggcgagcagacggtgggctccaccgccgtagtggccgtggtgggcccgcgccgcatcgtcgtcgcgaactgcggcgactcccgcgccgtgctctcccgcggcggcgtccccgtgccgctctcctccgaccacaagccagaccgacctgacgagatggaaagagtagaagcagctggtggcaaggtcattaactggaatggataccgtatcctgggagtgctcgcaacttctaggtcaataggagactattacctgaaaccatatgtgatagcggaaccagaagttaccgtcatggaccggacagacaaagatgagttcctcatactagcaagcgacggcctgtgggatgtcgtgtccaatgacgtcgcctgcaagatcgcgagaaattgcctaagtgggcgtgcggcctccaagtaccccgagtctgtctccgggagcacggcggccgacgccgcagcactgctggtggagctcgccatggcacgcggcagcaaggacaacatcagcgtcgttgtcgtcgagttgcggcgactgaagagtagggcagcggcggtgatcaaagacaaccgcagctagtactagcactagtggtaatgtaggagtggctggctggat

SEQ ID NO: 344 - DNA, 2877 bp, Hordeum vulgare
gtccagatgagttcgaagaaggttccgttcaaccgtcataaggagaatgaggaggcgaggaagaagagggaggaagatgaagcggcgcgcgtctatgcggagtttgttgagtcattcaagggtgaaagcacatccgggtcgaagtttgtccgtgggggcgtgattgatcccaatgccaagctgagagctgattcagaaggtggaaagtccaaagatgggggttctgttccaaagaagggcagtaggtatgttccatcttttttgccgccatcatttgggaaagagccacacaaaaagaaggaagatgagcggccgaaggaaaaggaaaaaggaaagccacgggtgatagataagttcatggaggaactcaagtttgagcaagagcttcgggaaaggcgtaatcaagaacgtgacggtcgacacggtgacacctccgcgtcctctagccattttgatgaactaccagatgaatttgaccccagtgggagaataccaggatcatttgatgatggggatccacaaaccacaaacttatatgttggcaatctctctcctcaggtggatgagaattttcttttgaggacatttggtcggtttggacctattgctagtgtcaagattatgtggcctcgaacagaagaagaacgcagaaggcaaagaaattgtggttttgttgcattcatgaatagagcagaaggacaggcagccaaggatgaaatgcaaggtgttattgtgtatgactatgagctgaagattgggtggggcaaatctgttgctcttccatcacaagcactgcctgctcctcctccaggacacatggcaatcagaaacaaggagggtggtactgtaatcatatctggtcctggaggtccacctgctgcatctgttacacgacaaacctcagagctggtccttactccaaatgttcccgatatagtagttgctccaccagatgattcacatcttaggcatgtgattgacacaatggctctgcatgtacttgatggtggatgtgcttttgaacaagctataatggaaagaggacgagggaattctttatttagcttcttgtttgatcttaaatcgaaagagcacacatactatgtctggaggttatactcctttgctcagggcgatactttacaacgatggcgaactgaaccatttatcatgattactggaagtgcaagatgggttccacctgctttgccatccagccgaagtcctaatcgtgaaaaagaatctacttttgcagctggtagaagcaggcgtgcggaagtggagcgtacactgactgattcacagcgtgatgaatttgaggacatgctacgtgcattgacattagagaggagtcagataaaggaggccatgggatttgcgttagataatgctgatgctgctggagagattgtcgaggttcttgcagaatctttgacacttaaggagacatctattcccaccaaggttgcaaggcttatgctagtgtccgacatccttcataacagtagtgctcccgtgaagaatgcttctgcgtttcgaaccaagtttgaggctgctatacctgatgtcatggagagcttcaatgacttatattgcagtatcactggaaggattactgctgaagctctgaaggagagggttttgaaagttctacaagtatgggcaaactggtttctgttttctgatgcatatctgaatgggctgaaagctacctttcttagaccaggcaactctggggtcacccctttccactctctatgtgatgatgcacctgaaattgaaacgataactagctctgagggtagtaataatggatttaggcttgatgaagatggtgccctggccacaggaaaggcagcagcgacgaaggagctgttagggcttccgcttgctgagcttgaacgttgttgtagacataatggcctctcactatgtggtggtaaagagatgatggttgccaggttgctcagcctggaggaagctgagaaggagcgagcatatcagaaagatgttgacatgaaatgtggacaaggagaacctcatagaactagtagagaggatattggtttgaatgcgcataatggtttgagacctggagaaggtactgttgatgatgaatcagttatgctgggcctctctcgtcacacaggtcaaaagcactatggaaaatcttcatctgccgaactgaaacaagttccaagcaagaagcagagggctggtcccatcttaccagcttctaaatggaatcaagaggatgatggcagcggcgatgaagatagaaaagatggtcaaggattgggattaagctattcatctggaagtgatattgctggtgatcctgggaaagctgatgcaaaagaaattagtactgatcaggcaattcatcatccagatacaattgttgatgaagagcataggcagaagttgaggcagattgagattggtgtcatgcagtatcgtgagtctcttgaggagaagggtttgtggaacatggaggagcttgagaggaaggttgccagccaccgtaggtgtcttcagtctgaatatgggttgtcttcttcagtagatggggcaaacaacaggcactcttccgagagaataccatcggaccggaaagaaaggtatgatgatgcacgcgattcttccaagaagcggcctcacagcccaagtaggagccgtagtccttcaaagaaatcatcactggatagagaccgagagcacaaccgcagcagagacagattgcatggtaatgatgttgggagagacagggcacgtgaaaaaaggtcaggccgagagaaggacgatcaccatgatagaagcagagaaagagaaaaggacaggagaaaggggaggtgactgaggtatgttggttcttga

SEQ ID NO: 345 - DNA, 3880 bp, Hordeum vulgare
taagccctagaacaccccttgcttttcgtcgctgctccccccgccggtgatggccgcgccgccggagacgacgggcgcgccgtccccgccggaaggggaggacaagggaaacgcgggcgtcgaggtctgctgcttcgagcaatctgcagaggacttctccagagcggtacgcgccatctcggagctcgccgccggcgagcccgagcccggcttccccgacgccgaggcggaacggctcgcctcctcgataacgttcctcagagaatggaggcattttaattatgagccaaaaggtgtaagttttactcacggcactggatcaacttcatccagagataacacacatgagattaccttaccacaattctcgtctgcatctgttcctcaggtcactcacttggaagatgggagggataataatacatacagttctgatttcattttgttcgctggggggaatgtttggtcgctggactggtgcccaaggttgtgcgacaagccttcttctcctgtaaattgtgagtatcttgctgttgctgctcatcctcctggttcttcttaccataaaattggtatgccactgattggcagaggcatcattcaagtttggtgtatcgtagcaccctttgaagaggcacgtactaatcagtcaacgcttgcatacagtaatagcaatcgtagaggaaggcctagaaaaataccgaatgagcacaattcaattgagagttcatcagttcctcgaaaaccaatagggggaccaagaaagataaaactgacgactagggatgatcacgcagaacctagtctgaaaaaaccaagggatcacacagaacctagtctgaaaaaaccaaggggcagaccaagaaaatatccactgtcagctaccaaagcagtagattcaacaaaaaatagcggaagtcaaggttctagttttgttgaccctcttgtcacttcaggagttattccaggcgatcttgcgttatcttgtgctataccatctgtgaagtctgtggactcagctccaaaaagaggtaggggtcgacctaggaaaatcccaattgacaaaataaagtgttcgcctgacactgaatggacagaagatatctctagagctctaatatgctgcactataccaaagaaaaaaagggggaggccccggaaatatccacccccaagcagcagcaagcatgtttctggcactgataatgaatttgaaagagaaactggatacacagagtctaattctaatttaagtcttgttacagttgatgcagcgctaccagttccatcttcatctcttacaatttgtgggaaaagatcaagaggtcggaatggtagaggacgacctaaaaaggaaacaaatccttgcatactttcttcatcggtggtttctggtctccaattgcaaagtagggagaccatttcaaatgacccagcatgctctgttgagaatcatttgccatatggacactccaacttgacaagtgagctttgttcaattgatggcaatgtgcacacaagccccactttagaagattccttgctgcccatgcacattgcagctaaatcaaatggcgaggagtcaagtggtagtaggagacgaggacggcctagaaggaagacactttcaattacaaacggttgtttatttgcttctggtaccgagtcctcaaaggtggcaactacaattaccgattcggacaatcccatggctttgaccaagagtgacggtgaaactatagcaagcgatcctgcttcagttggttcgttgatgaggtgtcatataggaatgtgcaatgtcaatatgagtgctgcatcaccacctcatggcttgtgtaatgcaaattacaaggaaaaatcaagtgcccagcatagaaagaagcctgttgcagtagagtggtgttcttcaactgcattcagcggcaaagaacaaaacaatcagacaactccccagacaagtgataatgtggcctcagtccaaaattgcaagaaagaattacttgtctacaccagaaggcgtgtacgaggacctacaaagaaacctgcttcaaatgagacctgctcactggctcttagtggtgacgcgcagaagatggaaagatcctccacgtctatcatgccaaataatcatttgttttctgttgagaatcccaagctactgggttcatctataagcgaagacatggctaatgaggcaggtttggttggatgtaagagtgcacttggtaaccatgaagtcatggaaaagaatgatagtgaagctgccaataaagttgtgcctgttccttctgaaaacagtgcccagatcataattgtggaagatgcagaagtagttccatccaaagaatcaagtaaaaatagtaatattattacttgtgcagaaaactcaaacttttctgcaatccccgaaggcattcatctaccaagggtcgttttgtgtttagctcataacggcaaagttgcttgggacatcaaatggaagcctcctttaccaaatcagtcagaacagaaatcacatttgggttttcttgcagtactgttgggaaatggctcacttgaagtatgggaagttccatctccaagcatgatccagaaaatatattcctcttcttcggtgaagggtaccgatcctcgctttctaaagctgcaacctgtatttagatgtgctaaagtgaagtgcggaaacatacagagcattcccttgacagttgattggtcgccttcttctcatgatatgatactggcaggatgtcatgacggaacggttgctttatggaagttctctacagacttgccatcacaagattcaaaaccttttatgtgtgtcactgctgaatctgttcccatcagagccctctcgtgggcaccatatgtaagcgaggaaaacacaaatatcttcgtcactgctggagaggatggcctgaaattctgggatttaagagatccataccgtcctctgtgggaactaactactgccccaagggctgttttaagtcttcattggttaaaggagtctagaggtattatcatctcactggaagatggcacattgaagttcatcagcctacctagaattgccaacgatgtttcagtcaccggaaggccatttgctgggactaaaactcagggtgtttctacttatcagttgtcagaatatctgatatggaatgtccatgtctcagaaattaccggttatgcagcttattgtgtggcagatggtactgctgtgcgcttccagcttacttcgagattctgggagaaggaacctgggaggaaccgtgtgccttatttcctttgtggttcggtagcagaggaaggggcaaccattaagattggtggaacattgcaaagctctcctttgtcaaatgttcctctggttgcaaaaaagggtccaaaaccatgccaaaaagtacctaaagcgcatgatacacaaacagagaaagtacttgccctcaccaactcagaacatgtagatccagaacccagagagggtcgactagatggacctggggagggccaagagaccaatgctctggttttagctgattctctaatgccagagaatggtggcacatgcaacgtcccagttgatgaagacactaaagactttgagctcttccctcccaaagctgtagcgctgcatcgactgagatggaatatgaacaaaggtagcgagaaatggttatgctatggaggcgccgcaggcatcatccgttgtcagaggatctaaaaggcaagcataattgggaagtgttttgtcccacctagtttgttgcatgtttgccgcagaccagggtcatccgtgtatatccacctacacaataagctgttgcagcaacatatggtatgttcttccgattctttccttgacctttcatag

SEQ ID NO: 346 - DNA, 448 bp, Hordeum vulgare
gtctctgccttcgtctctcaactccagcctctgcttgaccgttgtagtacgtacacaaagcaatggagcacaaggggcagcttcagccggagaagaagagtgcccaagaagaagaagaagaagccatggcgatggcggcctcgtctccttccttcttcttcgcgcaccccttgtctctactgcaccacgtcacccgcggcttcgccgggtacatgggcctctctcgtctctgccacgcgctcaaggatctcaagcctcgggccgccacttcttcccggctgcatgagcaagggcccggagcaggaggcgctggacatgctgcagatgatggttgcgcggccgtccaagtgcggtcgagaggggtgcctcagaggcctcgtggtccaagagaaggacgaggaggaacacaccactaggcttaggcttagcatagtctgcaattgtaggc

SEQ ID NO: 347 - DNA, 2261 bp, Hordeum vulgare
ccgggatgctgcacgagctcctcctcgccctcctcggcttcaccggcgacttcgtgctcgacaactcctccgccccccgccgccccgagcccgccgaggccggcggcgccgcagacggcgacgcgggccccgccttccgcctggcgcccgacctcaccttcctccagccgtccgagaggagtgctattgaaaggctcatatctctgggcttttattacagagaactgaatcgttttgcgaccgagtctcgtgatctgagttggattcagtcttctgttgatgtttcatcacctaatgctgatattactctgaagggtaaagggagaaaagggagtgcataccggagggcaattggcaatggtattgctgagattttatcagtttataggtcagctgttctgcaggttgagcaaaacctgttatcagatccattgcctatcctggcgacagtaactcatgggctaaataagttcgaggttcttctgcctccactttatgagcttgttatggaaatcgagcagaaagacatcaagggaggacagcttcttaacctgttacataaaagatgccattgcggggttccagaattgcaaagctgcattcagaggctgctttggcatggacatcaggtcatgtttaaccagctgacttcttggatggtttatggtattcttcaagatcagtaccatgaattcttcatcagaagacaggttgacagggacgaggagaatgaatcagctcagtctgatgttgctgataaatttgcgcagaaattagctagagacacatcccttactagttggcactcaggatttcatgtatcattggacatgttgccggagtatatccatatgcgagttgcagaatcaattctattcgctggcaaagcaataagggtacttagaaatcctagtcctggtgctacattgctggaaccaaccaaccaaagtcagacactgaaagggtctcatagaatgcaaagtttcattgggtgctccggtgctctgaaagagctgccaaacttctctaacattagtgcagaggaattattgccacaggctgaagcagataaagttgatgccatgcttaagcagctaaagcatgcttccgaatttcataaaaggttgtttgagtctgctgttagctcaatacgtacaattgcagctaatcatctttggcagttagtggttgtacgcgctgatctcaatggccacttgaaggcacttaaagactattttcttttggcgaaaggtgattttttccagtgttttcttgaggaaagccgtcaattaatgcgcttaccacctcgtcagtctacagctgaagcagatctcattgtcccatttcagttggctgcactgaaaactataggcgatgaagacaaatacttcaccagggtatccctaaggatgccactgtttggtatgaaatcgagcacctcacagaaagatcttcaaaagtccaacacatcagatctttcgttgcaaggaaaggctagctcagagttggcacttgatggttggcatagtattgctctggaatattctgtcgattggccactacaactcttctttactcctgatgttctttctaagtaccgcaaagtttttcagtatctcattcggttgaagaggacacaaatggaattggagaaatcctggacagctgtaatgcatcaagatcatgttgatttttctgattattgcaaggatcagaagaattcctctgcaacacaactgcgccggttacgcacgaagcctttttggcgagtaagggagcatatggctttcttgatcagaaacctacagttctacatccaggttgatgtaattgagtcacagtggaatgtcttacaaactcacgtccaagattcacatgattttacagaactagtgacctttcatcaagactatttgtcggcattgatatcacagtccttcttggatataggatcagtgtctagaatactggacagtataatgaagctttgcttgcagttctgctggagtatagagcaatacgaaacaggggcaaacatgtttgagattgatcacataacggaggagttcaacaagaaatcaaattcgctgtacactatcctaaggagtagtcgacttgcaggaagtcagagagcacctttcctgaggcagtttctgatgagactgaactttaactctttctttgagacaactgcgaggggtgtgatgaattcgggcaggctgcggccaggcacagcgagtacccagctgtaagcctattaa

SEQ ID NO: 348 - DNA, 3238 bp, Hordeum vulgare
tagaaccctctccaggtctcggctctccgccgtcgccatgggcagcgcctccaagctgctctcctccctcttgctcacctcctccccgctccgtctccggccctccgccgccgccttcgcgctcatcctctcctcgcgcaccgcggcatcccgccgccaacacctgctctcctccccctctcccctccgcacgctctccacctcggccgccgccgccgccgcctcaccccttccctgcagctccagctccgcctcgtcaactccaccgccccacgtccctttccctgactggtcccgcctcgtggaccgcctcgcggccgccggttacgcagcccgcgccccctcccccgccgacgagctcgccgtcccctccggcagcggcctgtcggccgaggcggagtccgctgtgtcctcctgcctggccttcgcgcgcgaccggcccgaccttctcaggtcgctgcccacgaaggatgtcgaggttgtggtgtctaacgttgcaccggctctcttcaagagaggggaggaatctgcgcagcggctgcagcaatacctcgccggtgaagatgacaatgcaattcaatcagtcagagcggaaactgtggacatcgttcggtacttgttaagttacacatatggttcgtcaaacaactatttggaagacaaagaactcactgattcagctgtgagaaatatcttggctgagctagttaattttagtggacttccccacacctccagttttgtggagtcaacagttgataatcaacctgagcgattctctaggcatccaggacaaaatgttgagatgaaacgtggtgattggatttgcacaagatgtagctttatgaactttgcaagaaatgcgaggtgccttgagtgcaatgagcatcggccaaagaagatgttgactggcggagagtgggaatgccctcagtgtgaattctataattatgggaggaacatgtcgtgcttaagatgtgcttgcaaaagaccagcgacaactgcatctgctggtgctggtttaggcggtgtggcggatcttcttagtgtaaccaatgctggtagatctgacattgagagaaaacttgctgaaaacgatgagaaggcagaaagatggttgagcaaagtatctcaacttgacgattctgctgatttgagtagtctggcagctgatgaggattttcctgagattatgcctatgaggaagggggtcaataaatttgtagttagcacacgcaagacaccattggagagaagattgtcaagtgcacagtacagcagtaataatagccctcaagcaacagcatccgactccaagattagtcaaactttagacaggatacttgggcgttctgcatctacctctgccccaagcaaccaatctgataatgggggtgtagatgctgggcctcccaggaaattaacaggccatcttggtgatatcgaccctgttccttttgtgccattatctgctgatctgtttaccaagccacagaatgcaaacagtaatgaacaggcagatacggactgccaaataaataaggaaactggaagttccacaccggataccacacaggcctcaactgggaggagggatgtcgataaatcgctagatactgctgagaaatggtccaagaaagtcgcagaactcgacagtgtaaatgacctttcaagtgctatttctgatgaagactttcctgatattatgccaatgaggaaaggagagaatcggtttgttattagtaagaaaaaagaccggtcactggcatcaccgcagtacaagaggcgcagtgtgcttgagcaggctgacaattccgatttcgtcccatttgttccgttcccccctgattattttgccaagaaagatgcgccagcagagagcactccagatacaggaacagtatcagaaagtcctccatcagctgataagctaccagaaacaaatgcttcaccaggaaattcgggaaatagccaaaacacctcacaggtgattggccctcagcgaagtagcaacatgactaatgagaactggaatagaaattactctcagcagagctcgagtacaggtggttatacacagggtggaagcagcagccagcagtatcaacagcaaccttatgatgtgggtgatcgatcgagtcgaacttcgaataccagtgcttggaacccaaactactcccaggggacgtttaatgatggaagaggaggatctagcaactatcagcatcaacagcaaccccaggagctaggcgatcaatctattagaacttcgaatactggtgctttgaacacaaactactcacaggggaggtttaatgatggcagaggtggatctagcaactatcagcatcaacaacaacctcgtgagatgggtgatcgatctagtggaatttcgaatactggagcttggaacacaaaccactcacaggatagttttaatgatggcagaggtggatctagcaactaccagcaacaacagcaacttcatgggatgggcgatcaatctagtggaacttcaaatactggtgcttggaacacaaactacccacagggcaggtttaatgatggcagaggtggatccagcaactaccagtatcagcagcaacctcatcagacgggtggtcgacccagtggcactttggatacccacgctccaaactcaaactactctcaggggagcttcaacgagggccgagatacatctacttataatcacggcagctactctacacaaccgtcttatgcgcccggttacagtaataatagcaacagcaatgcttggagcagcaacaacaaccaaaattggagtggttcacatcctgatactagggctaccactaccggcattggttccacaaaccctaatcaagcaacaggctactcaagctacggaagtggaggttatactggaaagagcttagaaggctctgctgtgaaggaccctgatcctctggacatgtccgaggaagccaaggccgagagatggttcaggagggcagcccagataaaggacatctccgagctcgccaacatccccgatgaggacttccctgagataatgccgatgaggaagggggtgaacagattcgttgtgagcaagcggaagacgccgttggagaggagattaacctctcctcagtacagaaggaacctgccgatcgtaagctctgagccggacaaagatggtagctgaaagcaggtatatttattccgatgcaagagcgaagagtttacatag

SEQ ID NO: 349 - DNA, 1502 bp, Hordeum vulgare
gcacgaaaggaacgaagcgcccctcgctcccactcgccgccgcctccggcgtcgctacagaatatacagaggctaaagtcaaccttaaaatggaggatgctaatgcagtagtagattggaatgttgacattattggcccagatggtggtagtgcttgccgcaaattggcaaaaactgaagaccctgatgccacggagtgttcaagttcctttggggacacactatccggatctcaggatgatgcaaagccttcagagatcagtgacattgaagtagactcaccattctgccgatatcctcataatggtgatgctgctgcgctcttggatgcagctgcttctgacaatttggatagattattgaaaaagaaaaaggtgactgatcattggagaaactatatcagcccattaatgtggagatgtcaatggttagagctacggatgaaagacttgcaatctcaagtatctagatatgacagggagcttgcagtacttaaacatgagaaagagttgcagacaaaaatgatcgagttggactgttcatcgtcgagatcagtgcccttctcttctcattgctgcaggaagactatgaagaggaagaagagaaagagaaacgaggagaaaatcaatgctccatcatacatcgcaacccacaccatattgtcttattacgaaaaagagaaaacggaaggggatggcccttctatcgacgacaatggaaacttagcagatgacagcacaaaaggaaataatgacgctgactggctacttggtaatggagacgatgctactgtcgagcagattcttttaaacattcagtctattcaagacagagtctgtagtctgagatcagatctcaagaaagcaatggccaagaagagcaaggggcttgtccttaaagtcaacacacgtgtcaatggcgcacagagctctaattgctcacatggaaaaggcaaagttgctgaaatgcctgaaatatcacctcaagatgcatcagattgtgatatggacgatatggacatgcccgatagtgctgtctcaagctatggagaagctaacaatatggatatttttgagagcacgatgaacctattgtcagttgaagatccagataaaatcggtgaactacaccagacttcggaagatgtgttgatcgacaaccaaccagcagagggagggtatcaaaatttcgaggtgatcaatcatccatgccagcggctacgggtatcagtcaagagggaacaggtacctgtcaagagagaaaccatagcacattctgaggatgagagcgtcgctgcccccatggcggtcgttaaggaagaagacacaaccaggttgggcctccaggggatcttgaagccctgctacacgggcaagagaaaaggcaggaagccgaagattctaaggcgcggcggttcatcatccgttctcagctcatggaagagcgcccggactcgaaagaagaggaaatcatagacgcagatcgtctcagtgaatgcatag

SEQ ID NO: 350 - DNA, 2359 bp, Hordeum vulgare
tactatagtgtgcgcaagggaccaagcagcgagagctgaagggactcgagggattagcctagggttttagggcggccgaggcggcggcatgggctaccaccacctcctcgtcgtctcgccgccggcgcagccgccgccgcggcgcctctccctcctctcccgctcgccgcgtggagccgtcaccgccgctgcctcgcccgacgccgcccggtccttgtcggtggtggcagcgtcggcggccacgcgaaggagggccgtgctcctggtcgggatctccgtgctcccgctcctgcgcctccgtgacgcggcggccgccgcgcagcccttagcggcagatctcgtcactgataaaatgggcattcagacgtctgaggaaatgcagcttgaagaaactagggctaaaccacctcagcctgaggtgaaaaggccatctccagggaatcctcttgcaaatcttctgaatgcaattgcagttattgcttctgggcttctggctgggcttcttggtactactcaacgtgaaaagaaggccttgcagtcaaccatctcatctatggagatcaaattggctgaagatgaggcagcgatgtctgtgcttagagagaactatgagaaaaggctattggatgagcaagcggcacagaagaaacaagctaggatgttccaggacgaggaagcttctcttcttgatcaattggcttcaacaacgagaactgtaaaaaaattaaatggggaagttatgaaggaggaagagctagttgggcagcttaaacatggaatacatgatcttgagatgagcattgcacaagcagaggaagacaaacatgcatttgaagaaaatttgagggacaagttggaaacagttgatattttacatggcaaggtaaatctgcttagccaagatgtaaatgacaaggaggaacacattacagaactcagttcatcactttcaaccaaggaaggagactaccagaacctgcacttgatgtttaatcagactaaagggagcctggaacatgcaaattctagaatggagcaactggagaagtatgtttatgcagctaaaaatgatataaaatcaaagatatcctcaattgattcattgaatgaggatgtccaaacattgtacagtgcaaagagtgatgccgaggaaaaaataaatgagttaatgaaacagtatgcggaattggacgctgcttctgagatgagggcctctcgcgatttggaactattgtcaaataaagatgatcagctcaatcaactcgaagaacaactttctactgcattaagtgactctattgaagacagaattataatcgctgagttaaacagtgaattggaagctaacagaacaatgctagtcaatgaagttgaggcccggaaaaaaatgtcagatcttattcagtccactgaagatgcacttaaagaatccagaaacgagttgttcaaactgtccgaagagcttaatgaagtaaatatatctaaccattacttgagaacccagatttcagaattcacaaatgagtctaatgaagtgaaagaggccctgactaacaaagtagaagaagcggaatcagtttctaaagctctttcagatgaagtggcctcactcaaggagatacttcaaaagacgcaagaagatcttgaagtcacctctaatcaattggtgtctattacagaagtgcacgatgaacttaataaagaattgctggatgcatataaaaaattagagtctgcaacagatgagcttgttcgagaacgacagattaattctattttaaatagggagcttgaggcattggtggaacaatcacaggtggaatctgaagctagaagagctcttcatgtagacttggatgaggccaccgtttcactaaatgaggtgaatgagagtacattatttctgtctaataagcttgatagcactgtttccaggatttgtgctattaaagaagagaaagaggtgctttcagcggctcttttggagcaaaagaaaaggacagccgaagctcagaaaaatatggtggacgctcagcatcttattaaaaggctcgggatggagagagagaatagtgaaatcaggaataaaaagcttgaagaggaattggccacagcaaaaggtgagatgttatatctgaggaggcagattactgcaagtgggtcacagaatacagatgttatggaagcaagcccaacaccaaatttcagtcaacctctggaagatcgtgttccaaataccagtagtactgatgctgtacctcctcgttctgctaagaagatctataggagaagaaaagacagaccatcaacataagcattatcagaacatgtgatctaccatcaatcttccatttgctag

SEQ ID NO: 351 - DNA, 1012 bp, Hordeum vulgare
acttccctgttccacgtctgttgactcctcccaccttcctctgctccggtagaccgtaaaaatggccgcatcactgccgtacctccctccgccgccgcctacgccgtcgccggcggccaccaccctgccgagcaacctcgtctccttccccgcgccgcggccgcgccccgcggccacgcaccgccgcgcggtactggccgcggcctcgtccaggccccctccccctccgccgccgtccccggagggaggggacgaggaggtggagagggccatggggatggacggcggcatcccgggaacctccggggagctgctgcgccgcgtctcctcccgcgcctacggcatgcgccgccacctcatggagtcgctcgactccctcgcctacgacgtgttggagacaaacccatggagggaacaacagcccaagccagtctacgtcctggctagaagagacaatcaactatggacgatgaaaacccgcaggaaccgcagtgaagttgaaagggaacttggaatgcttttctcaaagggagggggctcaggagttgggactaaatccaagtactctggctccaagtttagcatggttgttgaagatctgacagagggtgtgctggtgttcgaagacgaggatgatgctgtaaaatactgtgatgttctacagggcggtggtcaaggatgcgagggaattgcagagctagaggcttcatcagttttcaacatgtgccgtcaaatgaaagctctcgctgtccttttccggcgtggaaggactcctccaacgccacaaagccttgagcgtgacttgagggcgaggaaccggtcactggaagactaggatcttctgaaacgcggtgtagatatgttaattgtattcttctagctgttgaagcacaggccatatgccttgtatactgaatggtacatagatgtttgaagccacaaagaaaatgatgcaaaataactggtacatattcaatgatagccaagatggagtggaagtcaagtctgacag

SEQ ID NO: 352 - DNA, 1356 bp, Hordeum vulgare
ccaccatgtacggcgtcggcggcggcggaggcggcttcaacgcgccatccacggcctccgggcggcgccggaaccaggaggacgacgaggaagaggaggaggaggaggagcagaccggcgacggccgcgtcctcgaggcatgggagcgcgcctacgccgacgaccgctcgtgggaggcgctggaggaggacgactcgggcctgctccgccccatcgacaccaagaacctcgtccactcgcagtaccgccgccgcatcctgctccgctccgcggccgccgccgcccgcatccagaagggcctcattcggtatctgtacatcgtaatcgacctctccagggcggcttccgaaatggattatcgccctagtcgaatggcagtcgttgcaaaatgtgctgaggcattcataagggaattcttcgatcagaatcccttgagccatgttgggctagtgacaattaaagatggcatttctcatcgacttacggagattggagggagtccagagtcacagattaacgcattgatgggcaagcttgagtgttctggtgattcatctctgcagaatgctctagaacttgtccatggttacttgaatcagattccttcctatggtcacaaggaagtattatttttgtactccgcactgaatacatgtgatcctggtgatatcatggagacaatagaaaaatgcaagaaatccaaagttagatgttcggttattgggcttgctgcagaaattttcatttgtaagcatctctgcgaagagactggtggatcctatacggttgcactagacgagtcccacttcaaggaattgctgcttgaacatgctcctccgccacctgccattgcagagtatgctgcagccaatttaattaagatggggtttccacagaggggagcagaggatcttatctccatctgctcttgtcacaagaaaattaaatctggtgctgaaggttatatatgtcccagatgcaaagttaatgtatgcgagcttccaacggagtgccgaacatgtggtctaacacttgttagctccccacatctggcacgatcttatcaccatctattccctgtatcgccgtttgatgaggtgacgttcaaattaggtcaaaagggaggacaaaattgtttcggctgccagcagagtctcattaacacaggtgggcaatctaatatccatgtccgttgtccaaaatgcaaccaccacttctgctttgactgtgatatttacatccatgagagcttgcataactgccccggctgcgagagtcagcgcagttcatctcgatagggacaccatggtgtgcattgttcaggtgttgatcctttttgagtcggagctgcgcatt

SEQ ID NO: 353 - DNA, 1472 bp, Hordeum vulgare
ccagatcccctctcttctcctccccgtcacctcccccaatccccattttccccacacggccaagggaaaatggcgccgtccacctcgtcggcgtccgccctcatccacctccctggcctgcctcccaggagaccccatagtggcgggtgccggaaccagacgcggcggccgcgccatgcggccgtgcagtgctccttcgcgttcgcgcccgtggagacggcgaggataaaggtcgtcggcgtaggcggcggcggcaacaacgccgtcaaccgtatgatcggcagcggcctccagggtatcgagttttatgctataaacacagattcccaggctctcgtcaattcgcaggcacaacatccgttacaaattggagaacaattgactcgtgggctgggtactggtggaaatcctaatttgggagaacaggctgccgaggaatcaaaggaagtgatagccaatgccctccgagattcggaccttgtcttcataacagctgggatgggagggggtactggctccggtgctgctccagttgttgcccagatagcaaaggaagctggttatcttactgtcggtgttgtcacctacccattcagcttcgaaggacgcaaacgctctttacaggcacttgaagcattagagaagctggaaaggagtgttgacacactaattgtgataccaaatgatcggttgttagatattgctgatgaaaatatgcccttgcaagacgcgtttctccttgcagatgatgtccttcgtcagggtgtccaaggaatatcagacataatcacgatacctgggcttgtgaatgttgattttgccgatgtgaaagctgtgatgaaaaattctggaactgccatgcttggcgttggtgtttcttccagcaaaaaccgcgcccaagaagctgctgagcaggcaactcttgcccctttgatagggtcatccattgaggcagctaccggtgttgtgtacaatatcactggcgggaaggacatcactttgcaagaagtaaacaaggtctctcagattgtgacaagcttggccgacccctcggcaaacataatttttggtgctgtcgtagacgaccgttataacggcgagatccacgtgaccatcatcgcaacaggatttccgcagtccttccagaagtcccttctggctgaccctaagggagctcggatactggaggcgaaagaaaaggcggctagcctcgtatcagctgctgtgcaacaaccgacgccggcggccgtcccgacatggtcgcggaggctcttctcctgaacaccgttcagcaggcacaaacaaccttgtgaagctgtggttctcactttatcaaggcagtagagagttagccggtgcggtgtaaacactctgaaactagtttcgcgtagtgattaggttctcgcctggtgtatgtattgttcagaagtctcttgactcggttgttttagaaggtgttctgttcgttgaca

SEQ ID NO: 354 - DNA, 2315 bp, Gossypium hirsutum
aattccaatctttcccttcttcttctcggaatttgacatggacggtgtgacggtggcgtcgacgccttcgccgtcgtactctacgacggcctatgtgagctgggacgaggtgaatgtttcaagcgataaaggaaggagagtggttcactattatttgaagagaagggacggcgtttcagatctggctgtgattggtaaagaaaagagcttgaggcacatgtcttatcatttcgctattaagaaccgttctcttttcttctcttcgacttctttttacaagctcaagtctcgccgggaggtcgtcaattggcttaattctgtcgtttccgattcttcttcacgtgagtctcactgttcagttgatggcatttggaatggaaaggacgtgaaaagtatggattttggagccgtcaaggatcttcagtcacaaaagctggtccaaaaagaatttttatggttaggttcttcgtggacgtgcaagagaaaaaagaaacactatgagtctttccgcaggaatggtgtaataatttcggttcacgacttcgtttatgtcttagctgaggagaataaacgacttgttgcctatttggaagatttgtatgaggactctaggggcaacaagatggttgtggtacgatggtttcacaaaattgatgaggttgatattgaccttcatcacaattataattgcagagaaattttcttttctcattgtcttcaagatctcagtattgaatgcatagatggattggctactgtccttagtcctttgcatttcaagaaatttttgaatgaggcaacacacactcggctggagccatttgtatgctgcaagcaatttgaaaatgatgttaagccttttgatgtgactcaagttaagggttactggaaacaagatatacttagatatatgtatggtctttctccttcaaatgattgtgtgactcgtcagcaacgtgctgacgacctgaaaactgtttgggatgttgatgacgatgttgggattaggcctagaaagagatattgtcgatcaaaagatgattatatgcacatgcatttcagtggcagtagagagtcaatggatacatcatttgcagatgtgcaagactttcacaaaagcaaaaatggaaatgcatcattcaatttcagtggtgggaattttgcgttcctgtccactggtgaggctaagcgatattcttctcaccatttaatggtaggttccgaggttgaagtgctaactcaagatagtggtatgagagggtgttggtttagagctcatataattaagaagcacagaaataagatgaagttgcaataccaagacatccaggatgcagctaatgaagctaacaaattagaggaatggattttggcaaccaaggttgccacttctgatgaagtgggtattcgtgtttctggccggacaactattcgaccgtcttcacaattcactaaaggtagtacttcatgtattggtgttgggtctgttgttgatgtctggtggcatgatggttggtgggaaggccttgttgttcaggagttggaagataaatttcgtgttcatttcccaggagaaaagcgggaatcagtctttggtatcggtgatataagacaatctcaggaatggataggaaatcggtggataaatatgaaggaaaggcatgatcttgtgagtaccatcatccaggccagaaagcaagaggcaagcaaatcctataatttcaataccgacaaaaacaccatttgtgtgagtggacagtgtggtaaagaagccactgagtgtaaaggttttgctgttgaaccaggaaatgagagggcacaagatacgagtgttgttccagatctttcaaaggatggtcggctttctcagttgaagtggaagtcatctaggaagagaaaacgtgtgacttcaaactgtgtacggaaactgaattgcagtcgaaacctcatcaaaagcactgcacagtcagttgcttgtgaacgatttttgatccctgcatccttaaaagtcgataatgagaactgcaagaacataggtgatccgttattcagttcttcagtagtgccgccgctaacaagcttggtaatgactaggtgattagagttgttgctttctgttttgtttggaagtgttcatttcggaagtctggcattgcggcatccatctccctcttttattttcttgtatgtaactttcagcctatggggctcttaacttatagagtcttgcaaatttcaggctacagttttggatgcattataataacctggtagatctctaacttactaaacctcgtttgtctaggatgtttcca

SEQ ID NO: 355 - DNA, 989 bp, Gossypium hirsutum
tgaaaatggctgctaccttctttaggagactctccaaagccaccccagctaccttcaacaatgcatttcgaggtcagcccaagtctggttttgctggatttcgcttcactaccatcgccgccgttgccggtggaatctctacttactactgcttctccgactcaaatttggttcatctagatcaagtcaatgaagagactggtccaaaagttgctttgaaatctgataagtggcttgaatttaagttgcaagatactgcaagagttagtcacaacactcacttgttcaggttttcatttgatccctctgctaagttgggattggatgtcgcttcatgcatccttactagggctccattaggacaagatgctgaaggaaaaaccaaatatgtcatacgaccgtatactcctatatcagatccagatgctaagggatactttgacttattaatcaaggtgtatccagaaggaaaaatgagtcagcattttgctagcttgaaaccaggcgatgtagttgaggtgaaagggcccattgaaaagctcagatactcacccaatatgaagaaacacattggcatgattgcaggtgggacaggcataactccaatgcttcaggttattgaggctatactgaagaaccctgatgacaagactcaggtgtcactgctttatgccaatgtctcccctgatgatatactgctcaagcagaagcttgatatacttgctgctagtcatccgaatcttaaggtattctacactgtagacaatccaactaaaacttggaaaggaggtgctggattcatttcaaaggatatggtcacaaaaggcttacctggtcctgctgcagatactcttatccttgtatgcggtccacctgggatgatggaacacatatctggtgataaggctaaagactattcacaaggagagctaaccggcatactcaaagaactcggatacactgagcaaatggtttacaaattttgatga

SEQ ID NO: 356 - DNA, 2504 bp, Gossypium hirsutum
ttctttaggagggtggtcaatatggggtcttcgattttgccagatctcggagctgagatcttgatccccgtttgcgccgttattggaattgtcttttctcttgcacaatggcttcttgtttccaaggtgaagctctccccgggtcgagactcgggttcccccggtaacaacggtgcgggtgggaaaaacggctattccgattacctcattgaagaagaagaaggtcttaatgaccataatgttgttattaagtgtgctgaaattcagaccgccatatctgaaggagcaacctcatttcttttcactgagtaccagtatgttggcattttcatggttgcttttgcaatcttgattttccttttccttggctcggtagagggtttcagcaccaagagccagccttgcacttatgacaaatctaagatgtgcaaacctgctcttgccactgctatattcagcacagtatctttcttgctcggtgctgtcacttcagtagtttctggctttcttgggatgaaaattgctacctatgctaatgctcgaaccaccctggaggcaagaaagggagttgggaaggcatttattactgcattcagatctggtgctgtcatgggctttcttcttgctgcaaatggtcttttggtgctttacattgccatcaacttattcaagctctactacggtgatgactggggtggtctttttgaggcaatcactggttatgggcttggaggttcgtccatggcgctttttggaagagttggtggaggcatctatacgaaggctgctgatgtgggtgctgatcttgtaggcaaggtggaaaggaacattcctgaggatgaccctagaaacccagctgtgattgctgacaatgttggggataatgttggtgatatcgctgggatgggatctgatctttttgggtcctatgctgaatcatcttgtgctgcacttgttgtcgcttccatctcttcttttggcatcaatcatgaattgactccgatgttatatcctctcattataagttccgttggtatcattgtttgtttaatcaccaccttatttgctactgatttctttgagatcaaggctgttaaggaaattgagccatcattgaagaggcaacttatcatctccactgttctcatgactatcggaattgggattgttagttgggtagctcttccatcttcctttaccattttcaattttggagatcagaaagctgtgaagaattggcagctattcttatgtgttgctgttggtctttgggctggcctaattatcggttttgtaaccgagtactacactagcaatgcatacagccctgtacaagacgttgctgattcctgcaggactggagcagcgactaatgttattttcggccttgctttgggttacaagtcttgcattattcctatttttgccatcgcaatgagtatttttgttagtttcagctttgctgctatgtacggcattgctgttgctgcccttggaatgctgagcaccatagctactggattggctattgatgcttatggtcccatcagtgataatgctggaggcattgctgagatggctggcatgagccacagaattcgagagagaactgatgctcttgatgctgcaggaaacaccactgctgctattggaaagggtttcgccattggttcagcagcccttgtgtcccttgccctctttggtgcctttgtgagccgtgctgctatttcaacagttgatgtattgacccctaaagtttttattgggttgcttgtcggggcaatgcttccttactggttctctgctatgaccatgaagagtgtgggaagtgctgctttgaagatggttgaggaagtgcgtcggcaatttaacacgatcccaggtctcatggagggcactgctaagccagactatgctacctgtgttaaaatctctactgatgcttccatcaaagaaatgatcccacctggtgcgctagttatgctcacaccccttattgttgggatcttttttggtgtggaaactctctccggtgtccttgctggatccctcgtctctggcgtccagattgctatctccgcatcgaacacagggggtgcttgggataatgctaagaagtatatcgaggccggtgcttcagaacatgcaagaactcttggtcccaaaggatcagaaccacataaggcagctgttatcggtgacaccattggggaccctctaaaggatacatccggaccatcactgaacatcctcatcaagctaatggctgttgaatcacttgtctttgcacccttcttcgctacacacggtggactgcttttcaagatattttaagtaaaagaacacaaaaacggttacagtctctgccggttctcttccaaatctccttttttttttctcaagtatagttttagtgtgtagcacattttgacaatatcctcttaaaggttgaatctatagcgaaaattttcccttgcaaaaggttgacaatgaaatcaatgatg

SEQ ID NO: 357 - DNA, 761 bp, Gossypium hirsutum
cgaccatgttgcttaaagcttcccctgctttttctttgttgaagaatccccaagttgaaactcgggttcctctgttttcaagaaacggttctgggtttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtatgcctattttgatagggacaacgttgctctcaagggtcttgccaagttcttcaaggaatcaagtttagaagagagagagcatgctgagaaattgatggaataccagaacaaaagaggtggacaagtgaagctgcaatccatattgatgcccctctctgagtttgatcatgcagagaaaggggatgctttatatgcaatggagcttgccttgtctctcgagaaactaacaaacgaaaagctcttgaacttgcacaacgtggctgagcgaaaccacgattcgcagttgactgatttcattgaaggcgagttcttagctgagcaggtcgaatccatcaagaaaatatcggaatacgtggctcagctgagaagagttggcaaaggacatggggtgtggcactttgatcaaatgcttctccacgagggagctgttgcatgatga

SEQ ID NO: 358 - DNA, 931 bp, Gossypium hirsutum
aatcaaggagagtgctttgtgggtgaaaaaatgtatgcagaaacagggctgtttttcccttacatgcagaaattttctgaagattttcagcagttcatagattactgcaaatcccagaaacccaatgcttccacgaacaacctggttcagatttccacaatatccgagtatgaccttggaggagaaggtgatctgttcaaagctccagagccaatcattgaagaaccaaatctggggcttgatcccatgactgctgccatctcattaatctcatgtggtgaagatgtcattacttcccaaggacttaaggcagctgatattgaatcaatccaatatgagcaacttttagaggttctctatgagtgtgaaaaggatatgatggcaaaagcagctatggaaacaccactgtccgaggtccttgatatcaagattcctgttgtgaagatcaatgaaaaccaacatcttgaaaacaaagtgctctctgatatcccatttcagaaaagtgtcagctcgagttgcttaagctcaatggagtgggtgcaaggagctgtaatcaagcctaactttctggattttcctggaatggattttggttctgtttatggaatgaggagagcttttagtgaaggagatatacagactcttggcaatgggaatgggagcgtcatctgttctcctcttgagcgaccaataatgatcagctgctgttctactgaagatcgaagggaaaagctttccagatacaggaataagaagaccaagaggaactttggaaggataatcaagtacgcttgcaggaaggctcttgctgacagtcaaccaaggatccgtggaaggtttgcaaagactgaagaatctgacaactccaagaggcagtaattgttgactaattccaaagtaaaacaggaatgaagtagctagaccctagagg

SEQ ID NO: 359 - DNA, 923 bp, Gossypium hirsutum
ctaagttcctttgctgtgggagttctcgaaactcgaaccacataataaaaatggcgatgtgggtctttggatacggttctcttatttggaaagctgggtttaactatgatgatcgtcttgttggtttcatcaaggactatcgccgtgtattctatcaagggagtactgatcacagagggacgcctgagtatcctgggagaactgtcacattggagcctgctcctggggaagtctgttggggagctgcttacaagatatccaaggaggaagataaagaagctgcaataacgtatttagaagtgagggagaagcagtatgacaagaaagcttatgttgatctcttcaccgatcccttagctacaactccagccatttctggagtaatggtgtacatagcatctcctgacaagaagcttaatccgaactacttggggcctgcttctatagaagacattgccaagcaaattgttcgtgcggaaggcccctcgggaccaaacagagaatatcttttccaactagaaaaggctcttcttcagattggttgtaaagataaacacttaatggatcttgcaaacgaagcaaggcgcattctttcagaatccgagcatactgcatcatgatgcaaatttgttggaaaggaaaaatgagagaataaatcacaaacctaggaaaaagcatgaatggcattatagatgttagcatcatggaaattgcatgttcctccatgttttgctctggaccgggacacacaccgaaacatagtttcttatagtgtgggacacagtcaccccaattctacaaacaataacttcatccccacaagcaaacagtttctgaaagtgggcgttttccatatttttttccttcatttctaattcgggtatttttccctattaaacctgcttgttcttcgatgacgaaag

SEQ ID NO: 360 - DNA, 2001 bp, Gossypium hirsutum
cagcatgtgtctcatcgattctgggtaaatggcattctatcttactttgatagacttccagatggattttaccaagtcaatgggatggatccttatgcatggactataagtgctgatcaaggagagattggcctgatgccctccatcgagtcattgagggccattgatccgcatgctgatttgtctattactgttgttctgattgatagattaagggatcctagtttgaaggaacttcaaaattgggttctcaaaatatctagcagctggatcagcacaaaagatgcaattaatcagcttgcatgtcttgtctgtaaccgaatggggggtgcagcttcttctgaagaagatgtttatagccaatggaaggagtgcaccgaagttctgaaaaactgctcaggctctatcgtatttccaattggaagcctatctgttggcctttgcgtccatcgtgtgttactgtttaagatattagcagacttggttaatctaccatgtcgcatcacaaagggttgcaaatattgcaggagggaagatgcttcatcctgtcttgtgcagttgggtcctgacagggaatatttggttgatttgtttgaggagccaggagccttaagtcagcctgattcctcactcaatggtacttcatcaattttagtttcttcaccgctgtgtcatccaagatttaaaccggttgagattgctacaaacatcaagacattggccaaactctatttcattgatgatcaatcccataaacatgcttgccttgatgcttcctcagacaatgctagcaatcaaaatgagcaaactggtccacagcctaggaaagcatttgatagaaactactttaacaagaacaaccccttttccaccttaagcaacaacaaagaatcttctctttcacctctgcaccagagcactttgtggaatattggctgtgataaagatcttcagatgctgaactcttcaaaattgttcccaaaagccatcaactcaacacacttgatcagaagtcctcctctgccaagttctgttacttctcacatgcacaaagatgtttatcaagcttttccatactcagatccaatgcaatgtactattaacttcaagcaatcagatgatccagtaatgagctttgaccaggaagatctaaatattccttggagcgaacttgttttaaaagagagaattggagcaggttcttttggaactgttcatcgggctgaatttcgtggttgcgaagttgctgtcaaaattctcatggagcaagattttcatatagaacgcttcagggaatttttacgggaggtttccatcatgaaatgtttacggcaccctaacattgttctgtttatgggtgctgttactcaaccaccaaagttgtccattgttactgaatatttgtcaagacggagtctctttcgacttttgcagatgcctgatgcttggaaggttttaaatgagaagcttcgcttgaacatggcattggatgtggcaaggggaatgaattatcttcatcaacttaagcctcccattgttcatcgggacttgaaatccccaaatcttttggtagacagtaattatacggttaaagtctgtgattttggtctttcacgttctaaggcaaatacatttctttcatcgaaaacagctgccggaacaccggagtggatggcacctgaagttctatgcaatgagaattcaaatgagaaatccgatgtttatagctttggagtggttctgtgggaacttatgacactccagcaaccatggaagcatttaaacccaccacaggttgtggcggctgtaggtttcaaaggtgaaaggcttgagatcccaagccatgtaaaccgagttgtagcttccttgattgaacagtgttgggctcgtgaggcttctgaacgccctcccttctcccatgtcattcaatgtttgcagcaagtcatccaaaatactgcatctcaagaacttaatggactaagtctttgatccacaacatga

SEQ ID NO: 361 - DNA, 1198 bp, Gossypium hirsutum
aacgaaggttaaaggaaccacaccagccatgtctgcaacatctgcctcatctcttattctcccatcgctcaaacccaaagttctatctttatccgactcaactcccaattcactttccctcttctccctttctcctaccccccatgcaaagcctctcttctgttctgctcttccaagtttccagcttttaaccaaaaagtcctctttttcttccgggttcctgacaaacgttgctgtttcttctgagtatgaccaggaagaggacttatttggcagcgatgatgaagaaaggtctcctactttctcacctgacttgaaactttttgtgggtaatcttccttttactgtggatagtgcccagcttgcgggtttgtttgaaaacgccggaaatgttgagatggttgaggtgatttacgacaaggtaactaggagaagtaggggatttggatttgtaaccatgtgcacaatcgaggaagtcgaagctgctactcaacagttcaatggctatgaattggaagggagagcattgagggtaaactcaggacctcctcctcctcgtagggaagaattttctcctaggggagcaagaggtggtccttcaatgggagcaaggggtggtcctcctatgggagcttcaaatcgtgtctatgttggtaacctttcatggggtgttgatgatacagcactcgagaccttgttcagtgagcaaggcagggttgtggaagcgaaagtcgtttatgacagggaaagcggtagatcaaggggttttggctttgtaacttacagttctgccgatgaggtcaacagtgccattaaatccttgaatggttgtgatttggatggaagaccaattcgggtcactgtagcagagtctaggccaaggcgccaattttgagtgcggatatttcctactggtgctgctaaaattctttggggacgcctaagatatgcagccggaatctggcaactgcagtcttttcctgttcgtgggaatctgctcggctgcatttggacgttatggttgatctgactgctttttatactaggaaaagctgataatatccatttaaatgtttttattgtatgtttcaagtatcttatgattgggtgactgacaatgtagcctaatgtttcgcctcattggatatagttgcttcaaattattgacatgtttggctcccttgtacaaccttgtggt

SEQ ID NO: 362 - DNA, 1346 bp, Gossypium hirsutum
cgaggatgatttcttcctggagaaagagaagagctggtaagcgtgcggggaaagagcaggcaaggaatgaaaatggtgaaatggagctttcgattcctagagatttcaggtgtccgatatcgttggacttgatgaaagaccccgtcacgttatcttcaggtataacgtatgatcgacccaacatcgagaaatggatcgaagccgggaatttcacttgtcctcttaccaatcgagtgttaaggagtctcgaacccatccccaaccacatcataaggaaaaaaatccaagattggtgcgtcgagaatcgatcccacgggatcgaaagaatccccacgcctcgtgttcctgttagttccatggaggtttcagagattctttcgaaaatcgacgtcgcttgtaagaagcaagatgggtcacggtgcctagatttggtggcgaaggtcaagtcattggccaaagagagtgaacgtaacaagcggtgcattgtgagtaatgggacaggcaatgttttatcggaagcgttcgcggcgttttccatggcggctttcgacgaaaacgtctcggtcttggaggagatattatcggctcttgtaataatgttccctctcgatggtgaggccaagggtttcttaggatcagcttcagccatgcattgtttgataaggtttttaagcagcggagacttgtctaggagacgaaatgcagttttggccttgaaggagctcgtttcatcaatggaagatcaaagaaaaatactgaatcagttatcagagatggaaggcgccattgaagcattattgaagcttatcaaaagcccaatttgctcaacatcaacaaaagcatcgttaaccatcatttaccatatgatcacatcctatggtaacgaaaaacaagtgggtaataaacttgtaaacctaggcatagtcccattgctgctagaaatgctcgtggacgccgaaaggggaatgtgcgagaaagccttgggtgtcctagatggaatcttcgacaccgaacaaggcagagaaatggcctgcaagaatgccttgacgatgccggttttggtcaagaaaatcctcagggtttcaaccatggccaccgagttttctgtctccattttatggaagctttgcaagaacgagaaaaaggaagatggtggagtccttattgaagcactccaagtgggggcttttcaaaagctgttgctgctattacagcttggttgtgtggagaagacaaaggacagagtttcagacttgttgaaaatgttaaacccttacaggagcaaaatagaatgtgttgatcccatagaccatttcaagggtctcaaaaggcctttttaaggataa

SEQ ID NO: 363 - DNA, 2039 bp, Gossypium hirsutum
ggaccatggcagtgacagtctctctttctgtctcccaccttcccggctgcaaagttcatgatttctctcatctccccaaaccaactaacaaagacaacccatcttctaaagcctcctctgacatcaaattaagcaaaagaaacctgttgttgagttcaatggcttcgggtcttattggaagaggtgtcttcgttggtgagccggtaaaagctgaaccagagaccccaatggaaagctcatcaagtagactatcgtattcaaggtttctgcagtacttggatgaaggtggggtgaaaaaggtggacttgtttgagaatgggactgtggccattgctgagatatataatcctgcattggagaaaattcagagggtaaaagttcagttgccgggattgccccaagaactgttgaggaaaatgaaggagaaaaacgtggacttcgccgctcatcctatggagatgaactggtcggctgctttattcgatttgttggggaatttggcttttcccttggtattgcttggcactttgttgctaaggagctcatctgttaataatcctggaggaggtcccaacttgcctttcggacttggaaggagcaaagccaaatttcagatggaacccaatacaggagttacatttaacgatgtagctggtattgatgaagccaagcaagattttcaagaggtagtggagttcttaaaaaccccagaaaaatttgcagcaattggtgccacaattcccaaaggagtgcttctaattggacctccagggactggtaagacattgctggccaaggccattgcaggggaagcaggggttcctttcttttccctttctggttcagagttcatcgagatgtttgttggcgttggagcttccagagttagggacctgtttaacaaggcaaaggctaattccccatgtttggtgttcatcgatgagattgatgctgttggaagacagagaggaactgggattggtggagggaatgatgaaagggagcaaactttgaatcagctgttgactgaaatggatggttttactggtaatactggagttattgtcattgctgccactaataggcctgaaattctggattctgctttgcttaggcctggaagatttgatagacaggtaactgttggattaccagatataagaggaagggaagaaatattgaaggtacacagcgacaacaagagactagataaggatgtttcactcagtgtaatcgccatgagaacaccgggattcagtggtgctgatttggcaaatctcatgaatgaagctgccattcttgctggtagaagaggcaaagacaagatcacgatgaaagagattgacgattcgatcgatcgaatccttgccggaatggaaggaacaaagatgacagatggaaagaacaagattctcgtggcgtaccatgaagttggccatgctgtatgcgcgacattgacaccaggccatgatccagttcaaaaagtgactttgatccctagagggcaagctcggggtctaacatggttcataccaattgaagattcagatctcatttcaaaacaacaactctttgctagagttgttggagggctcggcggtcgagcggccgaagaggtaatctttggtgagccagagattactactggtgcagcaggggacctgcaacaagtaactcaaatagccagacagatggtgacaaagtttgggatgtcggaaattggaccatgggcgttaactgatcctgcagtacaaagcagcgacgttgtgttaaggatgcttgcgaggaattccatgtctgagaaactcgctgaagacattgattcatcggttaagaaaataacggaaactgcatacgagattgcaaagaaccatataaggaataaccgtgaagccattgacaagctagtagaagttttgttagagaaagaaactcttacaggatatgagttcagagcaatcctgtcagaatttgttgatgaacctgtaataaaagtagatagaactcctgttcgtgagatgatcaacgcttgagtctga

SEQ ID NO: 364 - DNA, 1061 bp, Gossypium hirsutum
aaaagatgggtgaggagcagcagggaattcagattcccagaatcaaactgggaactgaaggacttgaggtttcaaagttggggtttggctgtatgggtctcactggaggttacagttgtccagtttctgaagaagttgggatatcgattatcaagcatgcattccacagaggaatcactttctttgatacatctgatatctatggacccaaaactaatgaaattttggttggaaaggcattgaagcagctaccaagagagaaggtacagctagccacaaaattcggtttcgaaaaactggattcaacaggtatcaaagtaaacggtacacctgaatatgtccgtgcctctatcgaggctagcctaaagcgcctagatgtggactatatagatctctactaccagcacagagttgacaccaacactcctatagaggatactatgtctgaactcaagaagttagtggaagaggggaaaattaagtacataggtttatctgaagctagccctgaaactataaagagagcacatgcggttcatcctataagtgctttccagacagagtggtcgctgtacactcgtgatatcgaggatgaaatagtccccctttgcagggaacttggaattgggatcgttccttatagccctcttggtcgcggtttctttggtggcaaaggagtggtggaaactgtgcctgcaaatagtcatctgctatatttcccaaggtttcaaggagaaaacttggacagaaacaagatgttgtatttgaaagtggagaagttggctgagaagcatggatgtagccctgcacaattagcacttgcctgggttcttcatcaaggggatgatgtagcaccgattcccggaacaacaaagataaaaaatctggatagtaacattgattcagtaaaagtaaagctcacagcagaagatttgaaagaaatttctgatgcggttccgataaatgaggtagcaggtgatgttttgcctgatagatttagtcaattacactggaagtttggtaatacaccaccaaaggggagcaaagtttcaacctgatga

SEQ ID NO: 365 - DNA, 991 bp, Gossypium hirsutum
cttctgttgttgtcttcaatggtactcttggtacaaaggcttagtaaattataccacaagctggaaaatcactaccaccaccaccaccaccaccaagcagaggttgatgctttgtcagcctctctacaggcttttcggtctgatgtttcgaattgtgcgaatcagttgttgcatccagaacctggttcagaaatcttgtctttttcatggattcagcgatgttttgagttacttcctgttatcaaccaggcgtttttgaagctggttggggatatagactaccccatgagctgctgggatgttgcttccctcgatgagtatcttaactacggcttgcatttattggagcttctcaactgtgttacttcttctctttctcacttggcacaggctcggctttcctttgctcatgctttgaaccttgtggagagttcaccttctacggcgattgaacatctcaaagcaatccagtcccaaagttcaagcaaggacttaaaggaactggtgagaaacaaggaaggtggtgagggaaaattgtcttcttgcaaggaaagggtagtccatgaagctttgatggaggtaaagagtgttgggttatgggtatttggggttgttttggctaccttgtctggagagaccaaaccatacttggagatcaaacaagtgattgtcaggttcaattctgctttgttaattgatgtagattcatgtgtttttaaggttatggtggagaaaggtgagacattaaaagaggttaaggagctgaacagtgcagcaaattccctagtatcagcaatcctttctgggaaaaccagtgatgcagccatggatttcggtggaaagttaggtgttttcgagaaggagatggatgctttagaaaagcaagtggatgccctgttttcgagtgtattggcagccagaaatgaactgcttaacggtgtttggcaacgcaagcaataacatcaaaatccccagtttcttatgtaaatag

SEQ ID NO: 366 - DNA, 2207 bp, Gossypium hirsutum
tcttctcaacaggttctgatgcattcaagctttcaaggactatacttggtctgcgtttttctagcgttttctattgttgggttttgcgttttggggttaaaggcttttgagaaacgttttttctttcaagttcaatcatgcctgctcttgttaattacagtggtgatgatgatttctataatggagggtccttttatacaaattctactgacttgggtagattgtgttcaatcagtttccaagttgatgtgtactgcccgcctcgtaaaagaacgcgtattagtgccccatttcactttggagaagctgaggttgagcagaataagcaaccatcgatcgatgtcctccctgatgaatgccttgttgagatctttaaacgcatttctgggggtaaagaaaggagctcctgtgcttgtgtctctaagcactggcttatgcttctgaccagcattcgcaagggtgaatatgagtcatcaaaggtggtcaaggagaacgttggttcgaattcgggtgatgttgagatgatcttatccgaggaagatgatgggtatcttacaaggtgcttagaaggaaagaaagcaactgacatgaggcttgctgcggtggcggttggaacaagtggtcatggtggtttaggaaagctttctattaggggaagcagctcttcacgtggagtaactaatttcgggctgtctgccgtagctcgtggttgtccttctctaaaggtactttctttgtggaatgttccgcgtgttggagatgaaggtctgtgcgagatagctaaagaatgccatttgttggagaagcttgatctttgtcagtgcccccacctttcaaacaaggggctaattgccatcgccgccaactgccctaatctgactgcgttgagcatccaatcttgcccaaagattggtaatgagggcctccaagctatcggaaagctttgccccaagctgcagtccatctctatcaaggactgcccacttgttggggatcatggagtttcaagcctgttgtcatcagcatcttccgtcctttcaaaggttaagcttcagggtttgagcatcacagatttttctcttgctgtgatcgggcactatggcaagtctgtgactaatctaatgctgagtggtctacaaaatgtgagcgagaagggattttgggtgatgggtaatgctcagggtctgcaaaagttggtctcttttacaattgcttcttgctggggagtaactgatgtgagtcttgaagccattggaaagggctgcgctaacctgaagcagatgtgccttcgcaggtgttgctttgtttctggtgatggattggtggcttttgccaagtctgccggttctcttgagtgcttgcagttggaggagtgcaacagggtcactcaatccggggttatcggtgttctctcaaactgtgggttgaaatctcttaccctagtaaagtgtatgggaattaaggatatatccttggaagctcctttgtcttcctcttgcaattcccttaaatccttgtctataaggaactgcccaggattcggaacagccagcctggctatggtgggcagattgtgccctcagcttcagcatgtagacctgagcggactttgcggcattacagatgcaggtcttctgcctcttctagagaattgcgaggcaggacttgtgaaagtgaatctgagcggctgcttaaacttgactgatgaggtcgttttgcacttgaccaagctacatggcgcaaccctcgagttgctcaatctcaacggttgcagaaggattactgatgcaagtttggctgcagttgcagaaaattgtgttttcctcagcgacttggatgtgtcaaggtgtgcaatcaccgatgtcggtattgcagccttgtctcacgcagagcaactcaacttgcaagtcctttcgttttcaggttgttcaggagtatcaaacaaaagcatgaccttcctaaaaaaattgggcaagaccctggtggggttgaatctccagcactgcaattcaatcagcacccaaaccattgagctgctcgtggaaagcttgtggagatgcgacatccttgtctaatcgggggtcgagccactgaacaactacacttctggcgttaaagacagtagaaatatcaatctcgtatagtcatctcccacgggtagcaaaaatatttggcacagtttttcggttcaactaagtagccatgcg

SEQ ID NO: 367 - DNA, 1625 bp, Gossypium hirsutum
ccttcacttcagctcaaagaaccaagtatggctgcagagtatagagagcccctgttaaagaagaagtactataagaactgccctggatgtaaggttgatgaaatgaaggaattggagcaaggcctcccaattcggccactgctttccatatggattattgtcttatgcactgctctgccgatatcatctctctttcctttcctatacttcatgataagggactttcatattgctgaaagagaggaagatattggctcctatgctggttatgtgggatctgcatttatgcttggaagagctttaacatccgtatcatggggaatatttgccgatcgttatggtcgaaagcctgtaataattatgggaactacttcagtggttattttcaacacccttttcggccttagtgtaaatttttggatggctgtaattacaagatttcttcttggaagtttgaatggcttacttgggccaataaaggcatatgcagtcgaaatttttcgagacgaataccaagcattaggcctatcaaccgttagcacagcttggggcataggattgatcattggccctgctctgggaggttttctagctcagccagctgagaagtatccaaatctcttttccaaagattcattgtttggaagatttccatatttcttaccatgcttggccatatcaatttttgccttggcagtaaccattgctacttgctggcttccggaaacacttcataaacacaatgacaatgatcaatcatctgatgattcatacgatgctttggaagctgcatctaatgaatctaacacaaaagatataacagaaaaggaggaaggaagagaatccacttctaagcaaagcctcctaaagaattggcctttaatgtcatctatcattgtctattgtgttttctcccttcatgatatggcctacacagagatattttctctatgggctgttagccctagaaagtatggaggcttgagttattcgacggagcaagtcggggaagttcttgcagtctcaggtttcagccttcttgtctttcaaatgtccctatatccatatgtagagaggcttcttggacctgtaatggtgtctcggattggaagtgtcttagccatacctctcttgcaaagttatcctttgacagccatgttatctggcttcactcttaccttggtaataaactgtgcatcagtcctcaagaatgttctatcagtatcaatcataaccggattattcattctgcaaaatcgagctgtggaccagcaccaaagaggagctgctaatggcattgccatgactggaatgtctcttttcaaagcagttggtcctgcaggaggtggtgcattgttttcttggtcggaaaagcgcctagacgcttcatttctgccaggtactcagatggtatttttcgtcttgaatatagttgaggcagttggatttttgttgacattcgaaccatttctagctcaacataggcaataaaacaagggttcccaaaggttgggataatgatcttttattttattttaagaatgcaaaaaaagaagagaatactccaaaggcttaaatcttggtcaacaaagtatccagacaccagctatgtcactcgggttctt

SEQ ID NO: 368 - DNA, 3787 bp, Gossypium hirsutum
aatacgagagtgaaagcaatgaaatcaactgcagaagccgccgttgccgagaatggccggtttttgggaagcatttcgacttcttcgcttcgaaatctgcttcctaaatcaaaacttaagaaaagcatcaagaaatccaactctgaaaacactcctccaccagatcccaacattattcaaataaataattctgctcagttttcccccaaatctccactctccaaatcgcttacttctgactccttcgtgaacccatctgacgctcatccccaaattccgctttctatggactcttccgtcaagaaagatatggttgaatccgaagaacaaaatggagatttgacgaatttagatccatccgtcaaggtggtagtgagaattagacccataaatggtcaagaaaaagaagtggatcgaacagtgacgaaggtttcttcagattctttatcagtcggtggccgcaaattcacattcgattctgttcttgatgcaaattccagtcaggagaatgtctttcaactaattggtgttcctttggttaaaaatgcattagctggttacaacacttcagttttgtcgtatggacagactggaagtggaaagacttatacaatgtggggtccaccaagcgccatggttgaggacccttcacctgcgagccaccaggggattgttcctcgtatcttccaaatgctgttctctgagattcaaagggaacaagagaactctgatgggagacagacaaattatcagtgtcgttgctcctttcttgagatttacaatgagcaaattggggatttactcgatccaactcaaaggaaccttgagataaaggacgatccaaagaatggattgtacgttgagaatttgacagaagaatatgtttctagctatgaggatgtaactcaagttttgattaaggggctttcaagtaggaaggttggagcaactactgtaaattccaagagctctcggtctcacattgtttttacttttttcattgaatcttggtgcaagggagcttcatcaaaatgtttcagcagttcaaaaacaagcagaatcagcctgattgaccttgcaggattggatagaaacaaacttgaagatgttggtagacaacatttacaggaaggcaaaaatgtcaagaagtccttatcacaacttgggtatttggtgaacactcttgcaaaagaaactcaacctgaaaaacctgaagatgttccatatgggggttcctgtttaacacgtatattgagagaatcccttggtggcaatgccaaactcacagttatgtgcaatatttctgcagacaacagaaatacaagtgaaatactgagcactcttagatttgggcaaagggttaaagctgtcagaaacgagccagtaataaatgaaatatctgaagatgatgtaaatggcttgagtgatcagattcgtcaactgaaggaagagcttataagagcaaagtctgatgcatatagctcagttgggagtaaaagtggatattttaaagggtggaatgcacgtgaaagcttgaaccagttaagaataagccttaaccgctctctgatccttccacgcatagataacgaatacgaggaagagattaatattggcgaggatgatgtaaaggaactacgtcagcagctagattatttagatagctcttgtgagacaaacttaagagatccattggacaagagaggttccattcaatcttctgtaaaagaaagttgtgagacagacttgctgagtgaatatgacattcattgctcaaaggaaacagagatagaagaaattgatgaagtggaagttcctcccatgtccagtcctgagccagctgatgacctttcagttacatcaaaaactttgaaggctgttgatccttcaattagaaatagcatctccatcagcccacatcgtcggtcttcaatccttgaagagcctacattgtctgaatctcccaaaattgcaaataatctaaggaaaagcatggctgttccgtcagcacttttggccagtcagaaaaatgtatcagagagttcagagtcagaggtattacgagagttgctcaaatatagtgaccacatcaggtcctcattacgtacaagcaagacgtttttaggacctacagagtctttggctgcaagccttcaaaggggccggcagattattgatcaacaccagcatagttcagttcccaacagatcttcagttgccttctctttcgaacacctgatgctgaaaccttctccagaagcagacaaggccaatgcttctgttcaaacattaccaaatgacaaaccatctccggatggttcttctactcctttgttttgttcatcttgccaaaggaagtttgacaataaccaccctgatgaggttcaggatagcttgaagacatggattgtaacggttgataaccaacagagagatggcaggaacacagtggaagaagcctccaaaaaagagaaaacacttgaaagtgtttgtaaggagcaagcagccaaaattgagcagttaacccagctggtgaaaaaatacaaacttgaaagagaaaattctgcaattgaacatgctcctgagcctctgaagaatgaaataatactgtttgatgagcagtccaacaatggtgaaaatggaaaagaatattttgatatgactgaaaaggaagcacttcttcaggagattcagacattgaaaagtaaattgcagtcatatactgcttctccatctccaaacaagtctactgaaatactgaggtcctctttgttgtcacgttccattcaattgcgaaaaagtgtagactgtcgtaataacagcgaggaagaacttgagcgagaaagacaaagatggatggaaatggaaagtgactggatatccctgaccgatgagctcaggatggatctggaatctaaccgctgccgtgccgaaaaagtagagatggaactgaaattagagaagaagtgcaccgaggagttagatgatgctcttagcagagctgtcctcggtcatgctagaatggttgaacactatgctgatcttcaagaaaaatacaatgatctggtttcgaagcaccgggcgataatggaaggcatagcagagataaagaaggcagcagcaaaggcaggaagcaaaggtcatggtgcacgttttgccaaatccctggcggctgagctctcagctattagagtggaaagggaaagggagaaagaacaattgaaaaaagagaacagaagtctcagaatccagctaagagacacagcagaggcagttcatgctgctggagaactcctagttaggctgagagaagctgagcaagctgcctcaattgctgaggagaactttagtaatgttcagcaagagaatgaaaagttgaaaaagcaagcggataagttgaaaagaaaacacaagatggaaatggtgaccatgaaacagtaccttgcagagagcagattgccagaatctgcactacaaccattataccgagaggattcagatgtagcagcatcacacaacagcagtgcaattccatatgatgatcaggcttggagagcagaattcggagcaatatatcaagaacattactaattcatctaaaacaaatctgaccttactttggtcagaatgaagatatgtatacctatgttgtttgattgtcggatacgaatatgtatcttacacaatttaattcttttaaaatgtttttttttttgtgtgtaaaagttacaagtcaatcttatacccatatccggatatatgtatgttggacatgggttagagcaag

SEQ ID NO: 369 - DNA, 1091 bp, Gossypium hirsutum
cccaatcaacgctgcaatacttttcacacctcaaattttatttgaagcaaaaacaaatcccaaataacacaagctttgtttttgttttgatttctctgttaattagcaatgaataccagcagcaaagaatcgcagcctaattaccccactatctcacctgatgaatataccaaccctttccatcaacagccgcacatggaacctgcagcggccaccgcggcggcacccgcatcaacatcttcgtcgcctcctcctccacctcctccggaacagtctgagaaatgggggactcatatcatgggaacaccagctgttcccacatgtcatccagacaacaagaaagcagccttgtggggtgctggtgaccaagctcaatactaccatcatccatacctccaatattcccccgtcgagagatcaagcaataaccccatggattccatgcttcaagtcttcaacacctggagtcacaaagctgagaccatggccaataatatctggcacaatcttaaaacaggaccatctgtatcgggagctgcatgggggaagatgaacgtgacagccaaagcaatatcaggaggtggattcgaatcgctttataagcaaacattcgcaacgtattcaaacgagaagctgaagaaatcattcgcatgctatttatcgacttcgacaggaccagttgcgggaacactttacctatccaatatccatgtagctttctgtagtgatcgccctttgtcattcacagcaccatcagggcaggaaacatggagctattacaagataatgataccactgagcaaagtagggataataaacccagtgataatgagggagaatccatcagagaaatatatacagattgtgacagtggatggacatgatttctggtacatgggatttgtgaattatgagaaagcgtcaaagcatctgtctgagagtgtttccagttctgtagcaactgggattgctgttcaaccttcacctgttgcatcgtaaacacaggattttattatatttttcttttcatatttacaggcctttgcttttgtttggagatttgggttcggcttgtcttagatttattctag

SEQ ID NO: 370 - DNA, 623 bp, Gossypium hirsutum
agtacatggggatcataaaactcagacaccaattatcatcttccatggaatcccagaatctcaaacaccgttccagggatgaccctcgttttgccaccaccacctccaacgaaaagaacagagcaaacaggcgagaaaaaagaatggcaatggccaaacgtgggctaagatcactagtcatagcagtttccttccctttgtctctcaccttgttaaacatatacttgtttggttcaggtcgtggttacgcctctttagccaaacctttctggttccctcctttgtggcttttacatacaggttgcttggcttcgagcttcgtgatggggctgtcggcttggtttgtttgggttgaaggtgggttccacgttaaaccgacggctttgtctctttatttgggttacttaggattgagtatggcttggcatccgactgtgctttggatgggagctagctgggctgggttgcttgtgagtttggcgatggttgggaccttggtcgggtgttcaagagattttggaaaggtgaatccgattgctggtaactcggttatgccttgtttggcttgggctgcgtttttggccactgtaaatctaaaacttgtcttcctttgaagcatatga

SEQ ID NO: 371 - DNA, 735 bp, Gossypium hirsutum
tctcttcttgtctccaacatcgatttgaaaaatgagcgccgtggccgacacacttacccattggattaatttcccagaaaacatcgagaaattaatgttcccttcacggactcacgaaagccgcgataacgagaacaagggattcagtagcataccggccgacattttggacactcccaaggagttcattttctacttagatgttccaggcttgtccaagtcggatatccaggttactgttgaagatgagaatacgttggtgataaaaagcggtgggaagaggaaacgagaggagtttgaagaggaagggtgtaaatatataagactggagaggaaggcaccccagaagctgatgaggaagttccggttgccggagaacgccaatgtgtcagccattacggctaaatgtgaaaatggggttttgactgtggttgtcgagaagcttcccccgccaccaaagcccaaaactgttgaagttgcgattgcttaaaaggttctagttgttggggggaagggggggggggatagataggttaagttatagagggctttcaagtttctcaactttgggaactgaaggagtcaaacaatggttgatgtatttaggtgtggttcttctgtatgtatttttatttgcagtgtaatttaattgggtggatttgctcctcctcagtctacggtctttccttctaattttgcaattcctgtagtttgtctggcactaaagggttgcta

SEQ ID NO: 372 - DNA, 251 bp, Gossypium hirsutum
agttctcaactctctcaaattcaccatggctgacaagtgcggcaactgcgattgctctgacaaaagccagtgcgtgaagaaaggaaacagcttggtcattgagactcaggagagctacatcagcactgtagtggccaagcctctggcagagaacgatggcaagtgcaagtgcggaactagctgcagctgcacaaactgcacatgtggcagtcactaagcagacatatagaatgatgaagtttgggacctaa

SEQ ID NO: 373 - DNA, 2030 bp, Gossypium hirsutum
cagcaaccatctaccatccatcttctcattctactctttacctaccaagatcaagaaacctcaacaatcaacaactaccaactagatttggattaagtcacccaaaaccaatcaaccaaccaagcaaccgagaagcaaaaagaatggactctgattatggcattcccagagaactttctgatcttcagaaactccgatctcaataccaaccacagctccctccttgcctcgagggaactactgtcagggttgagtttggtgataccactacatctttagacccggctgatgctcataccatagcccgagcttttcctcacacttatggcaagcccttggctcactttctcagggcagctgccaaagtacctgatgctcagattataactgagcatccagctattagggttggacttgtcttttgtgggagacaatcccctggtggccataacgtcgtatggggcctccacaaagctctcaaaatccacaaccctaatagcactttgctgggctttttgggtggtactcaaggtttatttgcccaaaaaacactagagatcactgatgatattctttcaacctacaaaaatcagggtggttatgatctcttaggacgaacacaagatcaaattagaacaactgagcaagttaaggctgcactagctgcctgcaatgatttgaaattggatggccttgtaattattggaggtgtaacatcaaacacagatgctgctcaacttgctgaaacatttgctgaagctaaatgtcctacaaaggtggttggtgttcctgttacactgaatggagacctcaagaatcaatttgttgaaaccaatgttggttttgatactatatgcaaggtcaattcccaactcatcagtaatgtctgcactgatgctctctctgcagagaagtactattattttatccgtcttatgggaaggaaggcatcacatgttgccctggaatgcaccctccaatctcatcccaatatggtaattcttggtgaagaagtggctgcatcaaagcttacactttttgacataacaaagcaaatttgtgatgcagttcaagctagggccgagcaagacaagaaccatggggtcatcctcctgcctgaagggcttatagagagcattcctgaagtgtatgcgctattgaaggaaattcacagtttgctcaggcaaaatgtatctgctgataaaatttcttcccaattatcaccttgggcatctgctttgtttgaatttttgccacatttcataaggaaacagcttcttctccaacctgagtcagacgattctgcacagctatcacagattgagacagagaaactactggcgcaccttgtagagaatgaaattaataagcgcctgaaagcaggcacttacaaggggaagaaattcaatgctatttgccacttctttggctatcaagctcgtggatccttaccatcaaaatttgattgtgactatgcctatgttcttggacatatctgctatcatgttcttgcagctggtctaaatggttatatggcaactataaccaacctaaagaatcctgtgaacaagtggcgttgtggtgctgcacctcttccagcaatgatgactgtgaagcgctggtctcaaaatcccaatgccgcgtcaattggaaaacctgctattcatccagctactgtagatttgaaaggcaaagcatatgagatgctgagacaaaatgcaacaaggtttttgctggatgatatctacagaaatcctggacccctccagtttgatggtccaggtgctgatgctaaggctgtgacattatgtgttgaagatcaggattacatgggccgcatcaagaaactgcaggaataccttgacaaggtccgtaccattgtgaagcctgggtgttctcaggaagttctgaaagctgctttaagtgtaatggcttctgtgacagaggttctgtcagtgatgtcttcatcgtcatctggcggacaagccctttgagaagaaagcagtgattgtaatggtgctctcgtttag

SEQ ID NO: 374 - DNA, 1276 bp, Gossypium hirsutum
tgtggttctagttcttgttatggcggagatctgttacggagttgtgagcgaaggcgaagcatcaataccgtgcgagccgagttcacgtgcagcaaggaggcgtaggatggagattagacgaattaaaatcgtcgacgtggctccatctgaagctgacaacggccggaaacgcaagaacctgcaagcttacggagcatcattttctctggactgtgaaaacgctgtagaaaattgtgcctccgatgaggacggaaaaaagcgaactgttaaacctaaaaatggaagactaaaaacgaaaggaacaataatgaaaagtaactcgagtccctcgcttttgatacctgaaatcgattcagagttacatcctaaattcggtgtcgcttcggtttgtggtaggagaagagacatggaagacgccgtcgctattcatccgtctttccatcgtcaaggccaggactctgccgccattggcttccactattttggcgtctatgatggtcacggttgctctcatgtggcgatgaggtgcagagagcgtttacatgagctggtgaaagaagagttggccagtgaggaggaatggaaaggtgctatggagcgtagcttcacgcgcatggataaggaagtgataaagtggaacgagagcgtggatggtgctaattgccgatgcgagttacagtcacccgagtgtgatacggttggatctacagctgttgtcgctatcgtaacgcctgataaagttgttgttgctaactgtggtgattcgagagctgttttgtgtcgtaacggcaggcctgttcctttatcgtccgatcataagccggatcgtccggatgagctgaaccggatccaagaagcgggaggtcgggtcattttctgggatggtcctcgagttctgggagtcctcgcgatgtcaagagccataggtgataactacttgaaaccctacgtgagctgtgagccggaggttacagtaacggatcgaacggcagaggacgaatgtttgattctggcgagtgacggtttatgggacgtggtatcaaatgatactgcatgcggggtggcgcgcatgtgtttgaggggaaagtgtgatgtacaggcgccgctattgtcaccggaaggagaggcggttgtagggtcgatgatgggaggaggagagatcccggacaaggcgtgcgctgatgcgtccatgttgttgacaaagctggcgttggccaggcatagtacggacaatgttagcgtagtcgtggtggatctaaggagagccacgtaatag

SEQ ID NO: 375 - DNA, 1116 bp, Gossypium hirsutum
gtcccttcattcagaaacttcccttttgtctcatcttcttcaccaaaaacccttcatatttttggccttaaatgggtgccaacatatctggtggtggttcaattgacggcgatgcaaccggtcctccattaaggccaagactcgatgacataccagagagctgcgccgccttaattttagcaaggttaaacccaccggagatttgtaacttggcacgtttgaacaggtcttttcgtagtgcttcattggctgatttcatatgggaatcgaaattgccatcaaattataagttgattgtggaaaaattgtttgttgaagaagatagagatttgatgaatttgaagaagaaagatgtttatgctaggttgaccaagcctatcccttttgatggtggcacaaaggagatatggttagataagaacacaggtggggtttgtttatcaatgtcttctaaggcgttgacaattacagggattgatgatcggagatattggaaccatatttccaccgaggaatctagctatcgaacagtagcctacctccaacaaacatggtggttcgaagccgacggagagctcgagtttcaattccccgccgggacatattccctattctttagactccacctcgggaaatcctcaaaaagactcggccgtcgggtttgcaacaccgagcacgtccacggatgggacataaaaccggtccaattccaactaacaacttcggacggccaacatgtcttatctcggtgttatttagacaatccagggagttgggttctctaccatgtcggagatttcatagttgagaactctaatgcgttgacaaacatcaaattttcatcgactcaaattgattgcactcatacaaaaggaggcctttgtgttgatgctgcatttatataccccagtagtgctagaaaacaggttaaattgtgttcatgagaaaattaagaggtctaaaactgtaaatacggtaaatctaggttgttttttgatagctctagatgttgtggttattattattttactcaaataataacaaattttgctgcaatgattattttttttgttttgtaatgttacaataggaacttgaaactatgttgttaattgg

SEQ ID NO: 376 - DNA, 1933 bp, Gossypium hirsutum
tctgattgtatttctccagcagcgcactgtagcaccaaatttccttctagatttgttgtggtggttagatttcaagatggtgtccgacgcaagcaagaagaaggctgctcagaagaaggctgctgccgctgcaaagagaggagggaaggccgctgcatcttccaaggcggcagctgcagcgaccgcggagaacggcgttgataatgcttctgataaagttagcatgctccagatatccgatcggacctgtactggtgttctctgctcgcatcctctttccagagatattcgtatagagtccttatcagttactttccacggacatgatcttattgttgattcaacattggagcttaattatggcagacgctatggtttgctaggattaaatggttgtgggaaatccacgctgcttactgcaatagggttgcgtgaacttccaattccagagcacatggatatctatcacctgacgagggagattgaagcttcagatatgtctgcattgcaggctgtcataagttgtgatgaagagaggttgaagttggagaaagaagcagaaatcttggcagcacaggatgatggtggtggagagacacttgaacgtatctatgagcgattggatgccttggatgcatcaactgctgagaaacgtgctgctgaaattttatttggcctcggtttcaacaagatgatgcaggcaaagaaaacccgagatttctctggtggttggagaatgaggattgcattggcacgggctctattcatgaatcccaccattcttttgcttgatgagccaaccaatcatttagatttagaagcttgtgtctggttggaagaaaatttgaagagatttgatcgtatccttgttgtggtatcacattcccaggatttcctgaacggagtttgtacgaacattatccatatgcaaaacaaaaaacttaagttgtacactggcaattacgatcagtatgttcaaactcgttctgaattggaagagaaccagatgaaacaatacaagtgggagcaggaacagattgcttcaatgaaggagtacattgctcgcttcggtcacgggtcagccaaactagcccggcaggcacagagtaaggagaagacattggcaaagatggagcgaggtggactcacggagaaggtagtcagggacaaggttctggtgtttcgatttgttgatgtcggaaaacttcctccaccggtactgcagtttgtggaagttactttcggatacacgcctgagaatctgatctacaagaacttggactttggggtagacttggactcaaggatagcattagtaggacctaatggtgcagggaagagtacactgctgaaactgatgacaggtgaattgactcctattgatggaatggtccgacggcataaccatctgcgaattgcgcaattccatcagcacttggcagagaaactggatatggaaatgtcagctctccagtacatgataagagaataccctggaaatgaggaagagaagatgagaggtgcaatcgggaagtttggattgtcagggaaagcgcaagtgatgccaatgaagaacctatccgatggacagaggagtcgagtcatcttcgcgtggttagcatttcgacaaccccacttgctgctgctagatgagcccactaaccatttggatatcgagacgatcgattcactggcggaagcattgaacgagtgggacggtgggttggtactggtgagtcacgatttccggctgataaaccaggtagccgaggagatatgggtgtgtgaaaatcaagctgcaacacgatgggaaggggacatcatggacttcaagcagcatctcaagagtaaagctggtttatctgattgaaacaaagtagtaattagcatataactttaaagcagaggtaacgaggaaaggctttgttattgt

SEQ ID NO: 377 - DNA, 1516 bp, Zea mays
tcacagatacacaccacgctaagccaaatcgagcaacgcctatcatcatattataatttcccctcattcatctcacagtcccaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtgcatacaagatatccaagggtttgcttgacaagtatggccccgatagggttctcgatactccgatcactgaggcgggcttcactggcattggtgttggtgccgcttaccatggtcttcgacctattgtagagttcatgacatttaacttttcgatgcaggcaattgatcacataattaattcagctgccaagtcgaactacatgtctgctgggcagatatctgttcctattgtctttaggggtccaaatggtgctgctgctggagttggtgcccaacactcacagtgctatgcagcttggtatgcacatgttcccggattgaaagttctagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatactggccaaggaaggtatcagtgccgaggtaatcaatcttcgctcaattagaccgctggatagagctactattaatgcatctgtgaggaaaaccaatagattggtaaccgtagaagaaggcttccctcaacatgggattggtgcggaaatatgcatgtctgttgtagaggacagctttgagtatcttgatgcaccagtcgagaggattgctggagctgatgtgcccatgccgtacgctgccaaccttgagaggatggctgttccacaggtcgatgacatcgtccgggcagccaagcgtgcttgctacagggcagcagtaccgatggcagcaaccgcctagtccagcagaaccctgcatgttgcatttctttgtctaattttaatgtccgtgctgcagaaagacgtgtcacataatggtgtgacgagtacccactgccgctgcaactcaactatagcatgagctgagtttttgtagagccaccgagaggtgttcagtactccagttccagttccgcttatcttcgccgccgcagccggaaggctgcgcatgactctgcgtctgttttatggttcacgaatgattgcagat

SEQ ID NO: 378 - DNA, 1874 bp, Zea mays
gtactgctactgctagctccaggccgccagaggcgacaggccaatgggtttccgcggtggtttgaggccgcccgtgacgcgcgtctgcttcgtcctcctgtgcctgtgcgcctcgttgtccgaagccaagaggacgccgcagcctgcgcctactacgggcaagaagcagcagccaccggcagcgtcgtcgtcccagcagagcccagcggtctcgtatccggctctccccgtccgggcggtgtgcctcggcggttggctcgtcaccgagggctggattctgccctccctcttcgacggcatccccaacaaagacctcctggatggcacgcagctgcagttcaagtcggcgctgcggaagacgtacctgaccgcggacaacggcggcggcggcgccgtcgtggccaaccgcacgcaggcctccgactgggagacgttcaagctgtggaggctgaacgacacgacgttcaacttccgcacgtccggcaaccagttcgtgggcatcggcgccagcgacggcatcatcgtcgcgacggccaccacgccgggcctgccggagacgttccagatagtgcggtgccccttcgacaagaacagggtccggatcaaggcggcgaacggctacttcgtccaggcgatagcgaccggcgaagtgatagcggactacggcgagcccacgcggtggtccgacttcgacgcgtcagtgttcctgatgaccaccgtcgggcagcagctgcaaggggagtaccagctctgcaacggctacggcgccgacaaggccgcgccgctgctgagggagcattggagcacgtacatagtggaggacgacttcaagttctttgcgtcgagtgggctgaccgcagtgaggatccccgtcggatggtggatcgccagcgaccccagcccgcccgctccgtacgtcggaggctccctccaagccctggacaacgccttcagatgggcagagaagcacgagctgggtgtcatcgtcgacctgcacgcagctcccgggtcgcagaacccctgggagcacagctcgtcccgagacggcacgcaggagtggggaaccacggacgccagcatcgcgcagacggtgcaggtcatagatttcctcgcgtccaggtacgcgacgagcccgaggctgctggcggtggagctgctgaacgagccgctggcgcctggagcgaccctggacagcctcaccaggtactaccgcgacgggtacgccgccgtccggaagcacgcgccggcggcctacgtggtcatgtccaaccgcctgtcgtcggggaactccacggagctcctctggttcgccggccgtgggttcccgggcgccgtcgtcgacgtgcattactacaccgtcttcaacagcttgttcggtaacttcaccgcgcagcagaacatcgacttcgtccggactaacttctccggcgagctcgccgccgtcaccacccgagatggcccgctcaccttcgtcggcgagtgggttgcggagtggaaggtgccgaacgcgaccaaggaggaataccagaagtacgcagcggcgcagatgaacgtgtatggacaggccacgtttgggtgggcctattggacggccaagaatgccaacaaccattgggatctcgagtggatgattagaaatggatacatctcgttgaaaggctaggacccaagccaacaggtttcagtctatataaaactctaatctctattggtagtacgtaggaacccgggcgagccagagatatttgctatatgtcgttgtaattaaattaaggccaagttcaatgaccttggcttcgtcagaacgaacccggccgggcgtactacttgtgccatgaacacttttgttggttgttgtgtgtacccgagcaaac

SEQ ID NO: 379 - DNA, 500 bp, Zea mays
agatggctctccattctccacagcacgcaggcagcacccagcaccacaccacagaccaaaacgaccaccgcacccgcagcagcgaagtgtccaagcggcggcatggcggagagcaaggcgcgtgtcgcgctgttcctggcggcgctcgcggcggcgagcctgctggcgctggccccggccggcgccgcgacgacgtgcgcgccgacgcagctgaccccgtgcgcgcccgccatcgtcgggaacgcggcgcccaccgcggcgtgctgcgccaggctcaaggcgcacccggcgacctgcttctgccagtacaagaggaaccccagcatgcagcgctacgtcaactcccccaacggcaagaaggtcttcgccgcctgtaaggtgtccctgcccaggtgctgatgctgagtgagtcgtctgccgccccatcaggtcgatgtcgatccatcctgctcgatcgatcgatcatgctactacttgagcacctttgggcagagtttagt

SEQ ID NO: 380 - DNA, 1165 bp, Zea mays
aggcaccaacaaagttaagtggggaggccagagctggccagctgggtcgctgttctaccagagggatggacgggagcgccggctccttcgtcgccgtccgccggctctctggctccgaccgcgccgccgccttccaccactcctcttcggcggaggtcgtgacggggtcgacggcgtggatcgggagggggctctcctgcgtctgcgcgcagaggagggacagcgatgcgcgcctttccttcgatttgacgcctgtgcaggaagaatgcctacagaggttacaaaaccgtatagaagttcagtatgatagtgcaaacagagagcatcaggaagcactacagtccctttggtgtgcttcttttcctggcaccgagcttcgggggctaatatcagaacagtggaaagagatgggttggcaagggaaagacccatctacagattttagaggtggaggcttcatctccttggagaatctattgtactttgctaggaactatccaaaatctttccaggaactccttcgcaagcagaatggtgaccgtgcaatctgggagtatccatttgctgtcgctggtgtgaatataaccttcatgctcattcagatgcttgatctccaatcagttaaaccgaggtcattgttcggagcagttttcctaaagcttctttcagaaaacgatcaagcttttgacattctctactgcataaccttcaagctgatggatcagcaatggcttgacatgcatgctacttacatggacttcaacacggtcatgaagtctacacggcgtcagctagaaagggagctgttaattgaagatattcagaggattgaggacatgccatcatacaggcttctggcccggtagctagaagaaactgaaaccttaacatggctacatattgcaaggcggcttgagatgctaatggatcgcaacttgtgtgtccacgtcgggcgacaatgttgaaatgtagatgacatgtatccttgtgtgttaggtacttgtggtctctggtaacctgatctctgaagattacaaggtagttttttttttcctggtgatagaatgccacgtagggtaactgaagtgtctgatcagctcccatggcaaaaaaaaaaaaaaaatgtagggtgtgttattacaatctggtcgttgtccatcatacc

SEQ ID NO: 381 - DNA, 1212 bp, Zea mays
gagagccctcgagataccatcagctagctagataaccagccagcgcgagcatggaggcggcggcggcggcggtcctgcaccggacggtggaggcgaacggcatctcgatgcacgtggcggagtccggccccgacggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcgtcggcgacgtcgtcgccctgctcgacgcgctcggcatccacaacaaggtgttcgtggtgggtcacgactggggcgccatcatcgcgtggtacctctgcctgttccggccggaccgggtggcggcgcttgtcaacaccagcgtcgccttcatgcgccacatcttcgtccgcgccgccgccgccgccgtcacgcccatcgactacttccaccgcacctacgggcccacctactacatctgccgcttccaggagcctggtgtcgcagagaaggagttctcgccggccaacgccgggtacctgatgaagcggatcctgtgcaaccgcttcacctcctcggcggccggcgacgacaagcgaccgccggcggacgccgccgaggaggagccgctgccgccgtggctgacggaggaggacgtgggccacttcgcgtcggagttcgagcggacgggcttcacggggcccatcaactactaccgcaacatggaccgcaactgggagctggcggcgccgtgggcggacgccaaggtgcgggtgcccaccaggttcatcgtcggcgacggcgacctcacctaccactacccgggcatccaggactacatccacaagggcgggttcgaggccgacgtcccggggctcgagagcgtcgtcgtcatccccggcgccggccacttcgtccagcaggagaaggccgacgaggtcagccagcacatctacgacttcatctccaagttctgatacatgtgcatggatcgaccatcagcttgcttgcttacctgctaaagcctgtaatctcaacctcgatatccgtgctgccaacttgttttgtttttcgaactaagagtaataagtgttcgcatatatgtctggtttaatttgtgacttggacatggtatgttcgatg

SEQ ID NO: 382 - DNA, 1334 bp, Zea mays
ccagcatgggcgggtacgagctcgtcaggagcgacgacgcggcgggcgccgcgggagccgacctcgagtccggctccggcgccagcaaggtcgccggcgccccgccgccctcgccggccccgtcggcgtcgcccgccgcgcggcagcagcgcctcgcctcgctcgacgtcttccgcggcataaccgtcctgcttatgatcatcgtcgacgacgctggaggcttcctcccggcgctgaaccactctccctgggacggcgtcacagtagctgatttcatcatgccgttcttccttttcatagtcggagtctcactaacactagcgtacaagcgggtgccggatagagtggaggcaactaggaaggcagtgcttcgtgccctcaagctgttctgccttggtcttgttctccaaggtggatttttccatggcgtccacagtctcacgtttggtgttgacctaacgaagattcggttgatgggcatacttcagaggattgcaatagcctatctcctagctgcagtatgtgaaatctggctcaagggagacgacgatgtagattctgggtatggtttgctgaggagataccgctaccaactgtttgtaggattggtcctctctatagcgtactctattcttctctacggcatgtacgttccagactgggagtaccagatagcaggccctggttccagttccacagagaagtcgttctctgtgaaatgcggagtgagaggagacaccggaccagcttgcaacgcagtcggaatggtcgaccgtacggtcctagggatcgaccacctctacagacggccagtttatgcgcgcacgaaggaatgcagtatagattatccagagaatgggcctctcccacctgacgctccgtcgtggtgccaggcgccatttgatcctgaaggcctcctcagctccgttatggcgattgtcacttgcttgatcggactccagtttgggcatgtaattatacatttcgagaagcacaggggaagaatcgccagttggttggtcccttccttcagcatgctagctctagccttcgtaatggacttcgtcggaatgcgaatgaataaaccactatacacgatgagctacactctggctactgctggcgctgcgggtcttctcttcgctggaatctatgctcttgtggatctgtacgggttcagaagacctaccatcgccatggagtggatggggaagcacgccctgatgatatacgtgctggtggcgtgcaacatccttcccatgttcatccgtggcttctattggagggaccccaacaacagccttctgaaagtcattggtatcggggcgtgatga

SEQ ID NO: 383 - DNA, 866 bp, Zea mays
acaagtcgtcttcttctccgtcccttgggccacctggtgttcttctataccacgcgtccacgccactgctaagctgctccccgttcgccaggtcggcgaccaggcgaaacgtgctgctgcaagaagaagaataggtacacagacagcatgtccggagttcaggcgatgccggcggccgtgggcgtggcggggctgagagggtcagggttggttagcagcagcagtaccggcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctccgtgctctcggcaaggagaggcaggagctcgcagagcgagtgatggtcaccaggcttcacctgtacgggaaatggataaagaaatgcgaccatgccaagacgtacgagaagatctccgacgagaacctggcgctgatgcgtgagcggctgatggagacggtcatctggccaaccgacgacagcagcacggagaagatcggctgatgcctgatgcctgcggaggcgccgagtcctttcgggttgctgatcaagcttagctccttctattagcatgtagagcagcactctgggtttctctatcagtcagtcagtcagccagccagtcagtgggttgtata

SEQ ID NO: 384 - DNA, 1746 bp, Zea mays
agccagacaacacgtggacacggcagcggcagcggcagcgccctccgacccccgccgggccaccaggcagaaaaggaacggaacggcgcagccgcggcggcggcggcggcggctgtaggttcccgcaccagcgactggcggacacatatatccaatcatccatcttctctcgcacggccgcacccgtcctcggactcgttccgtctgctagcaatgcctctggcgctcgcacagctgcaggacctgcgggaccgcatctccgaccgcctccgcccctggagccgctccgcgcagttctgggtccgcgccgcggacatctacaccagctacaaggtgtgccagctgcgggctgggtttgtgaaggatgaggacgagcgggaggccatgtgggagcagcagcacgagctcggcgcccagaagatgtattccctctgctccgagctcggcggtcttttcctcaaggctgctcaaattctggggaaacctgacctggcacctatggcttgggtgaagagacttgttacgctgtgtgacaaggccccagccacgccatttgatgtggttagaaatgttgtggagaaacagttcaggaagaacttcgatgacatattcgaattcttcgatgttgagcctgttgggtctgcttctattgcacaggtgcatcgagcaaggcttaaattgtcaaatacggatgttgctgtcaaggttcaacatccaggagctgaacatctgatgatggttgatattcggaatatgcaagcaatggccttgtttctgcagaagtatgacataaactttgatctattttctgccacgaaagagatggaaaagcagatatgctatgagtttgactttgtgcgcgaagcaagtgcaatggaaagaatacgagaattcctacgtatcaccaataagaaacctccggttatggtgccccgtgtgattcctgggatggttaccagagaggttttggtaatggaattcatcaaagggaccccaataatgaatcttggcaatgaaatggctagaaggggcatagatcctagcggtaagattgcagccatggcaaagcagaagattttgtcagatcttactcttgcatatggtcaaatgatcttgaaggatggctttttccatgcagatccacacccaggaaacatccttatctgtaaggatacagaggtggctttacttgattatggacaagtgaaagaaatgccagaagatttacggcttgcttatgcaaatcttgtagttgcaatggctgatgatgatttcttgagggctgaggaaagtttcagggagctcggtattcgaacatgggccatatctgacaacaagttagaagaattgtttcagttatccctgcgaatgtttgatacaagattaccaccaggtgtaactgttatgtcaccttttgctgatgattcttcgcttactaaaattggagtggagagtttcccagaagagctattttcagtgcttcgaacaatccagcttttgcgagggctgactgtagggatgggccttacattctcgtgcgctaagcattggagatcaatcgctgaggatgaattgttgaaagcaggaagacaaagcgcttcaaaatcaagaaagcaaaagagaagttttctcaggagactgttttggtgaagtagggataggggctatcaaagaacatgatatacggacattctgtgatgaaagtatgaaacggaattagccaacagctcaagccttcgattctta

SEQ ID NO: 385 - DNA, 1629 bp, Zea mays
atcgatgatttagcacggagaggctcaaggctgtccacacagcctggattgttcgatcgttcttggagctcgcagctggagcgagagagtaatctcatgcccgctcttcttctgtagattgatggaatgatcagtaacctttatccatccatccatccatccagggattttaatttgttcagagaactaaaatttgattcctggtttttgactcagcgtagactctaaacaagcttacagcccggatgcgtcgccgacatggtgaatgcagtggctacaatcatatctacagtagcctcaactgcgacagtggtagtaatcatcgccctcatcagaaggtgccgcgtcgtgaggaagaagatgaagaagaaaatcgtgaagaaagtcctggaggagattgagaaaaagaacagcgagatgcagggcagcaacgccgtggaagatgtggcgatcgaggtcgggccagtggagacgtttctcaaccagatcctcaacgagaagccgatgcgtttcagctccgagcagctggcggcctgcacccggaactactcgtcggagctagggtccggcggctacggcgtggtctacaagggcgagctgccgaacggcctgctggtggccgcgaaagtcctcaaggtgtcgtccatgaacaggaaggtccaggaggcgttcatggcggagatcggcaccatcggccggacgtaccacgtgcacctcgtccgcctctacggcttctgcttcgacgcgagcaccaaagcgctagtgtacgagttcctggagaacggctcgctggagaagtacctttacggcggcgacgagggcagcacgacgagcatgaggctggagtgggggacgctgcacggcatcgccgtcggcacggccaaggggatcaggtacctgcacgaggagtgccagcagcggatcgtgcactacgacatcaagccggccaacatcctcctcacggccgactacaccccgaaggtggcggacttcgggctggcgcggctgggcgagcgcgagaacacgcacatgtcgctgacgaccggcggcggccgcgggacgcccgggtacgcggcgccggagctgtggatggcgctgccggcgtcggagaagtgcgacgtgtacagcttcgggatggtgctgttcgagatcctgggacggcgccggaactacgacccctgccttgagggcgagagcaaggagtggttcccgagatgggtgtgggagaagtacgagcagggtgagatcgagcacgtcgtgtcctgctcctgcgacgggatcgtcggaggggcggacagggagaaggcggagatcatgtgcaaggtggcgctgtggtgcgtgcagttccagccgtcggcgcggccgacgatgagcagcgtggtgcggatgctggagggggagatgcccattgtcccgcccgtgaacccgttccattatctcatggaaagcggcggcggctcaactatctcgggattgtggagcggcacataccagagcagcagcagagacaccgccggcgcagagttgtcgcctgtcggatagctctgctgccaggtcaatcggcgtcgacgcgccgtgatcgaagatgttgagcggactcgcggggggtcgtgttgatgaaacagagtt

SEQ ID NO: 386 - DNA, 1662 bp, Zea mays
tacaactccacgagcttccacggctcagcgtcggcgcgcagggccatgacagctccgagggcgctaccagtaccaccgcacaccgcgcggcgcgcccagggccgccacccccgttccacgcctgcgccgccgccgccgccgcgccaccatctccatccacagcagcagggggccacggcgtccgtgctgggcgtcggcgtcccgagagcctggctctcgcagcgcaccccagtcctcggcctccgcgcctgggtcctcgtcgccgcaggcgctgcggcggccgccctcgccctcttctgcctcgccgtctgcctctgccgccgctgcagccggcgccgcgcaccgcgcctggccccgtgcccgcatcggcccggcgccagcaagtccctcaagcaccgcgtgcatgcgcaccatcaagcagcgacaatgccgccgctcccgccgccagccaacaaggacgccgaggaggctgccgctcgatggcgccccgcttcgttcgaacagccgccgatccaggccatcaaggcggagcagaaggcgccgctgatcctcgcggagcatttcgcgaattcgacgagcggcgagagcaccgcgagcgaccagggcggcagcgatgcggaggttccagaggcggcgcggcgcgggtggggccggcggtacacgcgccgcgagatggaggaggccacgggcgggctcgccgccgccaacatggtgggcgaaggcgggtacggcgtcgtgttcaggggcgtgctccgcgacggcaccgccgtcgccatcaaaaacctccacaacaacaggggtcaggccgagaaagattttcgaatggaggttcagacaatcgggcgcgtccggcacaagaacctggtgagtttgctcggctactgcagcgagggagcttgcaggatgcttgtttacgagtacatggagaagagtaatctggacaagtggctgcaccacgacgacagcgaaaccagctcactgacctgggacatcaggatgcgcatactccttggaacggccagagggctggcctacctccacgagggtctggagcccaagatagttcaccgcgacatcaagtccagcaacatcctcctggaccggcagtggagcgccaaggtgtcggacttcgggctcgccaagctcctctgctcggagaggtcctacgtcaccacccgtgtcgtgggaacgttcgggtacgtggcgccggagtacgccgagaccgggatgttgaacgagaggagcgacgtctacagcttcggagtgctcgcgatggaggtcatgaccggcaggactccagtggactacactagaccagccgacgaggtgaacctggtggagtggctgaagcgcatggtcgccgaccggagggtggaggaggtgctggacccgaggctgccggagccgccgccgtccaaggcgctgaagcgggcggtcctggccgcgctccggtgcgtggacccggacggcagccagagacccacgatggcgcacgtggtccatatgctcgaagacgaccagattctcagagacgaattcaagctcgcgcgggatctgtctcctcgggagtcggatagctacgaacgcgaacacagcaggtgatggatgggaggcagggcagcagtctgggacagggacaggacactgggagggatgttatag

SEQ ID NO: 387 - DNA, 1624 bp, Zea mays
acgtctttggtaaagttctctctctctctctctctccgtatctcgcttcgccaccgccggcgagagctagggtttcgtgcgccaccgtcacttccgcccgccatggccgagacctccacgtatcagattctggtgcgtctcctcgacgggcgtaccagatgtctccgcttctccacgcccaccgtttccggcgccgtgctcctcgacgccgtcgcgtcgatctctcgcgttcccgccgccgctctccgcctcgtcaccggcggcatcgacgtatcgccctcttccgtcctcgcctcagcagctgatggccagttcccctatgcgtcagcgctcctccgccttcgaggaggcaagggtggattcggctccctcctcagaggggctgcctccaaagcgggtcagaagaagaccagcaactttgacgcctgccgcgacatcaacggccgccgcctccgccacgtcaacgctgagcgccgcctcgaggaatggaaggccgaagccgccgaccgccagctagaaaagctcgccgagaacttcatcaagaagaaggccaaggaagcgggccgcggtggcggaccctcaaccgctgaggtggacaaatatctagagaagtaccgcaaggatgctgagatctgcgtcaacgtggttgaggaatccgtgcgtgcatcacttggaaagaggaagaccgcacctaagctgccctctggcgcagacgctaagaagcttaagttttggttaggaaagaacaaagtagaagaagatgaaagtgatagtgacactgatgtggatgatgaggacattgaagatcttaagagcgcagatgcaaaatctgtagtagttgatgaaggcaattactcaaatggatgcagaaaaaatgaggagaagcttgatcttggttctgtttctgggtcatcacattcagaaggagagtcttcaggagaaaagtcccaactgacaacaagttcaggagctgaaggtggtgactttgaatctggtgatagtgcagagcttgaggtaggaatgttggatcatcccatttctgttgctgctgcttcagaagaagtgacagcagatgaggataacactgctttagctacttcaaaccaaaataatccagaggtaccacaagttgaagaagtgcggaaagcagacaaggataacactgcttcagctacttcaaaccaaaacaatcaagaggtgccacaagtagaacaacatgttggcatcagcaactcttattcagagccgttggaccttgcaaagtacagttcatctgcagaattggaggtgcttggtctggagaagctaaaaatagagctgcaatctcgcggattaaaatgtggtggaactttacaggagcgtgctgcccgactcttccttctgaagacaactccattggacaagttaccaaagaagctgcttgcaaagactaatgggcggaagtgagaagttgtaccaatatatataaagaagtaccaatgatgcaacgtttaagattttctttgtcaatatatggaaatctgttgtggtgtaatcatgtgttataagctcttggcttggtttgacaattaatgagatgtctgtacgtgctatatgttaaccgttacttggaaggcgctcagtt

SEQ ID NO: 388 - DNA, 1544 bp, Oryza sativa
gtttcaagcacaacgctgctcaagatgccagcactgaggatgaagaggaactttgacgatgatgtttttagggatgagtttgattccaaacccacaaaatctatgaagatctcacattttcaagtcagcgaactagagcagtcagctgtgttgaacttgccttataaagatccccacgatgagctggatttgacaactcagttagctggccaggacattatgatcatggaagctgctagtttggatgatgctcttggaggagcatctttgctcaaggatttaatatctgaggtggcagtttcaccaaatatggagaatgatatgttagttaattatgaagacatcagatctcagttaaatgtagtaaattattttgacaaagatgaagatgcaaattctgcatcatataatagctgtaccgttaattgtcatgaagaaagctggggctcgaatgagggttgcagtctgttggacatttataatcctgatgatgctttctctttcctattggatacgccctctgagtttctgggtagttttactgcattatatgatgaagttgtaccaattgattcattggtgaatataagtggccgatgtggagtattcccacttactgagagcactacagaagccagtattggtaatgagccatgcagatctgagggggatatgctatttagtaactcagaggtgttagagtggctcaatccacatctggctgaggaggatttgcctaatctcgttgattttactgagctgaactcacatgctgtatcaaaggagcaaggggccaggaaggtcactcttgtacttgatttggacgaaacccttgttcattcgaccacagagcagtgtgatgactatgactttacctttccagtgttctttgatatgaaggagcatatggtttatgtgaggaagagaccacatctccacatgttcctccaaaaaatggctgagatgtttgaggttgttatattcacagccagccaaagtgtttatgcagatcagctgcttgacatcttggatccagagaaaaaactgttctctaggcgttatttccgggagtcatgtgtatttacaaacactagctacacgaaggatctgacagttgttggagttgaccttgctaaagttgtcataattgacaacactccgcaggttttccagttgcaagtgaataatggtatacccatagagagttggtttagcgacgactctgatgaggcattacctcagctgattccgttcctggagacccttgcttctgcggatgatgtccgacccataattgccaagaagtttggcgacaaaaaggatattgctgagattttccaataaatgttagggatagctttttgtttactcagatagaggaacagaaacttaattaacatgttaaccgggcttgttgacctttttcttttccttttttacagtgggtggttttcataggattaagaattttggtgttagagctagttgtgaattgtacatatcctcgtatttcttaaacagttctgtacatagtatgctgccgg

SEQ ID NO: 389 - DNA, 568 bp, Oryza sativa
ccctgcattgcacatcacagaaacactcgtagtaattaatttgcagctagttgtttgcaccatggcgcagtactactcggaggtggaccactgcgcggaggagatgaacaggccgccgcacgccggcggcgagcactacgccgtcaggagggagtcgtacgaggaggtggacgagatggcgcgcgccggcagggggcaccaccacggcaacggcggcggcggcggccacctgggctacagcggcagccgccacggtgatgcccatctgggcggccaccgggaggagcacctcgtccacggtgacgagcaccgccacggccacggcggcgggcgccagtacgactcctgcaccggccagtactacggctgagcacgttcggtcgcaccggacgacgtacgcgaggctgcagtttctgtatgactatgtgtgagtgtgtgtgtgtgtgtgtgcacggtcgtgtacatggtgtgtgtgtgcgcgctctgacgcacgtacgagcgtgtgtctacgcgcacatgcagcatcttatctatggtctgtacgtacgagaataattgagaccgtggt

SEQ ID NO: 390 - DNA, 1298 bp, Oryza sativa
atgaacccaagccacatcttagcttaattacatagctcctcctcctttctccactgactgctcagtgtgttttgcatctctccattgagcaagaggagaagggaggctcagctagctagctagctaccatctatactagtatcgagtttttttgttcagatttttttgttggaggaagagttctagggagatcgatatggccttcatgtccatggaacgcagcacttgggccttcacctttggcatcttaggtaacttaatctcactaatggtattcctttcgccactgccgacgttctaccgggtgtaccggaagaagtcgacggaggggttccagtcgacgccgtacgtggtgacgctcttcagctgcatgctgtggatgtactacgcgttcgtcaagtccggcgccgagctgctggtcaccatcaatggtgtggggtgcgtcatcgagaccgtctacctcgccatgtacctcgcctacgcccccaagagcgccaggatgctcacggcgaagatgctgctcggcctcaacatcggcctcttcggcgtcatcgcgctcgtcacgctgctgctctcccgcggcgagctccgcgtccacgtcctcggctggatctgcgtcgccgtctcgctcagcgtcttcgccgctcccttgagcatcatcaggctggtgatccggaccaagagcgtggagttcatgccattctcgctatccttcttcctggtgcttagcgcggtgatctggttcttgtacgggctgctcaagaaggacgtgttcgtggcgctgcccaacgtgctgggcttcgtgttcggcgtggcgcagatggcgctgtacatggcgtaccggagcaagaagccactggtggcgtcgtcgtcgtccgccgtggtggcggccgggctggagatcaagctgccggagcatgtcaaggaggtgcaggccgtcgccaagggcgccgtcgcggcagcgccggagggcaggatcagctgcggcgcggaggtgcaccccatcgacgacgtgatgccctcggaggtggtggaggtgaaggtggatgacgaggagacgaaccgtacggacgagatggccggtgacggcgatcacgctatggtcagaacggagcagatcatcaagcctgacatggccattgttgtggaagtgtagtctgattaagcttagagaactagtagtaattctctcatgtgaggtatagccagctagctggtggtacacaaacataaacacgaacacatgttcatcgcgtacgtactagctactaggtgagacacctcttggcgtagtacgt

SEQ ID NO: 391 - DNA, 306 bp, Oryza sativa
ggagggatgatgaggaagttggcggtgttggtgttggcggtggcgatggtggcggcgtgcggcggcggcgtcgtgggtgtagcgggggccggttgcaacgctgggcagctgacggtgtgcacgggggcgatcgcgggcggggcgcggccgacggcggcgtgctgctccagcctgcgggcgcagcagggctgcttctgccagttcgccaaggacccgcgctacgggcgctacgtcaacagccccaacgcccgcaaggccgtctcctcctgcggcatcgccctccccacctgccactgatccatctga

SEQ ID NO: 392 - DNA, 1354 bp, Oryza sativa
atttcttgcttgacgagctgagctgagctgagcagaggagctcccaccttctctccctctgttgcaagggatctttcggagattttgttagttcatggcggagatttgctgcgaggttgtggctggatcgtcgtcggaggggaagggcccggagtgcgacaccgggagccgagcggcgaggcggcggcggatggagatccggcggctcagggtggtcgcggagcgtggggcggaggaggagacctccgggaagaggcggaggcttgatggcggcgggggagaggcctcgacggacgaggaggacagggaggtggagcgcgctaggtacggctttacgtcggtgtgcggacgccggagggacatggaggactccgtctccgcctgcccggggttcctccccggccaccacttcttcggggtgttcgacggccacggctgctctcatgtggcgacgtcgtgcgggcagcggatgcacgagatcgtggtcgacgaggccggcgccgccgctgggtcggcggggttggacgaggaggcgcggtggaggggcgtcatggagaggagcttcgcgcggatggacgcggaggccgtggcctcgtcacgggggagcgtcgccccggcccccacctgccggtgcgagatgcagctgcccaagtgcgaccacgtcggctcaacggccgtcgtcgccgttctgggccctcgccacgtcgtcgtcgccaactgcggcgactcgcgcgccgtcctctgccgcggtggcgccgccatacccctctcatgcgaccataagccggaccggcccgacgagctcgaacggatccacgcggcgggagggcgcgtcatcttctgggacggcgcccgcgtctttggcatgctcgccatgtcacgagccatcggggacagctatttgaagccgtacgtgatatgcgacccggaggtgagggtgatggagaggaaggacggcgaggacgagttcctcatcctggccagcgacggcctgtgggacgtggtgagcaacgaggttgcctgcaacgtcgtgcgcgcctgcctgcggagcagcgggcggcgcgagaggaaccggtcgagcccgacgtccaacctaagcccgaggcagagcagcagcagcggcgacgaggcgcccaacgacggtgctccttccgccgccgctggctcggagagcgacgaggagagcgccgccgaggaggacaaggcgtgcgccgaggcggccgtcctgctgaccaagctggctttggcgcggcaaacctcggacaatgtcagcgtcgtcgtcgtaaatctcaggcgccggaaattgtgacaagtggatccatcagacatactactcctctcggtttcctggtag

SEQ ID NO: 393 - DNA, 730 bp, Oryza sativa
attgcaaatctgtcaccgaagctgtcaatagctagagagagatagagagagagagagagagcagggtgcggcgccggagcggaggaagatgagcgggagcagcaacagcagcctggagacgcgcacgttcctggacgaggtgcgcggcctggagaagaactggatggtcgacctcggccacccgctcctcaaccgcgtcgccgagagcttcgtcaaggccgccggcatcggcgcagtccaggcggtcgcgcgggagtcttacttcatggccatggaaggggagggtgggggcacgggagccgtgtccgactccaccggcgccaggaagcgatcgttcccggatctcaacggagggaacagcagcaagtcagctgaggctatggtgaaaagcgtgagcaaagagtctctccagtgggggctcgcggccgggttgcactcggggctgacctacggcctgacggaggcgcgcgggacgcacgactggaagaacagcgtggtggcgggcgccctcaccggcgcggccgtcgcgctcacctcggaccgcgcgtcgcacgagcgggtggtgcagtgcgccatcgccggcgccgcgctgtccacggccgccaacgtgctctccggcatattgtgagccgctcagccggcaaattagctgtccggagttttaactacctgcatcttaacttctcaagtctgccattgttatgctagctgttggagcttggaagtcttc

SEQ ID NO: 394 - DNA, 528 bp, Oryza sativa
gaatctcaatccacaggctcacactgatacgcaacgcacgtagctactgtactgtaggagcaaaagaaaagaaaagatgcagacggcgaaggtgaaggtgcaggacatggtgagcggtgccaaggagaaggtgaaggaggggacggccaaggcgcacggcaaggccggccaggcgacggcggccacgcacggcgagaaggagatggccaagcaggaggagaaggccggcaaggcacaggccaaggccgacgagcaccaggagagggcggagcaccgcgccaacgccaccacgggccgccacggcacgcgcgtgccgcttacggccggcggcaaccgccaccaccacgctccggtcggcggccccgccgtcgaccctgcatacccggccgccggcaccggcaccggcaccggcacgtacgcggcgtccgacaaatcgtacatctagatttggggtagatggacatgggcgggcttgatcgatctggatcgctagtgtgttttttttcagtgtagcgagtgatctggtcc

SEQ ID NO: 395 - DNA, 902 bp, Oryza sativa
attgtcctcctcttcccttgacggtgcaaagcagcatctccatcgcaatggattaccaccgaatccacccggtgggcgtcggctcgccggcgccggcgccggacagccagcagcaggtcggcaaggggaggtcgacggcgagctacggtgagaaggagcagctgccgatcaccgcgccacggccgtacgcgccggcaccgctgccgccgccgccgccgcggcgcaggagccgcgggcggcggtgctgccggtgcgtgtgctggacgctgctcgccgtactcgtcctcgccgtggcgctgggcgccacggcgggcatcctgtacgcggtgttcaagcccaagataccggacttccacgtggaccggctcaccgtgacgcggttcgacgtgaacgcgacggcggcgacggtgagcgacgcgttcgaggtggaggtgacgtcgacgaacccgaaccggcggatcgggatctactacgacggcggcgaggtgacggcgtcgttcaacggcacggagctgtgccgcggcgggttcccggcgctgtaccagggccaccggagcacggtgcgccccgtcatcctgctcgccggcgagacgcggctggacagcgccgtggcgctgcagctggcgcggcagcagcaggccgggttcgtgccgctcacggtgtgggcgcgcgtgccgatccgcatcaagttcggcgccatcaagctgtggaagatgaccgggaaggcgacctgcaacctcgtcgtcgacaacctcgtcgccggcaggcagatccgcatccgctccaacagctgcagcttcaagctcaaggtctgatcgagctttgtagaggcgttgatccatctccatttctgtgaatccatccgttgagttgagattagcaggtggtagaggcgtgtattt

SEQ ID NO: 396 - DNA, 572 bp, Oryza sativa
attcacagcaacagcacatctcgcagcttaatttcagcttactgatcagtgatcactgagctagctgagacaagtttttgagtatggcagcgaaggcatctgcagtgttcgtcctgctggtggtggtgctcgcggtggccgcggcgatgcggggagcggaggcggcgacgtgcacgccgacgcagctgacgccgtgcgcgccggcgatcgtggggaactcgccgccgacggcggcgtgctgcgggaagctgaaggcgcacccggcgagctgcttctgccagtacaagaaggacccgaacatgaagaagtacgtcaactcgcccaacggcaagaaggtcttcgccacctgcaaggttcccctgcccaaatgctaagcacctcgtatggtcacacacgcactggtcatcaatacagtagcacaccaatggcatatgcatggttttcaggctgccattatgccatatgggtgtcagtttaagtatactaataaaatgagtcactagacagtgttctgtttaaagtttcagaataaaatccaggctcagtacgtgctcggtgtgttatgagcttct

SEQ ID NO: 397 - DNA, 558 bp, Oryza sativa
catacatgcaccgacctaacttcaacccgacgcgcaggcaagcgcggcctataaatgcatgctaacaaaccatgatcccatttccagtatttgtcgccggctatataatatatcggacgtccagacgacgtcactctttactccgatccgtttcatggcatcagaagctgctacgacctgcatcgggtttatcctcctcacagcaagctcgatcgctgcgatccacaggtcacacggagaaatcaccgagacgtcgttcatcgtcgtgtcgtacctcagccttgtgctgctcttcgtgttcctccgccgcttcgaggcggcgccgcggaattcgccggcgaggggcggcgccaaggccggcgtatgggtcgtcacggcgctgctcgccgcggtgttctcgtggagggtttccgcgctcatgccgtggccggtggatgcgattatttgggtgatggccgcctcaactgttcttgggggattctacgccttgttccttcatcatcccggcgtagactgaaaatgatcgatcgatcgatcgacatgctgaagcaatggaac

SEQ ID NO: 398 - DNA, 1805 bp, Oryza sativa
aactgccaataaacacagggtgaaaaactgaatcagtaactgtaaaaattggtaagcctcaggcgctcagttttcttttacctcctcccatcttttatatgccaccggaagacaaagccctttttgtctccagacttcctgctccctctgtgtgtaatgcagacatgaggaaattcatagcagcactgcggcttgcactagcagcagcagctcatctgctgctgacgctgccaccggcacaatgctactggctcaacccggagatctacgacgccggcgggctgagccggcgagccttcccggaggggttcgtgttcggcacggccgcgtcggcgtaccaggtggagggcatggcgaagcagggtggccggggccctagcatctgggacgctttcatagagaaaccagggacgatccctaataatgccacagccgatgtgacggttgatgagtatcataggtacaaggaagatgtgaacataatgaagaacatgggctttgatgcgtatagattttcgatctcttggtcaagaattttcccaaatgggactgggatggtgaaccaggaaggagttgattattacaacaggttaatagattacatggttaagaaaggcatcaaaccgtacgcaaacctctaccactatgacctaccattagcactccatgagcagtacttaggctggctaagcccaaacatcgtagaggcgtttgcagactacgcagatttctgcttccagacgttcggagacagggtgaaggactggtttaccttcaatgagccgagatgcgttgctgctctaggatatgacaatggcttccatgccccgggaaggtgctctggctgtgatgcaggaggcaactccacgacagaaccataccttgctgcccaccatctcatcctttctcatgctgccgccgtcaagcgataccgcgaaaagtatcagctttatcaaaaggggaggattggaattctcttggattttgtctggtatgaaccattcagtgacagcaatgctgatagggctgcagcacagagggcaagagattttcacctcggatggttccttgaccccattatccatggtcggtacccatactcgatgctcgaaatcgtcaaggacaggatgccaaccttcagtgatgaggagtccaggatggtgaaagactcaatagattatgttggcatcaaccactacacctctttctacatgaaagaccctgggccatggaacctgacaccgaccagttatcaggatgactggcatgttgggtttgcctatgaacgaaacggcgtgcccattggagctcaagcaaactcctactggctttacattgtgccatggggaatcaacaaggctgtgacctatgtaaaggaaacatatggaaaccctacaatgatcctttctgaaaatggtatggaccaacctggcaacgtcagtatcactcagggtgtgcatgatacagtaagaatcagatactacagaaactacatcactgagctcaagaaggcgatagacgatggtgccaaagtgattggatactttgcttggtcattgcttgacaacttcgagtggaggctcgggtacacttcccgttttggcatcgtctacgtggactacaagacgctaaagaggtaccccaaggactcagctttctggttcaagaacatgctctccagtaagaagaggaactaaagtatgcagacaaaaggatcaagctgtgaaagcctcaaaggcttccactgtcagatttcagaacaaagctaactctagcgtatgctcatcgtagcgcgttagtttagc

SEQ ID NO: 399 - DNA, 2504 bp, Oryza sativa
aaggaagggaaaccccacgcggaggcggagagcggagtggcggcgggatggactccacctacgccctccacctcgccgtcgccaccctcctcggcgcctccttcgccgccgcctccgcctactatatgcaccgcaagaccctcgaccagctcctccgcttcgcccgctcccttgaccgcgaccaccgccgccgcaaccgccacctcctcgacgccgacgacgacgatgacgacgaccctcccagagaccacgatcgccgcaccacccttcccatcccaccgggccttccgccacttcacaccggccgagaaggaaagccaattatctcaccagcttccaccaaaagagttggacctttggttagacctactacaccaagatcccctgttcctactgtcagtgcatttgaaactattgaagattcagatgacgatgatgagaatattgccccagatgccaaaaacaatgccgtttccttgctcacaaatggaactattggatcagatccccttccgggtaaagcaagtcagaatggggacacaaaaccagtaccatcaacaaacatgattagatctcaaagtgcaacaggcagtctgcatggggcccagcacaatccagttgcagctgatattcttcgaaaggaacctgaacatgagactttcagtaggatcaatataacagctgttgagactccatctcctgatgaaattgaagcatacaaggttcttcagaaatgtcttgagctacgagagaagtacatgtttagagaagaagttgctccatgggagaaggaaatcataactgatcctagtactccaaaacctaatcctaaccctttctattacgagcagcagactaaaactgaacatcattttgaaatggttgatggtgttattcatgtataccccaataaagacgctaaagaaagaatctatcctgttgctgatgctactaccttttttactgatatgcactatatccttcgtgtgttggctgctggggatattcgaactgtatgttataaacgtttaaatcttctagaacagaaattcaatcttcatttgatggtcaatgccgatagagaactacttgctcagaaagctgcaccccatcgggacttctacaatgtcaggaaggttgatactcatgttcatcactctgcatgcatgaatcagaagcatctgttgagatttatcaagtccaagttgaggaaagaacctgacgaggttgtgatttttagagatggtacctatttgactcttaaggaggtttttgagagtttggacttgactggttatgacctcaatgttgatctcttagatgtgcatgccgataaaagtacattccatcgctttgacaagttcaatttgaagtataatccttgtggccaatcccggctgagggagatctttcttaaacaggacaaccttattcaaggccgatttcttgctgaattgacaaaagaagtattttctgatcttgaagcaagtaaatatcagatggctgagtatagaatatctatctatgggagaaagaaaagtgagtgggatcagatggcaagctggatagtgaataatgaattgtacagcgagaatgttgtttggttaattcagattcctcggatatacaatgtatacagggagatgggaacaatcaattctttccagaacctccttgacaatatttttctgcctctttttgaagtaactgttgatcctgcttcacatcctcagctccatgttttcttgcaacaggtcgttgggctggatttagtggatgatgaaagcaaaccagagagacgcccaacaaaacacatgcctacacctgagcaatggactaatgttttcaatccagcatatgcatattatgtgtactattgttatgctaacttgtacacgctgaacaagcttcgtgagtccaagggtatgacaacaatcaaacttcgtccacactgtggggaggctggagatattgatcatcttgctgcagcatttcttacttctcataatattgctcacggggttaatttaaagaagtcccctgtcctccagtatctgtattacctagctcagattggtcttgccatgtctcctttgagcaacaactcattgtttattgattatcaccgaaaccctttcccaacatttttcctaagaggccttaacgtttctctatcaaccgatgaccctttgcaaattcacctgacaaaagaacctttggttgaagaatatagcatcgctgcttcgctgtggaagctaagttcatgcgacctatgtgaaattgctaggaattctgtgtaccagtctggtttctctcataggctcaagtcacactggattgggagaaactactacaaaagaggtcatgatggcaatgacattcaccagacaaatgttcctcacatcaggattgaattccgacacactatttggaaagaagaaatggagctaatacatctgaggaatgttgatataccggaagaaattgataggtgaagaccttga

SEQ ID NO: 400 - DNA, 601 bp, Oryza sativa
tgttcatccaaatccacagccataaaagtagccatacttgagtttaggtagccagcatgcaggccgggaagaacgcgatgcagtcgaccaaggaggccgcggcgaacgtgggcgcgtcggcgcgcgccgggatggacaagtcccgcgccgccgtgcagggccaggtggagaaggcgacggcgcgcaacgcggccgacaaggacgcggcggaggtgaggcggcaggagcgcctgcaggccgccgaggaggagaagcagcacgccatggccgccaacgcagccgccaaggagcgcgccacgggcggcgccggcgcgtaccacccgtcgcagggcgcccccggggtggacccgcgtgcggcgcagccgacgggagggcacgtccaggacggcgtcgccgagagccggccggttgggacggccaccggcacggcgaggcccagcgccgcccacaacccgcacgtcggcagcgacttctcgcaggcccacggcaccggcggccagtaccagtgatctcattctcatatcaatgtgacaatttatgatctactagtagctgttcatcagttcatgtagagttcacttcgctactatgagttgatggg

SEQ ID NO: 401 - DNA, 278 bp, Oryza sativa
aggcaatggcgagcactaagatggcggtggtggcgatcctggcggcgctgctgctgatggcagctgtggagccggctttggccacgccgcccagcttgctgccggcaagaaagctgcagatgcctcgcctcatggatgtcgtctccgcagagtcaaagctggcttgcctcccagcaggcggtttttgcatgtttcgtcctatggattgctgcggtaactgcggttgtttatatcctgtcggggtttgctacggctcacggtgtgaggaatgaacttga

SEQ ID NO: 402 - DNA, 797 bp, Oryza sativa
acaccacagcaagagctaagtgagctagccactgatcagaagaacacctcgatctccgagagttttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccaccggcggcatgggaacgcacggcaccaccggcggcatggggacgcacggcaccaccggcaccggcggcggccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgccgccggcgacggccgccacgtcaccttcctgaataataagatgagctagccgagcgcaataaaaggaaaaaaaaaatgttactgtcgtgtgatgagtgtgaatgtgtgatggcgttctccagtacggaccgtgtctgcgtgttgtttgtactgtgaa

SEQ ID NO: 403 - DNA, 584 bp, Oryza sativa
ggagaaagttgtgaataccgacctaccggcggcgaagatcgatgatgtacatgcgcgcgacgcaccgggacgaggaggggaagaaggtgacggagaaggtggcggtgccggagacgcggcacccggacacggccaggcacttcgagcggaagctggaccagcaggggctccaccgcatggagcgccacccggcgaacggctcccgcggcatcggcgcgccgccgcccaagtccggccgcggcggcaagttcacctgggagggccccgacagcatcgtcgacagccagctcgatcccctcccggccgccatcgaccgcaacgaccccaactacgaggaggaggaaggcgaccacgagcgcgaggccgacgtcgtcggcgaggtggaggtcgccaaggtcgccggcgacgccagggatggtgtcgccagggtcgacgtcgtcgcgccgccgcagctgcacgagaaactgcagctgcagccgcagtaggggcgcccagccgccatttgagtggtgttttcgaagtgtgtttgttactttgtttgagtgtttatttacggttttgtatgcgtgttatttatgcctctg

SEQ ID NO: 404 - DNA, 734 bp, Oryza sativa
tctgctgcagtataaaggaggacgcggcggccggggcgagcagcagagagcagcgcccgcggtggaggagattcggaatcggatatgcggcttcttcgccggaagtcttcgatgggcggcggaggtggcggtgggagggcgctgaggcgggtggttagcttgccgaggtcgccgatggcgctgtcgctggcgccgagggcgtcgctggccaagaccgagtccatcaagaagagggataagaacaacaacaaggggtccaagagggcccgcctccgcgccgggctctccgccgcgctccacctcggcggcggccaccgccgcgccggcagaagaggcggcggcggggacgaaggagccggagcggtgtcatcagcggcggcgccgggtgttgcagtgctgcttcgcgcggccgctgatgacgccgacgagcggcccgcggcggcggcggcgaacgtggggcacgggggcagagatcacgcgagcggtggccgcggccggagctgggcggtggcggtggcgatggtgctcgtgctggcgtgcgtggtggcgctcggcaggggcccggccatctgctgctgcacctgcgccgcctggtggtgcggcggcagggcggtcgaccccgcgtgccggcgacggtggagcagcataggcggcggcggcggcggccgccatagcagcgtaccacctcaagctggttgcttgaagcactagtacttggcttgtgaattgtgatg

SEQ ID NO: 405 - DNA, 1250 bp, Sorghum bicolor
cctacgatgccgttgcgcacctcctctctcaccgccccgagacctccacgcttccctcaccgccctgaaccgtggcgcctccccccgctgcctccgccgccgcgatgctgctcgcggcagagcccgacgacgctcatgaggaaggggagaatcagcagctgctaatcacgacgaagggagggcccgggcttgagggactggtggtggggagctactgccacgatgtgctgatccggggcgggcgcgtagtgggggagacgctcggcggggctgcggccttcgtgtccaacgtgctcgacgccgcctcgccccaggacgctgcgctcaacgggacagcccccttcgtcgtcgtggccaaggtgggccacgacttcgtctacgcctccgcgccggcgcccgcgcggcatccgcctctgctctgcgcgtcgccgaccacctccttccacgcccagttctcggagaccgccgcctcggcgcacgcccccgaccgggagctccggcgcgtgcgcgcctgcgacccgatctaccccgccgaccttcccgaccgccgcttcgcctacggcctcgccgtcggcgtcgccggggaggtgctaccggagacgctcgagcggatgatccggctctgccgcgcggtgctcgtggacgcgcaggcgctgatccgggcgttcgacagcgacggcgccgtcggccacgtggcgcttgacgatacgccgtacgcgcggcttctgccccgggtggcgttcgttaaggcgtcgtcggaggaggcgccatacgtcggggtggaaacgacgaggcagcggtgctgcgtgatcgtcacggaggggagggacgggtgccggctgtactgggacggtggggaggcgcgcgttgcgccgttccccgccgtccaggtggaccctactggcgccggagacagctttctcgcgggttttgcaaccggactgctgtgggggttgtcggcgaccgacgccgcgctgctggggaacttcttcggcgccgctgcggtatcgcaggtcggcgtgcccaccttccatcccaagatgttgcaggcagttaaagaaatacttgaagagaagacaacaaaacgatatagtccgtgtataaacggcactagttttaccttcgagaagtcaaatttgcacaatgagttacacgcagctctccaagaagcggcgatgctgatgtctgaacagcagcaggctgataaggccaacggcaatggtggtgatatttgctcgccataggaatag

SEQ ID NO: 406 - DNA, 2326 bp, Sorghum bicolor
cggtgggggcgaatggctggcggggcggaggtagcggtcgtggaggacacggcggtggtgggggcgccgactgcgacggcgacgccgccaccgcctgacgcggccggtggcgcggaggaagggatgcggatggagggctggctttacctgatccgatccaaccggttcgggctgcagtactcccgcaagcgctacttcgtgctcgaggacgccgcgctccgctgcttcaagtccgcgccatcctccaagcgcgaggatcctgttagaagtgcaataattgactcttgtattcgtgtgacagacaatggcagagaaagtttacataggagtgacttttacatattcacactttataatgcttccaatcattatgatcaacttaagttgggtgcgagaagttcagaagaagcagctaggtggatcaggtgcttaatggagtctgccttaaagtcccctagaaaagatgagcacattgttgcttgttcacacagaagatggcaggctttcaggttgagccgccgcaatagacaaatgcactcaatagattggactttattttcatctgctcataacgatccaatggcatctgatgttattgcaccttctccatggacaatatttggctgtagaaacgggttacgtttgtttactgaggcaaacgatggtggctctcgtgggaagtattgggatgatcatccagctataatggcagttggtgtggttgatgcgaattctgaggctgtcttccagactctaatgtcccttggccaatcaagatctgaatgggacttctgtttgcgggaaggaaaggtggtcgagcatcttgatgggcatacagacataatccataagaaattaagaggcgactggttaccatggggaatgagaaagagagatctattacttagacgatattggaggcgagaagatgatggaacttacgtaattctataccactctgttttccactacaaatgtcgtcctgagagaggctacatccgtgcatgtcttaaaagtggaggttatgtaatatcaccagtcaatcaaggaagacaatcagttgtaaagcacatgcttgccatagattggaaattctggaagtcttatctgtttacatcatctgccaaatatatcactatacgtatgctaggcagagtagcagcactacgagaattcttcagagcaaaaaatggtaattgtgcttgcatggagttctcatctggtgagttgaccagggacatgggactaccacaaggtgaaaatcagcgaataaatttggagattcagcaagaaaatgagaacagaagacttgagggtcctactgaaggatcagtgggtggttctaacaggcacttaaacagtaccagttcctttgttcaacttaatgacgcgacagacgagttctttgatgtaccagatgaatcagaatatgatcaaagagaagttatgtttccttctgatgagagcacacatgcttcggatcagcgtcatgctaaattgtccaccgctgctgtttttgtaaaaaggttgcatgatcttgcagtccagaaaagaggatatgttgacttacagggagctgcagatgctgataatgggccatgttgctatggatatactcttcccaaagattcgagctatgcagtaccttctacttgggcaatgacagatcctacaacattcttaatccggggagagacttatttgcatgatcgtctaaagatcaaggcaaatagtaccctgatgcaaatggtaggtgctgattggataaagtctgataagcgtgaggatgatctagctggtcgccctgggggactagtccagaaatgcgcagcacaaggaggcaccaaattcttcttcgttgtaaacatacaggttcctggttcaacgacatacagcttagctttgtattatatgatggatacgccattagaaaaggtccctctgcttgaaagatttgtaaatggagatgatgctttcagaaattcaaggttcaagctcatcccttacatctcaaagggatcttggattgttaaacagagtgtgggcaagaaagcttgcttggttggacaagcattagaaatcaattatttccgtggaaacaactatttggagcttggagttgatataggttcatcaacagtggcccgaggtgtcgtgagcctagtgcttggctacttgaacaatctggtgatcgaaatggccttcttggtacagggcaacacatatgaagaactcccagaattcctcctaggtacctgccgactgaattacctggatgcctccaaggcagtatcgatagacgagtgctagaaggaccccaactgac

SEQ ID NO: 407 - DNA, 2097 bp, Sorghum bicolor
gctccttcacctcctacatcttctccggccgtcttcccgatcccctacgttcgagcttagctgaggcattatgggcaagtcaaacaagaagtccagtgttggggctgcacctgctgctgtcgcagttccagaggggaaatctgtaaagaaggggaagaggaatgcagaagatgagatcgagaaggccgtgagtgccaagaagcaaaagactgcacctgaaaaggccgtgccagttaagaagcagccccctccaaagaaagttgagagcagcgactctgaggaggattcttcagattctgaagtgaaggtgccggttaagaagcagccccctccaaagaaagttgagagcagcagctctgaggattcttcggattctgaagtggaggtgccagttaagaagcagccccctccaaagaaagttgagagcagcagctctgactctgaggaggattcttcagattctgaagtggaggttaaggtgcagccaaaaaaggttattcaaccaaagaaaggtacacaacttgctaaacaggagtccagtgatgacagcagctctgagagctcagatgatgaaccttccaaaaaaccagttgccggttcaaagaagccagctgccagtagtagcgacagtgatgacagcagtgacagtgatgatagcagttctgatgaggaacctgcaaaaaaacccactgtcctttcaaagaagcctgtcacagcagttagtaatggttcaaaacaggttaagcatgatagcagcagctctgacagtagctcagatgaggatgaaaaacctgctgctaacctaaagaagcctccagttgcctctctgcaaaagaagacccaagaatctgatagctctgacagtgattctgatgatgatgaatcagaagatgatattcctgctaaagctccagtagtggccaagaaaaaggaagcatccagtgacagttctgattctgagtctgaggatgaggataataatgctaaaacagtacagcctgtgaaggctgctgctcctaaaaagaaggaagaatctagtgggagctcagaatctgactcagagtcagattctgattctgatgaacctgaaaaacctactgtgcctgggaagaggcctctagcaacaaataagaagaatgaagaatccagcgacgaatctgatggcagctctgatgagagttctgatgaaagtgacgaggagccaccacaaaagaagtctaaggaaactcctgtagacactacgcaaaagtcagcacataatgagcccaaaactcctgccaaaagccaaagtcaggctactggttcgaagactatttttgttgggaatttagcttatagtatagagcgtgaacaagttaaggaattttttgaggaggctggagaagttgtagatattcgtttgtctacttttgatgatgggagtttcaagggttatggacatgttgaatttgctactgctgaagctgctcaaaaggcacttgaatttggtggtcgggacctgatggggcgttctctaaggattgacctggctgtcgagaggggtgcatacactcctaacagcgggaaggacaacggttcattcaggaagtctgctcaaaggtcaggcaacaccgtgtttatcaagggctttgacacgtctgttggagaggaccagatccggagtgctctcgaagaacattttcgctcatgtggagacattacccgtatttcaattccgaaggattatgacactggtgcaagcaaaggaatggcatacatggatttcaaggacccggattccttgaataaagcatatgagatgaatggaacctaccttggtgactacagcttgtatgtcgatgaggcaaagccgagacctgataacaacagggacggtggcttcagtggtgggcgtggtagcagagggaggagtgacagggggcgtggtgacagaggccgtgggcgtggatttggaggccgtggtggaaggggtgacagaggccgtggaggccgtggcacgcctttcagacagactgctggtacccctagtgcaggaaagaagacaacgtttggtgatgacgattgaagatcccatggctggcgattatagtgaaacca

SEQ ID NO: 408 - DNA, 2017 bp, Sorghum bicolor
gaccggatcggagctaggtctcgaggccatggcaagcggaggcgagggcgcagggagcggcgagtcccctcccgctgcctcagtggaggcggcagcgggggaggcgacgctgcacatccggtgcgcgaacggctccaagttcacggtgcagacggacctgggcgccacggtgggcgcgttcaaggaggtcgtagccgggagctgcgacgtgccggcgccgcagcagcgcctgatctacaagggccgcatcctcaaggacgagcaaaccctagaaagctacggtgttgagacagatcacacaattcacttggtgcgtggtgtcgccccaccagctgcatccagtgcacctgctgctgccagccccctagcttcatctactcctagtagtggccctgcaggtggcctgggaggcctatttccaggtcttggtgctccagcaagtggtaggccatcaggtatatttgggccaggatttccagaattagagcaagttgaacagcatttaagccagaatcccaacttgatgagggagataatgaatatgccggcgatgcaaaatctcatgaacaaccctgatttaatacgcaatatgatcatgagcaacccacaaatgcgcgagatcatggatcggaatcctgatcttgcccatgtgctcaatgacccaagtgtcctccgccaaaccctcgaagctgctaggaaccctgaaatcatgagagagatgatgcggaacacagacagagctatgagcaacattgagtcttctcctgaaggttttaatatgctccggcgcatgtatgaaactgtccaggagccacttctaaatgcaacaacaatgggcggggaaggaaacacagcctcaaacccattttcagctcttctcggcaatcaggggtctaaccaacctggacaaggtcaacctgcaacaaatgctcctgctactggctcagagtcgacaactggaaccccagctccaaatactaatccactgccaaatccctggagcaccaatgctgggagtgcacaaggagcaacccggtctagtcctagtggcaacgcaagaactggtgcttctggtggcgttgcaggcactggtgccactggtggactgggagggttgggttcaccagatttgagtagtttgcttggtggtcttgctggcaatccaagaactggtgctgctggcggtttaggaggtttgggttctccagatttggggaatatgcttggtggttcacctgatgtctctctttttaatcagatgttgcaaaaccctgcaatgatgcagatgatgcagagcattatgtctgacccacagaccatgaaccagttgcttaacttcaacccaaatacacgcaacctgatggaatcaaacactcagatgagggaaatgcttcaaaatccagaatttcttcgccagctgacatcacctgacactttgcagcaattactctcatttcagcagtctttattaggacagcttggtcaacttcaacctagccagggtggcaacaatgcaggcagtgccacaggtacgcagggaaaccctagccttgacaccttgatgagcatgctcagcgggcttggttcgggaggtggcctaggtgttccaaatacttccaatgtgccaccggaggagctctatgccacacaacttactcagctccaagaaatgggtttcattgacaccgcggagaacattcaagcactggtcgctaccgctgggaatgtacatgctgcagtggagcgtcttctcgggaaccttggccagtagcttaagcgagcgagccagacactgcccgcaaatcttaaaatgtcacgcatctgcaggagtgtttggcttaacgttcttcaagccccagaatttgaaggcggcggcgtccatagtcccgaaaacaaaataatcaaaaagtcaggcagccattaacttttctcatacatggtggtcatgtctttgtttttacagtgttgtatttgcgatttggattggtgtacatacatatcggtcggatgttacctc

SEQ ID NO: 409 - DNA, 1355 bp, Sorghum bicolor
agccagacaagggtcttcatcgcccctgctctgctcctctcctccctccctccccaatcccgatcccagccccgccgccgcccgccgccaaatccagcccaacccgcgccgcgatgagctggtggtggacgggcgcgataggcgcggtcaagaagcggcaggacgagcaggcggcggccgcggagccctcgtaccagagcgtggccctcgtcgtcggatccaccggcatcgtcggcacctccctcctcgacatcctcccgctcgccgacaccccggccggtccatggaaggtctacgccgtctcgcgccgcccgctcccgccctggtccccggcgccctcccccgccgtcacccacctccacctcgacctcgccgacgccgccgccgtccacgacgccctcacacccctcaccgacgtcacccacgtcttcttcgtcgcgtggaccagccgcgccaccgaggcggagaaccgggaggccaacgccgccatgctccgcaacgtgctctccgtcgtcgtccccaactgccccgcgctcgtccacgtctgcctccagacggggcgcaagcactacgtcgggcccttcgaggccatcggcaaggtcgccaccccggaaccgcccttcaccgaggacatgccccgcctcgactgccccaacttctactacgacatggaggacgtcctcttcgaccacgtctcccgccgcggcggcgccgtcagctggtccgtgcaccgccccaccaccgtcttcggctactccccgcgcagcgccatgaacctcgtcggcagcctctgcgtgtacgcagccatctgccggaaggagggcgccacgctccggtggcccggctccagggtcacctgggaggggttcagcgacgcctccgacgcggaccttattgccgagcacgagatctgggccgccgtcgatccattcgccaagaacgaggccttcaactgcagcaacggggatatcttcaagtggaagcagctgtggccgatcctcgccgatcacttcggggtggaatgggctggctacgaaggggaggagaacaggttcaggctcgaggatgccatggccgggaaggaagccgtctgggcggagattgtcagggagaatgaacttatagcgacggagcttgacgagatcaccaattggtggttcgtcgatgccatgtttgccgtcgagacccagcttctggacagcatgaacaaaagcaaggagcatggcttcctgggcttcaggaacactgtcacctctttcaacacatggatcgagaagatgaaggtcttcaagattgttccttgattcgtccctgcaattcagttctctactgttgctttcacatcctttctgtag

SEQ ID NO: 410 - DNA, 1215 bp, Sorghum bicolor
tcctgcaaggctgtgttagttaccgtgtggggggcacggaggccgaggccggcccatggcgtccagagacttcctgcgcgtcttcggcgaggggtccgggtccgggtcgccgaaggccgccaacgccggcgccggaggccagtccgacgacgtcgagctcagcctcggcctctccctgggcggccgcttcggcaccgacgccgccgccaagcgcccgcgcctcgcgcgctcctcctccatcgcctccgtctgctccgtctcctccctccacggcgacggcgacggcgagggagacgccgacgccgacccgtccccggccgcgccgctgccgctgctgcgcaccacctcgctgcccaccgagaccgaggaggagcgctggcgccgacgcgagatgcagagccgccgccgcctcgaggcgcgccggaagcgcgtcgagcggcgcaactcctccatggcctccctggtccccgccggacccaagcccgccgctgcagccgcggacgcgaacgcgaacgccgccgtcggcagcgggaggaggtccaacgcctcgcaggggagcaactctgtaagcaccaccgagcaaggtattggtggaagcgcaattaaccagtccacagatgctaggagtccatcaacctctgataacacaaatcaaaatagcatgcttcctccaaccaaagctgctgagaagccactaaatggcactcccacagagcagcctcgcctgcggacgcttgggtccctcacaacacgtacgagcagtaccagtgacatcaggaagctcatgatggaggacatgccaatggtctcatccaaggtagaagggcctaacaccaggaggatcgacggcttcctgtacaggtacaagaaaggcgaggatgtgaggatagtatgcgtctgccatggtagcttcctcactcctgcagagtttgttaagcacgctggcggcggtgatgtgtcgaatccgcttcggcatatagtcgtcaaccctgctccattctcatgaacagggggttacagggttaaactgctgctggtatctactgtgctgtaacatgtaggctccctgtttcggggagttcaacggaaggtctctgtattttacataaattgagtgtgacagcaaattcaagagaaatgtcatctgcaaatgttataggcttgtctacaaattgacaaggattcagttgctgcaataggtgggtcgtagtctgg

SEQ ID NO: 411 - DNA, 700 bp, Sorghum bicolor
ttaccaggctctgctgctgtggacctgtggtggccgcgaagcaatggaggccgcggtggccacgagtacgagggtgccgcccctccctctgccgcccaccgcggtgaggcccctgctcccgtcgggcctggcgcggtcccgccgcgggttcgcttcaatctccgacgcaggcggaggtggaggccgcgtatctggaggaggaggaggaggaggcggcggcggcggagacgactccggtgccggcgcggcagcggccgccgcggctgtggcggctctgggtgaggccgagcagcaggcggacggcggcgactccgacgcaatcgtgctccatgtcgggggaatgtcgtgcggcggatgcgcggccaaggtgaagcggattctcgagagccagcctgaggttgctgcagctacagttgatgtcgaaaaggccaccgccattgtatggacaacacctgaagcgaaggctaccaaagattggcaaaagcaattggccgagaagcttgccaatcatctcacctcttgcgggttccagtctcatgtgcaagacgaaggcgaagctgaacaaactgattcttgacctcagcagtgccttatgtatgtatgactatgagtgaccaggaagttttagcatggaggggtccttgaataaagacaatgtctcctattcctactactacttcagaagttgtacacgcggatc

SEQ ID NO: 412 - DNA, 834 bp, Sorghum bicolor
aaacctaagtggctgtcccttccgggagtaccctgcatagcggcggcgcgtcctgccgagagagagagagagctccgtagccatggcgtgggaggaggaggcggtggaagaggaggaatacggggatgagatggcggcttcagagtcggaggaggacgttgtggtggggcagatgccgacggtgatggtgccaaagcatatcaataagagggccctgaagaacaaggcgctctctgttacgctcgacaagaaagcgctcagggatttcgtgactgggttccacaagaggaagaagaagagaagaaaagaggcgcagaagattttgcaggagaaggagaggaagaagaaaatacaggaccgcaagaggaggaaagaagagaaggagattgctctatatggtagagtactgtcatcggataacaatgatgatgctggattagaaaatgaagatatcggcgatgatggtgaggatatggaaaatgacgaacctttgtctgaaaccaaaacgtacgaagatgatgggacgagaatcatagtcaccaccagtgaaattactcctgaagacgatgacatgggcccaaaaactgttggccccgtgtcaacgagctacaccaacaagaatcctagctcgtttgccaagaagaacaacagtttaggtgtgaagaagaagccacagaagagaacgttcaagagcaagagtaaagcgaaaaagggtgacaagaagcgcggtgctgcaaagggtaaaaggaagggcaagggaaggaagtagtgttttgtgaaccctctgtagaaagaattgtatgctgtgactggctgtggacctgtggttaatct

SEQ ID NO: 413 - DNA, 1307 bp, Sorghum bicolor
atcgtctttcttgctgttctggattcttcttctcgcttgttttccctcttgttgcttgctttcgttctcgttctcgttctctctccctgaccgaggaagacgaatcagatttggagatcgtgtggagagcctacaagtggcgcttctgggctctgggagaaggacagcctgtgtctctattggcaggaggacgaggaaagggaagacatggaagaggaatccggcgcagcttcaaggtactactgccacatgtgctcgctgatcatacggcccgagctgggcatcgaggagctgaagtgtccccactgccacaccggcttcgtggaggagatggcgggcgaccggcgaggcagcgacggcgcggccatccgaggccgtgctcccgcggatgaggcgagctttaacacctcggacgcggcgctggagcgcgaggtttcgctctgggcgcctgtgctcatggacttcatcgccgcctcgtccggccgccacggcctcgacggcggcggcggaggggacctcgcggctctggcgcgaaggcagtaccgcaacatcgccctcctgcagctgctcaacgcgctccaggaaggagacgccgacggcgggcgcgagcgggtcgtgctcatgagccccgcggacgcgcgcgccatgctcatgggacaagagcgaagggacggcgacgcgcgcgccgccctgggccccggcggcctgacgctcggggacctgttcctcggcccggggctggacctgctgctggagtacctggccgagaccgacccgagccggcagggcacgccgccggccaggaaggaggacgtggccgcgctgccgatggtccgggtgcgcgaggccttcacctgccccgtgtgcctggacgaggtcgcgggcggtggcgaggcgcgcgagatgccgtgcagccaccggttccacgaccagtgcatcctgccgtggctggagatgcacagctcctgcccagtgtgcaggcaccagctgcccacggaggagcctgcggcggaggcaattggcagcggcagaggcgccggtgatgagtccagtggcaacgcgcgcggcggcgacgggggaaatggcggcgggaggaggcattggttctcgtggccctttggcgggctgttctcgcaaagatccaacggcaactcctcctcgtcgtcgtcgtgatcgtgatgctaatgaacacttaaacacagatgatatatatacttatgttggtgtaggtaggggcttgtcttgtactttacgattggagatgggaggggttctttttttttggccagtgtaaagctgcatttgtg

SEQ ID NO: 414 - DNA, 1527 bp, Sorghum bicolor
gtttcctacgtacaagggactgcttagcttctcggctatgccggtcaggacatggctcgccgacctgcgctcgaagctcgtcgtcggcgttggcccccgggaccacggcgggcttggcatcctcgccttcgaggcagcagccaccatgtcgcggctcgtgtccctccaccggacggtgtcggacgtcgaggtcaggaggctccgcggcgacgtcttgcgcgccgagggcgtcgcgcggctaacgtccgcggaccaggctctcctgctccgtctcgcgtgcggcgagctcctggcggacctggaccgcgccgccgacagcgtggcgcgcctcggtgcgcggtgctgcgccggcgccggcgacacgccggcgccgctcctgcgggacttcgaccggatctacgccgaggcgaagcgtagccgcctcgcgcagctggacgccacggtcgggttctccaggggcgccacgaagcggttcagggagatggagcgccacgtggtcgtggcggcgaagctgtacgcggagatggacgcgctcagcgagctggaagcgtcgcagcggcggatggagcagtggaagcagcacagcgggcccatcccggcgcagtctttggggacgggcaagaggtcgtcagcgggcgagcccggagagaagctgatgagcaagctcagggcgcagcggcacaaggtgcgacggctcaccgagggatcactctggaacgtcgccgccggcaaggcggcgaggctgatggccaagtccgtcctcgccgtgctcgcacgcatctcccttgctttcagcgcgtccgttccaggcctccccccttggacggtaggacgcgcgtgggcgctgggtcactcgtcaggcccgttgcaccggtcggcgacgcccgcggcgctccggcactcggctcccatcttcggccagaaagacgccgcctctccactgttggaatcgatcaaaccatcggtgagcatggtcggcggctcgagcatggagctgcgatacgcgaacgtgatcttgaccgccgagacgttgctcgcggcgctgaggccgccggcggcaggtgacagcgaggaagtgcaggaagggatgatcgacctgtcgacgagagacgcgctgtacaagatgctgcccgtcagcatccgcgaggccatgaacacgaagctgagagagagatggggtaaaggacaacccgtggacgaggtggctgcggcggaatcgagggatgcggtggagcgtctgctgcgatggttgagcccgatggcgcacgacactctgcggtggaacgacgagcggagtatggagcgggcgcagcggttcggcatgcagccgcgcgcgctcatggtgcagacgctgcactttgccgaccggcagaagacggatgctgctattgttgatgtgctcatcgacctcagctgcatatgctggtacgacgatgagcggcgacggctggagtctcatgactgggacgccgagtagcacctacagatttagctgtgattgtatcgtgtgtgaatatcatggtatgg

SEQ ID NO: 415 - DNA, 1361 bp, Sorghum bicolor
gggctccatttattcttccttgcttgagcactcgcctttgcctgcctgcgcaacgcgtacttgatttcaggagagtttagctagctttggtggcatcggttctttgtttcatggccgagatctgctgcgaggtggcggcgaccgggtcggaccggaagggggagtgcgtcggcggggacgccggcagccgagcggcgcggaagcggaggatggagatccggcggctcagggtggtggccgaggaggcgtccgccaagaggcggaggctggaggcggatgaggaagacgcggtaaggagaccggcgccgaggtacggcgtgacgtcggtctgcgggcggcggagggacatggaggacgcggtgaccacccggcttgggttcatcgacggccaccacttctttggggtgttcgacggccacggctgttcacacgtggcgacgtcgtgcgggcagcggatgcaccagatcgtggccgaggaggcgaccgccgccgcgggctcgtcggcttcggacgacgcggcgcggtggagggatgtcatggagaagagctactcgaggatggacgccgaggccgtcggctccagggacaccgccggcccggcgcccacctgccgttgcgagatgcagcttcccaagtgcgaccacgtgggctccacggccgtcgtcgccgtggtggggccacgccacctcgtcgtcgccaactgcggcgactcccgcgcggtcctctgcagcggaggcgccgcgatccctctctctgatgaccacaagcctgaccgccccgacgagctggaacggatccacgcagcgggagggcgcgtcatcttctgggacggcgcccgcgtcttcggcatgctcgccatgtcccgcgccatcggcgacagctacctgaagccgttcgtgatatcggacccggaggtgcgggtggtggagaggaaggacggcgaggacgagttcctgatcctggccagcgacgggctgtgggatgtggtgagcaacgaggtggcgtgcaaggtcgtgcgcacctgcctccggaacagagcgccgccgcacccgcacggcggggacggggagcgttcgagcccaacctccaacctgagccccaggcagagcagcggcagcggcagcagcagcggggacgaggagggcgctgggcccagcgacggcgcagggtccgagagcgacggcgacggcgagagcagcgaggacagggcgtgctccgaggcggccatcctgctgaccaagctagccctggcgcggcagaccgcggacaacgtcagcgtcgtcgtcgtcaacctcaggcggcgcaggaggtcgtgatcggcggatccaacggactagccgttcttggctgattgatttgct

SEQ ID NO: 416 - DNA, 1413 bp, Sorghum bicolor
gccgtcttagagcaagcctctcaacatgtcgtgggccgcagtcgagaatgatcctggtgtttttacagaaatgttgcagcagatgcaactgaagggtcttcaagttgatgaactctactcacttgacctggatgctctcaatgatcttcagccaatatatgggctaatagtactatacaaatggcgaccttcagaaaaggatgagcgtcctgtcatcaaggatgcaatccaaaaccttttctttgccaaccagataattaacaatgcatgtgcaacccaagctatcctttcggttctcttgaactctcctggcatcacccttagtgatgaacttaaaaagctgaaggaatttgcaaaggatttgccacctgagctcaaaggattggctatagtcaattgtgcaagcattcgcatgctaaacaactcgtttgcaaggtcagaggtttctgaggagcagaaaccacctagcaaggatgatgatgtctaccatttcataagctatgttccagtggatggcgtcctgtatgagcttgatgggttaaaggaaggaccaataagcctgggaaaatgcccaggtggtgttggtgatacagggtggcttgagctagcgcagcctgtgattaaagagcacattgacctgttctctcagaatgagataagattcagtgtgatggcaatcttaaagaaccggaaggagatgtacacggtggagctcaaagacctccagaggaagagggagagtctcttgcaacagatgggcgatccttctgcgattaggcatgtgccatctgttgagctgtcactggcagaggtagcagctcagattgagtctgtgacggagaagatcataatggaggaagagaagatgaagaagtggaagatggagaacttgaggagaaagcataactacgcaccgttcctgttcaatttcctcaagattcttgaggagaagcagcagttgaagcccctgatagagaaggcaaaggcgaagcagaagtctcacggccccagtcctaggtgaaagctgcaatacacctactgtctcttttagttggggattccttgtagagattggccctgtgtcccttgttttcttggccagtgtttgaaacttatgcttacccttagttttaggtagcgcacaaatgtctgctgttacatattcaggtgaatgaaccttgacatggcgaggtccccgtggactgtatgcagtcatactgtatgaaacccatgcatggttcacccagttattttcctggcaaactaaatggtgtcgtttgctgacacatgtcaagccttgtttgtttctgaaacgtagaggatgacacaatcacgaacatgtctactcttccaatttgccctactcttcgacagggacaggatctttacaagctctgtatggcaggatttgtt

SEQ ID NO: 417 - DNA, 1799 bp, Sorghum bicolor
gctaggcatggaccagctccccaagcgcccggccaactacgtgccgctgagccccgtgggtttcctgccacgcgccaatgccgtctacggcgaccgcgcgtccgtcatctacgggcgcgtccgcttcacctggcgccagacgtaccaccgctgccgccgcctcgcgtccgcgctgctgtccctcggcgtccgcaggggcgacgtcgtctccgtgctcgcgcccaacgtgccggccatgtacgagatgcacttcgccgtgcccatggccggcgccgtgctcaacaccatcaacacgcgcctcgacgccggcgccgtcgccaccatcctgcgccactccggcgccaagttattcttcgtggactacgactacgtgcgcctcgccagcgacgcgctccgcctcctcgccgccgacggcacgcccgccgtcccgctcgtcgccgtcatcgacgacattgactcgcccacgggggcccggctcggggagctcgagtacgaggctctcgtcgcgcacgccgaccccgacgcggacctcccgccgctcgaagacgagtgggacgcggtcacgctcaactacacctccggcaccacgtccgcgcccaagggcgtcgtctacagccaccgcggggcgtacctgagcaccaccagcctgctgctgcagtggggggtaaccaccgagcccgtctacctctggacgctccctatgttccactgcaacggctggaccttcacctggggcatggcggcgcggggcggcgtcaacgtctgcatccgcgacgcgcgcccagccgacatctaccgcgccatcgcgcgccaccgcgtcacccacatgtgctgcgcgcccgtcgtcttcagcatcctcctcgagggccagggcgccggcgacggcgccgccaggcagctggaggcccccgtccacgtcctcacgggcggcgcgccgccgccggccgctctgctcgagcgcgtcgagcggatcggtttcaaggtcacgcacgcctacggcctcacggaggcgacggggcccgcgctcgcgtgcgagtggcggggccagtgggaccgcctcccgctcccggagcgcgcgcgcctcaaggcgcgccagggggtcagcgtcctgtccctcgccgacgccgacgtcaagaacgccgaaaccatggtcagcgtgccgcgcgacggcaagaccgtcggggagatcgtcctgcgaggcagcagcgtcatgaagggctacctcaataacccggaggcgaacgaaaacgccttcaggggcggctggttcctcaccggcgacgtcggcgtcgtgcaccaggatggatacatcgagatcaaggaccggtccaaggacgtgatcatcagcggcggggagaacatctgcagcaaggaggtggaggaggtgctgttccgccacccggccgtggccgacgcggcggtggtggccatgccgcacccccgctggggcgagacgccgtgcgcttttgtcgtgcgcaggaacagcgctgccgagctcagtgaggacgacgtgctcgcgttctgccgcaagcgcatggcgcgcttcatggttcccaagaaggtgcaggtcgtcggagcgctgcctaggaacgcgctcggaaaggtcgagaaggtgaagctccgggaggcggcacggaagctggcgcccaccgtaccggcgcagaagcccaaggggaagacgacaacctcatcgacgacggtcggcggtcgccgcgaggaccagccggtggcgcacgtcatggcggtgtcaaggctataggtagcacaacactacagagcatagctggtgctacatagtc

SEQ ID NO: 418 - DNA, 423 bp, Sorghum bicolor
ccacaaataaacaccatatatccagctcgatcgatcgacgataaacaacaacacatggcgaagcagcagcaggcggtggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaattactcttacggtatatatatttaagccgccatgcatcacgtacggctgctgccagcgccgctctctcgggcgtatctgcgaggaataaagga

SEQ ID NO: 419 - DNA, 1558 bp, Sorghum bicolor
ccactctcatcggattcacacacataatacatacatacatacacatggcaattctcgacgtcgacctggccactcctccctgtcatgctcatgctcgtcagcagcaggcacacgcagacgagcagcaggacgccggagaggaggaggacgagcagctgctgctcctcaagggcgtgcgacacctgtgcgagcgcggcaccattacgaagctccccgctcgctacgtcctgccgccctccgaccgtccatcacccggcgacgacgagcagccaccacgcagcagctgcgtgtcgttccccgtcatcgacctggcccggctgcgcgtgccggcggagcgcgccgccgccctggccgagctggacgcggcctgcagggactacggcatcttccaggtggttggccacggcgtcgacggcggcggcggcggcgcgatgctggacgtggcgcgccgcttcttcgacctgcccttcgaggagcgcgcgcgctacatgtccgccgacatccgtgcccccgtgcgctacggcaccagcttcaaccagctcaacgacggcgtcctctgctggcgagacttcctcaagctcgtctgctccgacgacctcgccggcgtcgtcccgtcgtggccagacgcgcccactgatctcaggaaggtggtgtcggcgtacgcgcggtcgagccggcggctgttcaaggagctcatggaggcgtcgctggaggcgctagggatccggtccggcgccgccgccgagatgctggcggactgcgacgccgggtcgcagatgctcatggtcaactgcttcccggcgtgcccggagccggacctcacgctggggatgccgccgcactcggactacggcttcctcaccgtgctcctgcaggaccaggtgaatggcctcgaggtcaggcacgccgacaggtgggtcctcgtcgaccctctccccggctcagtcgtcgtcaacatcggagaccacttcgagatgtacagcaacgggcggtacaagagcgtgctgcaccgggtccgcgtgaactcgtctcggccgcgcatctcggtggcgtcgctgcacggcctgccgccggagagggtgatcgggccggcgccggagctggtggacgacgacaagaacccgaggatgtacatggacacggacttcgccaccttcctcgaatacctcacctcggccgagggcaagcacaagtccttcctccacaccaggagactcatcaccagctgatgttgataccagctggacgcattcttcttgccagacgccagctgtcggcatcaggaagagaaaagtcaacacgcatgtgaacacgtatgtgcctgtggttgcgggccaacaggttgaccggtcaaacccgtcgcgcgccgtttagcgtcccggactgcgagactggtcgtgctcctctccctcccatcaggattgctgcttttttgtgtaccctacctactagccagttaaataaataaagaaacatgtaaatcaggaagccgcattgaccaaatttaaagctacgaagcctcgtcatctggaactagagagtgttggatcagcagcta

SEQ ID NO: 420 - DNA, 659 bp, Sorghum bicolor
gagccatattcgtgtagcttccgtgcgaccgattcaacggaacctcaatcgtctactcgatcgcttgtgtgtgtgtgttgatatggcgagatcggcgtttgttccgatggcggaggagaaagagcaaggtggtgcgggtgccggaagaggagcaggagcaggagcggccgtcaataacaaggagcagcaggaggtgctgctggtgcacagccaggtgcggcggatcaagaaggaggacgaggaggccagggagcgcctcctcaagctgcgcctgctggagaccaggcccgctgccgccgccggcggggtggcgtggcgagccccgcgctctctgtcgccgctccgccgtgccgggagcgccatcccggtcccggtcccagtcccggtgggggagtagcagcagcgcctcgcagccctctgcttgtatcgtatctaagagcatcagtcagtactcgcggttggttctcgatcggccgcagttgtagatacctacgtaggcgtagcgagcgagatcgtagttcagttcagtcgtggtgcttgtgagcctgcccgtgctctgcagacatgggatcagagcttagtagacgacggtagggtggcagccagcatctatacgccatgtgtggttggtgccttggtggtagcatagcatagcatgc

SEQ ID NO: 421 - DNA, 1615 bp, Sorghum bicolor
ctgagctccgctgcacacgcgggtcgacgacggccgaactgacatggccggccacgcccagtcgtggaggacgtacctgtgctgcggcgcgggcggcagcgcggcggtcgaggacgacagcggctcgacgacgcggcggcggaggatcacacggcggaggggcaaggacagccctcggtcgtcgtcgtcgcggatgtcgttcacgagcctcagctcgtcggagatgctgtcccctgaggacctgtcgctcacgctgtccgggtccaacctgcacgccttcacctacgccgagctccgctccgccacggccggcttctcccgcgccaactacctcggctgcggcgggttcggcccggtctacaggggcgccgtcggcgaggcgctccgcccgggcctccgcgcgcaggacgtcgccgtcaagtacctcgacctggaaggcggcacgcaggggcacaaggagtggctggctgaggtgttcttccttgggcaactgaggcacaagaacctggtgaagctcatcggctactgctacgaggccaagcaccggatgctggtgtacgagttcatgagcttcgggagcctcgagaaccacctcttcaaaagtgttaacggcgccctcccatggatgacaaggatgaagatcgccgtcggcgcggccaagggcctcgccttcctccacaacgccgacccgccggtgatctaccgcgacttcaaggcctccaacatcctgctcgactcggactacaacaccaagctgtccgacttcggtctggccaaggacgggcctcagggggacgagacgcacgtgacgacgcgtgtgatggggacgcacgggtacgcggcgcccgagtacatcctgactggccacctgaccgccaagagcgacgtgtacagcttcggcgtggtgctgctggagctgctcgccggccggcagtcggtggaccgcgcgcggcggccgcgcgagcagaacctcgtggactgggccaggccgtacctgaagcaccccgacaggctttaccgggtcatggacccggccctggagtgccagtactcgtgcaggggcgccgaggtggccgccgtcgtggcgtacaagtgcctgagccagaaccccaagtccaggcccacgatgagggaggtggtgagggccctggagcccgtgctcggcatggacgacttcttccccgccggcccgttcgtgttcaccatcagcgtggaggaggacaaggtggtgggcgtcaaggtggaggtggaggagaagctgccgcagcagcaccagagccaccaggacaggcaccggcagatgtaccccaactcgtcgatccacgccggcggcattgtgctgcacggccgggaagggatggtcggcggcgatgactacaccgccacgctccggcggcagcggagggcggcggcggcgagctaccacaaggagaggggggcttaattaagagcaggagcggggatatgtgtgtgcgtgtacataactacatactagagaggtgacacaatgtcactttggcttggtttagtcttgagattgtgtgattcttgtttcttttcttctagatagcgatagcgatagcgatgttactaggtgttaggcgatgatacaggt

SEQ ID NO: 422 - DNA, 2827 bp, Sorghum bicolor
gtcgtctctctcgcagtcgccaccggcgcctttttcgcacgccgccaccgaggggacgaaggagccgcgcacgcgtgcgacagaggggtaagatgggaggcgggcggaagcgcgggcgcacgcagcgccgccacttcaagcagggccgcgagaacgtctggaagcacaaccctcagcgtcctctcgccggcgaaggaggcgaggggcgggagggcaatccctcgtggcagcccttcgccaccgagaacccgtccttcgaggagtactacaaggagcagcaaattgttcctgaggaagagtgggatagcttcatgagtatgcttcggaagccattacctgccacttttaggattaatgcgagctgtcagttttatcaagatatctgctcacaattggaaaacgacttcaggaaatcattagagactgaggtgaccgatgaacatgaagaagatgctattaggcctttgccttggtacccgggtaatcttgcatggcatttgaacttttctcgaatgcagctgaggagaaaccaggcacttgagagttttcatgaattcttgaagagagagaacgaagttggcaatataactaggcaagaggctgtcagtatggtcccaccactgtttctgaatgtgcaacctgatcatcatattcttgacatgtgtgctgctccaggatctaaaactttccagttacttgagatgattcaccagtcaacgaagcctggagtgcttccaaatgccttggtggtagctaatgatgttgatgtgcaaagatgcaatcttcttattcaccagaccaagagaatgtgcacagctaacttgattgtgacaaatcatgaagcacaaaactttcctggttgtaatcttgcaaagttctgttcagaagtgtgtatggatgaggcaaaactgcagaggttggagtttgaccgcgttctttgtgatgtgccttgtagtggtgatgggactgtccgtaaggctcctgatatgtggaggaaatggaatgctggtatggggaacggacttcatcgcctgcaagtggaaattgctatgcgtggtatgggtttgctcaaagtgggtgggaggatggtttattcaacatgttcaatgaaccctgttgaaaatgaagctgttgttgctgagattttgcggagatgtggggactctgttgaacttcttgatgtttctaatgagctacctgaattagcccgtcgtcctggacttagcacctggaaggtacgggatagagggtcttggtttggtgttcacgaagatgtacctcgctacaggaagcatgtgatatcaccaagtatgtttccctctgggaaaggcagcaaagatagtcttacggtgagcagcagcgttgaggtcaacacagatgtagctgatgctgacatgaaggattcaacagacattggagagggagaacaagaaacaaatataacaattgatgacagtgataatgctgacaatctgaaaaccaaagagggaaccaaagttgattgtgagtttggtgaggttacagctagtagttataaaaagtcaaattctactcccatccgtacagaacattcagattatccactgcatcgctgtatgagaattgttgctcatgaccagaacagtggggcatttttcattgcagtccttcataaactctccccactgaacgagaaccaggtgatagatggggtaaaaggtgaacagaatatttcaaaagacaaaactgagaaacttgagaaagatttaggatcagataaggcatcatctgaagaaaatatagtgcatcatgaagtgattgataatacaaatgttctggatggagaacaaaatgaagacagggataacaaaagttcaaaagataagagctcagaggattctaaggtgaatgttaatgaggcggaaaagggtcaagcaggaacaagggataggaggaggcagcagaaccaaggcaggtggagaggggttgaccctgtgatattttttaaagatgaagcaacagtcaaaagtattgtatctttctatggtatcatggattcatttccacttgaaggtcatctcgtgactagaaatcctgatgctagtcatgttaagagaatatactatgtgtcaaaatctgttcaagatgctttgcagctcaacataaaagttggcgagcggcttaagatcacctcactaggcctaaagatatttgaaaggcagtcttcaaaggaaggctcaccatgcacatttaggttgtcatcagagggattgccgctcctgcttccatacatcacaaaacagattctatatgcgtctgcaattgacttccagcatcttttacagtacaggactattaagtttcctgattttgtggatgcaaaatttggtgaggaagcttcagctttgcttccaggttgctgtgtcgtagtattacgtgaagggcatcaggatataggatccatagctacagatccctcagctattgccatcgtttgctggaaaggaaagaccaacttgtgtgtcatggtttctccactagatgggaaagaactgcttgagaggatttcattgcgttttgggctgaaaatccccaaaggggataaagagaaacccagcgaggagattgctggatcagacgagctgcttgattgtgccactgaggtggacgatcaagaatgttttcctgaaagcaaagcatcggacatcgaaatatcagatgctaaggatgctgactagcttttgtttttatgccacttactacacctattacacaggaggtagatgtatcctctgagttggctattggttttcagtcacttaagttgctaaaggagagatagtcgccc

SEQ ID NO: 423 - DNA, 919 bp, Sorghum bicolor
agcaaactcacaagtcccagaccgatcgccgcagaagatcccgcgatgcaggccccaagtccgccggcgccgtcctcctccgtcgacctgccgctggcggcggcgccgccgccggtgaaggcgccgacgccgcggcccccgccgccggcgtcgctgcagccggagtccccgggcgtcttcttctccgccgcggccgccgccgcgccgctgggcacctcgcaccgccgcatcgccatcgccgtcgacctctccgacgagtccgcctacgccgtgcgctgggccgtcgccaactacctccgccccggggacgccgtcatcctgctccacgtccgccccacctccgtgctctacggcgccgactggggcgccgtcgacgtctccctccccaaccctagcaacgccgccgctgcctccgaggacgacgacgacgactccgaggccgccgcggccgcgagcaggatggacgacgactacgacgccttcacggcctccaaggccgacgacttcgccaggccgctcaaggacgccggaatcccctacaagatccacatcgtcagggaccatgacatgaaggagcgcctctgcctcgaggtcgagcgcctctcgctcagcgccgtcatcatggggagcaagggcttcggcgccgcaaggaggaccagcaagggcaggctcggcagcgtcagcgactactgcgtccaccactgtgtctgccccgttgtcgtcgtgcgcttccctgatgacggctccgccgaggctggggaggccggtggattttctgccgcggttggtgctgaggatgtgctgcaccctgtgctggaggaggaggccgagtaccatgacgctgctgaggagcacaaggatacttgacctcgatgatgcattgtgaagtgaagccctctcggattcagcatgtaaaggt

SEQ ID NO: 424 - DNA, 1004 bp, Sorghum bicolor
acagctcgcttcctcttcctcttccttcccccctttcttcgcctcccggtaaccgccgtagccaaagaacctggcttcgccttctcccgcggcggcgcgggcggccggtgctgctgcgccggcgcgtgagatggaggattgcggcggcgtcacggctggaagcggcaagaagccgttccagctgacgcggtcgctgacgtaccaccaccaccaggggcaccggccggcggcgtcggcggccaggtggcggaggcagcagctcgcggacgagccgcgcgcgcagcggccgcaggcggtggtgctgtacacgacgtcgctgcgcggggtgcggcgcacgttcgcggactgcaccgcggtgcgcgccatcctgcgcggcttccgcgtcgccgtggacgagagggacgtgtccatggacgccgcgctccgccgggagctccaggcgctgctcgccgcgcgggcccgcgccttcgcgctcccgcagctgttcatcggcggccgcctcgtcggcggcgcggacgaggtgcggcagctcaacgagaccggccagctccggcgcctcctcgacggcgcggccgggcaggacccggccttcgtctgcgacgcctgcggcggcgtccggttcgtcccctgcaccggctgcggcggcggccgcaaggtgttcgtcgaggaggaggaccgcgtcgtccgctgcggcgagtgcaacgagaacggattggtacgctgcgctaactgctgttcttgatcgccaacgcccaacgggcggcgatcgttcgccgttccattcttgctgctaatccaagtggtagaggttgtagtagatatcaacaacaaaagaagagcggcctttcgatttcccattccaggcgtgggattcgtgtgtgtccgatccgatctttttgaggatcggatttgctactcggtggagaagaacagattgttcttgactccttgctgcaaaattgccatatggtgatggcgattggagaataagaaccgggcttgtt

SEQ ID NO: 425 - DNA, 373 bp, Sorghum bicolor
ttcagacttcaagggagattcgcaagatggaggggaagagcaggctgccggaggtgaccatcgtgccggcggcaaggccgttggctggcgacggcaccatcgacgcggcgaaggcagcggcagcgccgggcaaggagcccatcagccctggtactccgtcctcggcggacgccggccgccgcggcaaagagaggcgcgcggtggaggccgtcccgctccctgggtggaagctcgacgccctctgccaggagtcttgcccgtcgccgaccatgagggcgcgcttcccctacttctgaagcttcccgttgcagtcctgcatgagtttcgtttcgagcggcaacattgcatcttgtgctttggacgtctgactgat

SEQ ID NO: 426 - DNA, 578 bp, Sorghum bicolor
ctcccatgggttcgcaggccatcgaggcgcaccgcgcgggcgcggaggtgtacaccggcgcggcgctatgcgccgagaagtcgacggagctactgtcagaggtgcacctcccgctaggcctgctgccgctggcggacatggaggaggtgggctacaaccgcgccacgggcttcgtgtggctgcgccagaagaaggcgctcacgcacacgttccggcagatcggccgccaggtgtcgtacgccgccgaggtcaccgccttcgtcgaggaccggaggatgaaacgcatgacgggcgtcaagaccaaggagctcctcatctgggtcaccctctccgacatgttcctcgacaaggacgaccagtccaagatcaccttcaagacgcccactggactcggtaggaccttccccgtctccgccttcgccaaggaaggtgacgccgcggccaagcccaaggacgcctccgccgccgccaacggtaacaaggaggccgtcgccgccggtaaggctgctgccagcaagtgaggtggcggcggcgtccgaactccggagcttttacctgtggttgtactgtagtagccg

SEQ ID NO: 427 - DNA, 2762 bp, Sorghum bicolor
aaagtcgacgcgccatgagcttgttcgcgggggtcggcggcggcgcggcggacgcggcgtccgggggcggcacaggaagggcgctcctggagctgacgccgcacaagatggcggtgtgccaccttgtgcaggtcttcgcgccaccggcgcaggctgggggcgacgtcgtgccgcccttccccttcgagtccctcgcccaccacaaccgcctcggactcttcctgttcacgctcacgcggtcatgcgaggattttctggagcctccactggaagaatttttgaggcagctgaaggcagtggatgatttggctaatggttggttctgcgagcagctgacaagttctctgtcggcactcatctcacctgatgacttgttcaacttttttgataagctacaaggtgtgctcactgcatcggagggtgcgagtgcagaagacgtatttttggatccaaatagtcaacttggagtttttattcgttgctgcatacttgccttcaactcaatgacctttgagggtgtatgccatctgttggcagatcttgtcatgtactgtaactcaactgatgcttcatatgacttggcggaagacgaggacttcaatagtgaaatgggcaacttgatggatgcagacataggttctcaagttggtatatttgacaaatttcatcagggttatgcctctgagcgtcatatgggggagagttcttcagctctaattcgtgcaccaatgtcaatcaatgattttgatgatgctaatatttttaaagcggatggcaacccaacctgtctgagatcaaggtggcaattagaggcttatcttaaccaacaagctgatattcttgagaaggatcctggctcagtgcctttgaattcatttaatgccactatgacacagcttcaaacattagctcctgagcttcatcgtgtccaattcttgcagtacttgaatgccctttgccatgatgactatgttgcttcactggataatcttcaccgctactttgactacagtgcagggatgcaaggactttttggtcgttctgtgtctcaggtgcaagatattgttgttggaaagtatgagagtgctctgctatgcttaggcaacttgcattgttactttggacatcctaagaaagccctagaggcgtttgcagaagcagtccgtgtttctcaaatgaataatgatgattcatgccttgcctatgtattaggagccatttccaatctattatcaaagataggcatctcaaacacagttggaataatcacttctccatattcacttgggaccaatattggactgggcacaccattatccattcagcaacagttacttgttcttttaaaacgatcactcaagagagctgatgcattgaaacttccaagtttactatccttcgatcaccttttgttggcaaaatttgatctgaagcatgtccaaaggccactagtctcttttggccctaatgcatctacaaagcttagaacatgtcctgcagatgtcatcaagaatttaagattaggttcccgtgtgttgactgactttggagcagatgtactatctacttcaaatgataatggtagttttagcacttcgtggctgaggaatctatctgccacttctgattcatggcgtagaagttctaagaacaccaagaaattacatattaacgacttcgacaatttccattaccatgcacaaccaagtccagtacctgcaccaatattacaattagctggctcagcatgtttgctgagagcgaccgcttgggagcactatgggagtgctccaatggtacggatgaatgctctggtttatgcaacctgctttgcggatgctgcaagttcgtcagagttatcgctagcatatgttaagctaattcaacaactggcggtgttcaaaggatattcagctgcattctgtgctctaaagcttgctgaaaagaagttcccatcctcaacaagtttgcacatccagcttctaggaatgcagattctacatgagcgcgcacttcatcgagggcatctaaaagtcgcgcaacaaatctgtgatgagtttggggtgttgtcatcttctgtttctggagtagacattgagctaaagacagaatttagtgtacgacgagctcgcactctccttgctgcaaaacagtttagccaggctgcagctgtggccaattctcttttctctacgtgctacaagtacaacatgcaggttgagaatgcaagtattcttttattacttgctgaaatacataaaaaatctgacaatgcggtccttgggcttccttatgcgttagccagccaatcattctgcaaatcattcaacttggatctgcttgaagcctcagctacacttactcttgctgagttgtggctggctcttggatcaagccatgcaaagaaggcactgagtcttgtctaccagagcctccccatgattcttggccatggtggacttgagctacgtgctcgagctcacattgttttagcaaagtgccatttagccgatccaaaattctcagttcttgaagatcctgaagctgttctggatcctctgaaccaagccactgaagacctgcaagcattggagtaccacgagatggcagcagaggcgtactatctgaaggcaatggcatacaaccatctcggcaagcttgatgagagggaggaagccgcggctcgtttcaaggatcacgtcactgcccttgagaacccgcagaacgaagaggactcgcttgcgtactgatgaaggcctaaa

SEQ ID NO: 428 - DNA, 441 bp, Sorghum bicolor
ggtaaagagcgagagagctacggagaggattatcaacctacagctagagcttccatggagagagttgcatcaagctgtgtcagcctcctagcacaaaggagggcctactctgtggccgcggccatggcgaagggagtcgcacggaggggcgccgacgagaagaaggcggcggcggcggcggtgaccaagcgcgtgatgggcaagaaggaagtgaacaccgcagccgctgctgcggcggaggagaagaaggcgtgggtgccggaccctgtgaccggctactatcgcccagcaggtagcgctgccaaggaggtggacgccgcggagctgcgcgccaagctgctcacggaggctgcggccaactgattaatcacacggttaccttgtcgagctcgagcatgcatgagttggctgtccaccactccacctagcttctcttgctag

SEQ ID NO: 429 - DNA, 839 bp, Sorghum bicolor
cgcccatggcgtccgcccccgcccccgccccagccgtggtggtggtgttcgacttcgaccggaccatcatcgactgggacagcgacgactgggtcatcaccaagctcggcgccgccgacgccttccggcgcctgcgcccaaccatgcgctggaacccactcatggacaggatgatggcggagctgcacgccagggggaagacgccagaggacatccgcgactgcctcaggagcgcgccgctcgacgcgcacgtcgtgtccgcggtcaagacggcggcggcggcgctcgggtgtgacctcaaggtggtgagcgacgccaacaccttcttcatcgagaccgtcctggcgcaccacggcgtgctcggctgcttctccgagatcgtcaccaacccggcgaccgtcgacgccgacggcaggcttaggatctcgccgttccacgactccgccgccgcgccgcacggctgcagcctctgccctgacaacatgtgcaagggcaagataatcgagaggatccaagcaacagccagtgacaagaagcagcacttcatctacatcggtgacggcaagggagattactgcccatccctcaagctgggggaaggggactatgtcatgccaaaggagaactaccccctttggaatctcatctgcaacaacaagcagcttctcaaggctgaggttcacccgtggaatagcggcgaggaactggaaaagacactactgaagttggtcagcaaaatgatcgccgcacctgcacaagcttcccagtttgactacagcaaatgcgagatgagcaacccagcaatccagcatccagccctccgtgtgccacactgatga

SEQ ID NO: 430 - DNA, 1115 bp, Sorghum bicolor
gactcgtcttcctccggttccggccgaacggtcggatctcccccaccaatggccgcctcccacccacccacgctactcctcctcctcctcgtcctcgccgccatcgcgccgaggccctccagcgcgcgccacatcatcaccttcgccccttcccgcgcggtcaacccctcgtccctcgcttgggaccccacggcgcagcacttcgtcgtcgccggcggcggcgatgccgtcctttccgtctccgacgctggggtaaccgagtcgatcgtatccactggcgcctcctccgtcgccatcgacgaccgccgacgccgcctcctcgtcgcttccccggggtccgtctccgccttcgatctccgatccccgcgcccgcacagcctcatcttctccacgccggttccggaccccgcccctccgggtggcatcgctgtggaccctcacaccgggaacgccttcctcaccgtgggcgcccgaatctacaagctgtccgtagaaggcgacctcgccgcgctcgcctccgcgccggcgctcggctccgatcccctagcctcgctcaccgcgcacgtgagccgaggcttcctgctcgtgggccagcccagcacgggccgcatcctccgcgtcgacatggaggacggcgccacgaggaccgtgtcctgccccctcacgccccccacgccgaccgcggtggcggtccggaccgatggggcggtggcggtgggtggggccgcggggctgcgcctcgtcgtgagcaacgacgggtgggtgtcgtgcggggtccgggacgaggctgcgcccgcgcccgacggccccgtggccgcggtggcggtacgggagcggcgacgggtttacgcgctggtggaggcgggggcgacggacgggggcaacaagtggcggatcgaggagacctcgtggaaatcggagtcggagggggagatggtggtggtgcttgtcttcgttggtgtcgccctcgccatcttcatgttctggaggttccagatgcgccagctcgccggcaacatgaacaagaagatcagatagtaccaatgcaatgtctccttcactcctttgattttgaagaatctatagtcaattgcctttgttatgccgtagttggt

SEQ ID NO: 431 - DNA, 1938 bp, Sorghum bicolor
gcctggaattgatggaattatccgatcagattgggtgagccggagggagcccaaagtttgcgccgtcacaaatcccaaccaatcgccgagcgaggcctcgagctgagctgcttgtgtcgattgttaaatactagctcgccgcgtacgacacaccaagcgggctgcgggcggcgactctctcatctgctctgcttctccactccgctccgccggcagcgcgggccatggcgacgccagcgccggcgccctccctccgcctcctcctgctgctaccgctgctcaccgtcgccggcgccgcggtgtctcacccagcgcacgagttctgcgcagtcgggggtgacgccgccggctgcggcggcggaggggacggcacgaggatcctgatcaagggcgggacggtggtgaacgcgcaccgcgcggaggaggccgacgtatacatcgaggacggcgtcgtcgtcgccgtccgctcaaacatcccggttggtgctgataatgtccgagtaatcgacgcaacaggaaaatatgtcatgccaggtggaattgaccctcacacgcacctggagatggagttcatgggcaccgtgaccatagatgacttcttcagcggccatgctgcggcgctggctggtgggacgacgatgcatattgactttgtcattcctgtgaacggcaacttgactgcaggcttggagtcctacaagcacaaggcagcaaaagctgccatggattatggctttcacatggccattacaaagtggaatgatgaggttgcaagggaaatggaagtgatggttaaggaacatggaataaattctttcaagtttttcatggcatataaaggctcgttgatggtcaccgatgacctcctcctgcaaggcctacagaaatgcaagtcgcttggtgcccttgctatggttcatgcagagaatggggatgctgttgccgagggacaacagcggatgattgaccttgggataactggtccagaagggcatgctctctcaagacctccaattttagaaggagaagcaactgcacgggcaatccgtttagcaaagttcatcaatacgccactgtacgttgttcatgtgatgagcatagacgcgatggatgagattgccaaagctaaaagagaagggcagagagtcataggtgaacctgtggtttctggactagtgcttgatgattcttggctttgggatcctgacttcacaattgcttcaaagtatgtgatgagtcctccaatccgggaagcagggcatggtaaagcactccaagctgctctttcgtcaggaattttacagcttgtaggtactgatcactgcacattcaactccacacagaaagcttttggttctgatgattttcggaagattcccaatggtgtaaatggtcttgaggaacggatgcatataatttgggacagcatggtggagactggcaaaatttctgtaaccgactatgtcagagtgacaagcacagaatgtgccaagatcttcaacatattccctcggaaaggagcaatcctggaaggatctgacgcagatatcataatcctgaatcctgaaaggagctttgtgatgggtgctcacactcaccattcgaggtccaacactaatgtgtacgagggcaggaaaggaaagggaatggtggaaatcacaatctcaaggggccgagtggtatgggaggatggtgttctgaacattacacctggttcaggaagatacgtcatgatgccacctttcggctacgtctttgatgggattcagaggtccgacgccgcctacagagcttccctccgagcccctgtacagcgtggtaaagctagtgcatagcttatagctatgacagctgttgatgccattgacctggcagtagcccccatctgattcaagaacgagttgctccaaggtgaacaccgtttgttccatgtgtatt

SEQ ID NO: 432 - DNA, 1408 bp, Sorghum bicolor
aatctagagagccttgggcttgttgccaggcgcgcctgtacgtaacgtacgcgccgttgtgggagacagccacttgctctcgcctccaatggccgagatctgctgcgaggaagccaagtccacgccggcaaccgccgtggctgcggcttcagtctccgcggcggccgccgccgtggcagtcgcctcctcggcgttggagaggaggcgacgcaggttggagatgaggaggttccgcgtcgcgactgatcccgaggcgccggtcgcggaggacgtccgcgctaccaagcggcagaggctgctggcgcgcacggtgtccggctcctgccccgacgcgggctcggactccgacaggccggccctgccggagcggttgcctaggtacggggtcacctccgtctgcggccgacggcgcgagatggaggacatggtctccatcaggccggacttcctgcccggcaccagcacgcaacacttcttcggcgtcttcgacggccacggctgctcccacgtagcgacgctgtgccaggacatgatgcatgaggtggtcgcggacgagcacaggaaggctggttgtggcgaagagacggcgtggaagggcgtcatggagaggagcttcgcgcgattggacgagcaggccgccagctgggcgaccagccgcagccgcgacgagcccgcctgccggtgcgagcagcagatgcccttgcgttgcgatcacgtggggtccaccgccgtggtcgccgtcgtcagccccacacacgtagtcgtcgccaacgccggcgactcccgtgccgtcctctcccgcgccggcgtcgccgttccgctctctgtcgaccacaagcctgatcgacctgacgagctggcccgcatcgaggcggcgggcggccgcgtcatttactgggatggtgctcgtgttctcggcgtcctcgccatgtctcgagccataggcgatggatacctaaagccgttcgtgtcgtcggagccggaggtaacggtgacggagcgcaccgacgacgacgagtgcctgatcctggccagcgacggcctgtgggacgtcgtgaccaacgagatggcgtgcgaggtcgtccgggcgtgcttccgcagcaacggcccgccgcaggcgccggccgctcggccgaacggcgtggctgccctcccggcagccgacgcggacgacgagaacggacccgcggttgtcaagggcgtgagcaaggaggattccgacagggcgtgctccgacgcggccatgctgctggcgaagctggcgctggcccggcggagcgccgataatgttagcgtggtcgtcgtggatctccgccgaggcatatgatgatccttggagcagagcaaaatcatatgctccatgattgctttcttttagcccttttcgaaatccaacctaatttctccc

SEQ ID NO: 433 - DNA, 2001 bp, Sorghum bicolor
gcctaagggaggtggtatttgttttgagcgggggactcgttctgggaggagatgttggtgctcttcgagacccccgcgggtttcgccctattcaaggtgttcgacgaggggaagctcgacaaggtcgaggatctatggaaggagttcacgacgtcggactcagcgagaaaggtggttgagctgaaggctttcaacaagtttgagaacacatctgacgccctatctgcggcaaccctgattattgatagcaagcctagcaagggtctgcgcaagtttttgcagaaacattgtgagggtgaaacattagctgttgccgattccaagcttggaaatgctatcaaagaaaagctgaaaatcgactgccttcacaatagtgctgtgatggagctgatgagagggctgagaaatcagctcactgagcttataactgggttgggtgcacaagaccttggtccaatgagcttgggattgtcgcacagcttgtcaagatataagctcaagttcagtcccgagaaggttgatacaatgattattcaggccattggcttattggatgatcttgacaaggagcttaacacttatgccatgagagttcgtgaatggtatggttggcactttccagagctcaccaaaatagttacagataatatacagtatgctaaagttgtgaagatgatgggcgacagagctaatgcagtcaaccttgacttctctgagatattgtcagatgaagagctagaaacacagctaaaggaggctgcagtaatatccatgggaacagaagttagtgaccttgacttgttaaatatcaaagagctatgtgatcaagtgttggccctttctgagtacagagcccagctgtatgagtatttaagaagcaggatgaacactatcgcgccaaatctgacagcactggtgggtgaattagttggtgctcgccttattgcgcatggtggaagtttgctaaacttggccaagcaacctggtagcacaattcagatacttggtgcagagaaggctttattcagagctctaaagacgaagcattctacacctaagtatgggctcatctaccatgcatccttaattggtaaagcttctcaaaagcacaagggaaaaatctctcgttctcttgctgcaaaaactgctcttgctatccgctatgatgcccttggtgatggcgaggacaactccattggcactgagagtcgactcaagcttgagacacggcttcaagttcttgaaggtagagaacttgggaaatctgctggttctacaaaaggaaagcccaagatagaagtgtatgaaaaggaccggaaaaagggtgctggggctttaacgactcctgctaagacatacaacccagcagctgatctggtgcttggacattctaccgaagaaacgccaaagaagtcagaactggcttcaaagaagaggaaacatcatgaggctgaaactgcaccatcagcagagcctgaagaggaggcaatccaggaggatggtgaccaggagggtcggaagaagaagaagaagaagaagaacaaggaaaccgaggagactcctgctgttgaagctgatggtgagaagaaaaagaaaaagaagtccaaggaggacggggagcctgtggctgccttggaaggtgagaagaagaaaaagaagaagatatctgatgcggatggtgagaatgttgcaatgcaaactgaagcgtctgctaagaaagataagaagaaaaagaagaaaaggcatgctgatgatgagtgagggctgtccggaaaatggtatcacagggttagaaaccatgttgagtttagtttccctttttttcgacctgggttgtattcaagtacttacactttctggattgatggatttaaattttgctgctgcgatctcataaataaattatgatgattgctcatggtaactgtgctgttggcgacctgaacgtgttggtagtataatgctatggaggcaacatgcaaattctctattgcctggcat

SEQ ID NO: 434 - DNA, 1557 bp, Sorghum bicolor
attcccaagcatcttctcttcccctccccctcccgcgctatatctctcctcccattgcgccgcactgctcccacacgctcggattcctgctcgctttctccgcctccgcctcggattccatcgccgccccttttccttccttcttccgttgcccgcccgcccaggactctccttcgcgcttcttagccagctccccgcccgcccaggactctccttcgcgcttcttagccagctccgtccttcgcaattcttcgccagccgtcggcgagagagagggaagggatcgctcgtgacttcgctcactcgggactcgggatcgcgcggcgccaccgtaccccgcctggacatgtgcgtggaggagctggacgacgcagcagggaggctcggcttcggagaccaggagatcgacaggcgcgcaggtgccgcgatggagagagtttgtgagaacacggtgtctgttgagttcaagcagactaagctgaacaactttgttccgttcatccggtcaggggattggtctgatatcggaagtcgcgattacatggaagatgcccatgtgtgcatctctgatctggcaaagaattttggctataactcggtggatgatgaagtaatttccttctatggggtgtttgatggccataatggcaaagatgctgcccattatgtccgtgataacttgccacgggtcatcgttgaagatgctgattttcctcttgagcttgaaaaggttgtcaagaggtcatttgtgcaaactgatagtaagtttgcagagaaattctctcatcagaagggactttcttctggaacgacagcacttacagcaatgatttttggaagatcccttctggtggccaatgccggtgactgcagagcggtgctctcacggcgtggcactgccatggaaatgtccaaggaccacaggccttgctgcatcaatgaaaggaagcgtgtcgagtcacttggtggctatgttgatgatggttatctaaatggtcagctggctgtcaccagagcacttggcgactggcatctcgagggcatgaaagagatgggtgagccaggagggcccttgagcgctgaaccagagctcaagatggtcacgctgacaaaggacgacgagttcttgatcatcggcagcgacggcatctgggacttcttctcgagccagaacgctgtggacttcgcgcggcggaagctccaagaccacaacgacctgaggctgtgctgcagggagattgtcgaagaggcgatacggcggggcgccagggacaacctgacggcagtgatggtctcgttccaccaggatgcccctccccagagcagatggaacaggactagggaaggcagcgtcgcacggagcatatccgccgaagggcttcacaacctcagagtgctcctggaaggccagtgacgcacggtggtgccattgctgccgttcattcctgatgtgtgctacgttgctgagtgttaactgtaagtagcgatttccggtatcttggagctgttatttcttccacggtcagtcgacatgccagggtgggtcactattcttgt

SEQ ID NO: 435 - DNA, 852 bp, Sorghum bicolor
cgagctgatcatcattcctttcacgacgcaaagaaggcaccaagaagaatcccctccatcgacgacgaaggggcgatgacgatgaggccgctgccgcagaccgtcgtccacctcctcccccccgtcgccgccgtgctcgcgttcgcgctcattggctgcctcgtgggcggcgccagcgcgacggtggtgacgacgtgcagggcggcggcggacagcgacgcgcgcgtggactacggcttctgcgtggcggagctgggcatgcaccgcgagagccccgacgccgacgtctggggcctcgccaaggtggccgcgctgacgggcgtcaacaacgccgacaacgccgtgtacgacatcaaggccctgctgctgctcgccgccgacgacggcgccaagagcaggtcgccgccgccggacggcccgacgcgcgcggcgctggagaagtgcgggaggctgtacgactccgtcgggttcgcgttcgccgaggcggacgacgagatcaacaaccgccgctacgccgccgggaagggcaaggtcgcggaggcggtgtccctcgcgcgccagtgcgacgacgccctcgccaaggccgccgccgtcccgtcgccgctggcgcagcacagctcgtacaacgtgaggattgctaatatctgcaccgccatcaccaacctcatcaagtgaatatactgctgtagtatatagtactgtaattacaggaacaggagcactcactttggtgcatccagaataaataacgtggtcgatcggcctgacaggtgacaggactttaaagtttgtataccttttgaaaactttgtacaaataatgaaaaaaaaggagttctgcgtcgagtaaagt

SEQ ID NO: 436 - DNA, 831 bp, Sorghum bicolor
ggaggaagtgataatggcgtcgtcgtgccaccacgtggatgtccccggcaagccgacggagacgggcacggcgctgctggagacggcgacgggcacgatccaggggttcgcgccgctgagccagatccaccagcacctgtgcgcgttccacttctacgcggacgacatggggcggcaggtggaggcgcaccacttctgcgcgcacctcaacgaggacgtgcggcagtgcctcatcttcgacgggcccggcgccggcgcgcggctcatcggcgtggagtacatcgtctccgaggcggtgttcctgacgctgcccgacggcgagaagccgctgtggcacacgcacgagttcgaggtgaagggcgggtttctgttcatgccgggggtgcccggcgtggtggagcgccgggacctggagaaggtgtgcaagacctacggcaagaccatccacttctggcaggtggaccgcggcgacgcgctcccgctcggcatcccgcagatcatgatggcgctcacccgcgaggggcagctccagcaggacctcgctgattgtgtggagaagaagttcggtgtgtccttccagaaggagagggagaaccgggcgtacatgagcgggccggagcacggcatccaccccctggcgaacgccgccggcaagggcctcaggaccgagatccgtgaagtcgatattccggcgagtactaccgccggtgccgggagggtcttcacttgatcgccttgtggatcgccgcggcggtgggtatgggaaatgtagtagggtgtatatagttagttagacggtgcttgctttggtccgtggttcgtcactagagt

SEQ ID NO: 437 - DNA, 1202 bp, Sorghum bicolor
gaaagccaaaggcatagaaaccagtcaagactcaagagcgagttccagtagcagtagctatagccgcgcctgttgggaaagccatctgtgtcgtcggcgatcatggaggatgagaggagcacccagcagcaccagggcggtgaggtccaggagaacgccgccgaggtgaaggacaggggactcctcgacagcctcctcggcaggaagaagcacgaggaccaggacaagaagcaggaggaggagctggccactggcatggagaaggtcacggtggccgagcccgagaagaaggaggaggagcacgaggccgccggcgagaagaaggagagccttctcgccaagctgcaccgctccagctccagctccagctcgtcgagcgacgaggaagaggaggtgatcgatgagaacggagacatcgtcaagaggaagaagaagaagggccttaaggagaagatcaaggagaagctgccgggccaccacaaggaccacgacggcgaccaccacacggccgccgtaccggcccccgcgcccgtggtggacgcgcacgctcaccaccaccaggaggaagagcacaagccgcagcacttcccggccccggcgccacccccgcacgtggagacgcacgtccaccagcatgaccacggcgtcgtcgtccagaaggtcgaggacgacgtgaagaccgagaccccacccccagcgccggaggaggagaagaaaggcctgctggacaagatcaaggagaagctccccggtggccacaagaagcccgaagacgctgccgctgccgcaccggccgtccacgcgccggcgccggcgccgcacgccgaggaggtgagcagcccggatggcaaggagaagaagggcttgctgggcaagatcatggacaagatacccggttaccacaagggcgaagaccacaaggacgccgccggcgagcacaagaccagctcctaaggtcgcccgcagcgtgtgtcctcctggccgggccatgatcgatcagaagcgttggcgtgcgttttgagttctggtttgcttttagcaagttaatttgtttcaaggtggatcgcgtggtcaaggtccgtgtgtgtgctttaagcccgaccggtggtactagcagtgaccagtgagtgttgatgcttgtgttggctttgggacgggctttagtttggttccaagtcagggtctggaactctggatgttgt

SEQ ID NO: 438 - DNA, 980 bp, Sorghum bicolor
cgcatacacagccacctgccagctttggcgatcgagcaacgacgacggccggccggccggacggacggtggacatggagcgcggcgacgactgccagttcatggtggtgcaccagtacgacgaggcggcacagctcatgcaccagctgatggtggcggccgcgggggaccagcaggaccccaacgcgggcgcggcggggcggggagccggcggcggcggcggggagaggaagcggcggttcacggaggagcaggtgcgttcgctggagacgacgttccacgcgcggcgcgccaagctggagccccgggagaaggcggagctggcgcgggagctgggcctgcagccccggcaggtggccatctggttccagaacaagcgcgcgcggtggcgatccaagcagctcgagcacgactacgccgcgctccgggcgcggtacgacgcgctccacgcccgcgtcgactcgctcagggaggagaagctcgcgctcgccaagcaggtggatgagctgagggggaggctgcagagcgtcagcgagcggcaagaccagagcggcagctgcgaggtcaacgacgccgcggacgacggcaagaggaacctaaatagcaccaccaccaccggcctggtgctggtgcaggaggacgatggtgccacgccgccggctgcagtagacgcctccggctccgaggactcggcggcgaccgagtacggctacgactacgactacgaccacgtcgtcgcgtacggcgagggcctgcacgatcccttgtgcgccactccggacctgtgggatacatggccgctgctggagtggaacgcggtggcatgaacccacgaccacgagcgaggaagaagcagcagtcgtgtactcgatcatctctcatgtctcttcttcttctgtatcgtcatagtgtacgtgtacgtgtggtggattcatggtgattcagttgatccgtggagagattgactgacgggaaacagat

SEQ ID NO: 439 - DNA, 758 bp, Sorghum bicolor
agatctcaccaccactccaacacagttggatcaagcaaagccgcgtagtgttttagtccgatagagcggtgaagggagccatgacggagctgttcgacacggccgtgaccagcctcctccacctgccggaggtgctggaccgcctcgccgccgcggacggcgaccggcgctcgggcggccaccacgctgcgcaccaccacgggcacgcccgcgtccacgggctcggtggcggcggcggcggcgcgccggtggacatcgtggagacccccggcgagtacacgttcgtgctcgacgtgcctggcctctccaagtccgacatccaggtgacgctggaggaggaccgtgtgctggtgatgaagggcggcagcgggaagcggaagcgcgaggaggaggaggaaggggagggggaagggtgccggtacatccggctggagcgcggcgcgacgccgcggtcgttcgtgcgcaagttccggctgcctgaggacgcggacacgggcagcgtcgcggcgcgctgcgagaacggcgtgctcaccgtcacagtcaagaagctgcccccgccggagaagaagaccaagtccgtgcaggtcaccatcgcctagaagtcggtcggcgctggcagtgtagcagagtagcagtagaatcgtacgtagtggcatggcatgttgggtggggtgctcttttgttcacgtttgtgctgatctgatggtgaaggtgagctcgggggtgtgtgaccgtgcttggaatgaaatggaatcgtc

SEQ ID NO: 440 - DNA, 2110 bp, Sorghum bicolor
tcctctccttgcagatgtttgcattcaattattttcgtccctgccatggcgagctctcttccagttcacgatcgacttgctgccgccatgcacggccgccgtttgttcaccgtcgtcgtgctcatcttcgcgctggtcacgccgccggccgatgcggtcaccgcggcctgcaacagcaccggcggcacctacacgagcggtagcgcatacgacatcaatctcagtcgagtcgtcggcggtctccccaccaacgcctccgcctcccctgagctcttcgccaccgccacggtcggcaccggcggcggcgacaaccagaccgtgtacgccatcgggctctgccgcggcgacatggccgccgactcctgtctcctgtgcctccagtcgagcttcagtgacgcccagggcttctgcccttccgacatggacgtgagcatggactacgactcctgccacatgcgctactccggcgccgacttcctggcggcgtccacaaacaactcggtgcagcaggccgtgttcagcagcttccccgccgtgaccccctcctccgccgccgccgcgttcaacggcctcgtggcccggctcctcaacgcgacggcggagtacgcggcggccaactcgagccggaggttcgccacgggggtgatggaggtggacagcggctactcccaggggaagttctccaacatcttcgcgacggcgcagtgcacgccggacctgacgccggcgcagtgccgtgggtgcctggcggcggccatggcggacatgcccagtcaggtgtacgctcggaactcgacgggggcgagccttgttggagagcgctgcggcttccgtttcgccccgtatcagttctacaacggcgacatcatggtgcagctgcgagttggtgagcctccagcaggaaaaaagacagcaacgactctagttctagcaatagtacttgcagtactgggtggactatgttcactcacattaattatattttgccattggaggaagataaggtcaccaagaaaatcgtcactcttcataaatgtagaagacatagaaagttttgagtccatctttatcagtctgtccgtacttcggtcagcaacaagcaactttgatgaaaagaacaaacttggtgagggaggattcggtgttgtttataagggtgccctgccagatggccaagaagtagcagtgaagagactctctgagaccacaacgcaaggactaggacagatgacgaatgagctagctttgctagctaagctgcagcacaggaatcttgttaggatcgtgggtgtttgcttggaggaaggcgagcatttgcttgtgtatgattacatgcccaacaaaagccttgataccattatctttgatcctgataaaagcaggcagcttgactggggggcgcgattcaaaataataaatggaattgcccgaggcatgcagtacctgcacgagcattcccagctgaagatagtccaccgtgatttaaaagcgagtaatgttttactcgatgcagacatgagacccaagatttcagattttggtctggcaaagatttttgaggacgatcaaaccagacatgtcacaagccgcatcattggaacacgaggttacatgtccccagaatatgccatgcgtggacagtactcggccaagctagacatatttagcttcggtgttctagtcctggagatagtgacaggccgaagaaacaactacgcagtgaactctgagcattctccaaacctcttctgtcttgtgtggaagcactgggtggagggaacaatcgcacagatagcagaccctagtctgggcaggcactaccccatggccgaggttctcaaatgcatcaatattgggctgctttgtgtccagcagagccctacggaccggccatcgatgtcggcgatcgtagtcatgctcagcagcgacaccgttgccgtggaagctccctacaggccagcttatgtcgacaggagcaggagctacacggagatgacagtagagcttatcaaggaaaaggaagagctgtgttcgcctcagtcgtccatcacagagctcatgccaaggtagacagagaatttcccagagtaaatatccatctgcaggaaca

SEQ ID NO: 441 - DNA, 1233 bp, Sorghum bicolor
accgcaccaaacaaacaagcaaagctgctcaaaaccaagcggcagaaaaatgtggaaccccaaacccttcctcgtcctcatctcactctgcatctcggcgtcgtcgtcaccatgcacggcagccagtgccgccgccgccggcggcaagccccttgtcaccgccgtcaccaaggacgcgtccacctccctctacacggcgccgctcaaggacggccacccgctgctcctcgacctcaccagcccggtcatctcgctgacgacgtgcacctccaagaacggcacggtgaccacgctctccgcgaacgccaccgacggccagaacccgctgttcccggtctccttctccgccgtggcctcctgcacgccacaggcaaaggtccctgccggtgccgtcggcgtcgcgggtctcgcgccgtcgacgagccagtcgttcccggcgcaggtggcgcgcacgcagaaggtcgccaacaagatcgcgctctgcctcccgagcgacggcaagtcgacgaccggcgacagcgtcggcgtggccatcttcggcggaggtcccttggtcttccctgaccgtggcgacttcaccacgatgctggccggcacggcgtcgctgcaagggttcaacggctcccctgggtacttcgtctccgccaccggcatcgccgtggagcagagtcgcgtcggcacctcctcggccggcggctcctcgctggtcgtggcgctgagctccacgacgccctacacatctctccggcccgacgtgtacgtgcccttcgtgaacgcgttcgacgcggcggcgaccgggccaaacttcccgtggatgtcgagggtggccgccgtcgcgccgttcgagcggtgctacgactcgacgaagctgccgccgacgcggctgggctacgccgtgccgcagatcgacgtgatgctgcagggtgggcagaactactcggtgctcggcggcaactccatggtgcaggtgaacggcaacacggcctgcctcgggttcgtcaaggcggcggccggacaagcgccggcggcggtcatcggtgggttccagctcgagaaccatctgctggtgctggatgtggagaagaagcagctcggattcaccacgttcctcaatgccgtcgggctttcgtgcagcaacttcaatttcactcttgctggctagtgttgaagcagcaaggtgctgagttgtactcgtatagtgtaataagaacttgtgctgcagtgtattaccac

SEQ ID NO: 442 - DNA, 913 bp, Sorghum bicolor
ttacgcttgggttggcagcatgcacttaaaaagcagcaccacaccacacgccaagaaattaaaaagcaaccggccaacgagtcacagcatagagatgacgctcccgcgccgccgccaccttgtcctgctcgccggcctcctggtcctcgtcgtcgtcgcggccaccgccaccgcgtcgacggattcctcttccaccacggcggtggcggtggacttcgtgcggcggtcgtgccggtcgacggagtacccacgggtgtgcgagaccacgctggtcccctgcgcggcgagcgtgggtcggagcccgcggcggctggcgcgggcggcgctggtggtgggcgccgaccgcgcgcgcaactgctccgcctacatccacggcagccgcagcggcagcggcggggcgatgaaggactgcgcggagctggcgcgcgacgcggaggaccggctgcggcagtccgcggcggagatggagcggatgggccgcgccggcaccccgcgcttcgcttggtccctcagcaacgtccagacctgggctagcgccgcgctcaccgacacctccacctgcctcgactccctcgcgcagcacaaggaccgcggccgcggtggcaagggcagcgacggcgacgacgatgccgtcagggtgaagaggagggtggtcgccgtcgcgcaggccaccagcaacgcgctcgcgctcgtcaacaggctccagccggcgacgcaccggcagaggctcctcctgtgactctctctctctctcgtagctgcagcttgctatggaagtcggtgctgctgattcctcatcgatcctcctcgctccatgtccgattcctcacttcccctgcatctccttcgccaatcccatgtatgtatgtatgaatgaatgtatggactatggatatggttcgatcagcttgct

SEQ ID NO: 443 - DNA, 1255 bp, Sorghum bicolor
gtccttcttaaaggcgcaggcgcaggcgcgcacgcacggcgacaccacgcctgcgttgcgttggctgatcatggcggcgagagctcatcatctgctcctgcgactcgcgctgctgtgcgcgtgcgcgtgcgccgccgccctcggctcggccaatgcggcggggaggaagatggtcggcgtgtacgagctcaaggcgggcgatttctccgtcagcgtcaccaactggggcgccaccatcacctccgtcgtcctcccggattccaaagggaatttggctgacgttgtgcttggctatgacaccattggaggatatgtgagtggtaaaagctactttggagcccttgttggacgagtagccaacagaattgcctatgcacgcttcgtgcttgatggaaaagcttatcatctttttaaaaacgatggcaacaacacacttcatggtggccataggggtttcagtcaggttatatggacggttaaagaatttgtcgccggcggtgactcgccctacatcacactgtactaccatagtttcgatggagaacaaggtttcccaggcgacctggacgtgtacgtgacgtacgagctggcgtccccgtacgagctgcgcgtgcacatgaacgcgacggccgcgaacaaggcgacgccggtgaacctggcgcagcacacgtactggaacctgggcggggagggcagcggcgacgtcctccacaacacggtgcagctgttcgcgtcgcggtacacgcccgtggacagcgcgctcatcccgacgggcgtcgtggcgcccgtggccggcacgccctacgacttcctggccccgacgcccgtgggcgcgcgcatccgccaggtctccggcggcaaggccggcatctacggctacgacaccaactacgccgtggacggggacgacgccggcgccggggcggcgctgcggaaggtggccgtcgtccgggacggcaagtcggggcgggcgatggagctgtgggcgaaccagcctggggtgcagttctacacgggcaacttcctccaggacgtcgaggggaagggcggcaaggtgtatggccagtacggcgcgctgtgcctcgagacgcagggcttcccggacgccgtgaaccaccccagctttccctcccagatcgtcaggccggggcaggtgtacaagcacgacatggtgttcaagttctccttttagctagcaagtcacaataatttccatcagtttcgcaaagctgaatcgtttgcgttgttcaaatag

SEQ ID NO: 444 - DNA, 2341 bp, Sorghum bicolor
catccaacacctaaacccctcgccgccggccgctccgattccggcgatgtcgtcgtcgtcgccgcctcgcaggccgcagcgccgcgcggcgtcgacgcgccctccgtcgtacgacgagtccctcctcgacgccgagctggagggcttgctcggcgacgccgcctcgcgccgcgtgcggcggctgcgccggctgtccgcggaggagcggcagcgggagacggagacggaggcgctcatcgcgctctctctgggtttccccatcgacgagctgctcccggaggagcggcccctcctcccgccccacatcgccaacgcgcccaacgactacatcgtcgtccgcaaccacatcctcgcgtcctggcgcgccgacccgcgcgcgccgctgccgctcggctgcgtcctcgagaccgtcgcctcctcctacgaccgcctcgtcgccgcggcttacgggtacctcgcccgcgcgggccacatcaacttcggcgtctccgccgccttccccgccgcgccgcccccggacgccgccacccagggcgccgcggccgtcctcgtcgtcggcgcggggctcgcgggtctcgccgccgcgcgccagctcctccgcttcggtctccgggtgctcgtccttgagggccgctcgcgccccggcggccgcgtctacacggcccggctaggtgaggataaggccgccgtcgagctcggcggcagcgttatcactggtatccacgccaacccgcttggcgtgctcgcgcggcagcttggtcttccgctgcataaggtgcgggaccgctgcccgctctactacccagatggccggattgtagagactaggctggataggaccattgatttggtgttcaacacgcttctcgaccacgccaccaaggttcgggagtctcttaatgaagctgcagagaggatttcgttggaagaagccatagagaaactcaggagactctaccatgtggccagaacggatgaggagcagatggttttgaattggcattttgcaaatttggaattctccaatgccggctgcctatcagagctttcactcgcgcactgggaccaggacgatccttatgagatggggggagatcattgtttcttagctggaggcaattctagactcatacatgcattgtgtgatggggtgccggtactctatgagaagaaagtgtcgcgaatcgagtatggagtggatggggttagtgtcacagtggaagaagggcagatttttcaagctgatatggttctctgcaccgtgcccctcggggtgcttaagagtggaagcatcgtgtttgacccagagttgcctcaggagaagcttggggcaatacagaggttgggatttgggttgttggacaaggttgccatggtgtttccccatgtgttttgggatgagaatattgacacgtttgggtgtttgaataaggatagcagcaagcgtggggagttcttcctcttctacagctaccacactgtctctggtggagcggttcttatcgcacttgtggcaggagaggctgctttggagtttgaaaaggttgatcccatcgtttcacttcatcgagtacttggcattctaaaaggtatctatggcccaaaaggtgttactgttcctgatcccattcaatctgtttgcacgagatggggcagtgatcctttttgctcaggttcatactcacacgtcagagttgggtcttctggtgctgactacgacattcttgctgagagtgtgaatgaccgactctttttcgctggagaagctacgaatcgcgcataccctgcaaccatgcatggggccttattgagtgggttaagagaagcttccaaaattcatcgtgcctcagaaagcttagtgaattctgaccagaagaagaattcattgcctaaaaggctcaaaccacccaatggtgcccttttggatctgttcttggagccagacctagaattcgggagattctcattcgtgttctcctcattgacacctgatgatccagaggctacagggatacttcggttttcacttgacaagcgtttctttctgcagcccaataatccggagttagatggggatcaaaaggactacagctctgcatctggggccttccatttgtatgccactgtctctcgagagcaggcagatcagctacagaagtcaagcgaagatgatagaactaggctaggagtgttatgcaaggattttagtgtaaagctaatgggttatgataatacatgcgatgtaggtagcgatctgatttcgagcatcttgagtgcacggaaagccaggaaactgctgcagcacccaaagaacttcaagatctcacgttgatgtgtatga

SEQ ID NO: 445 - DNA, 2422 bp, Sorghum bicolor
acgtatcacctgtttctccacctctctctaatttgcggcacccggcgatcatgtggaggctcaaggtcgccgagggtgctggaccatggctaaagtcctccaacaacttccgcgggcgggcggtttgggagtttgaccctgagcttggcacgccggaggagcgcgccgaggtggagagggtgcgccgggagttcacggagcgccgcttcgagaagagggagtcctctgatctcttattgcgtatgcagtatgcaaagcataaacatcttcaggtggatcctccacccaccaagctcgcagaaaatgtagaagtcacagaggagatcatattagcggcattgaggcgagccctcgatcaacattcaagtctgcaagcagaagatgggtgctggccagccgactatagtggcattttgttcattatgcctctcctggtattcgctctatataccactgggtcactcgataccgtcctatctaaagaacatcgacgtgagatatgtcgctatatttacaatcatcagaatgaagatggtggctggggtaaacaagtgttgggaccaagcaccatgttcggctcatgcttgaactatgttgccttaagacttattggtgaaaagcccacgaatgctgcattgaccaaaggacgtcagtggattttatcccatggaagtgcagctgcaattccacagtggggaaagatatggttctcggtgatgggtttgtatgattggtctggaaataatccaatagttcctgaattatggcttgtcccacactttcttccaattcatccaggacgattttgggtattttgtcgtatggtgtatctgcctatggcttatctctttggtagaaaattcatcggaacgattactccaactatattggaattaagggatgagctctattccgtaccatacagtgaggttgattgggaaaaagctcgtgatacttgtgccaaggtggaccttatatatcctcgaacaatggcacaaaatcttgtatggacctgccttaataaggttatagagccaatgctgaattgttggccagtaaataagttaagagatatagcattgaaaaacatcatgaaacatatccactacgaagatgaaactagtaaatacatctgtacatgtccgataaacaaggcgctagatatgatttgttgttgggcagagaatccaaattcagattcattcaaaaaacatcttccaaggatatatgatatgttatggattgcggaagatggcatgaaggcacaggtctatgatggtaatccaacatgggagacttctttcattgtccaagcctattgctccacaggtcttgttaatgagattggttcaacactccgtaaagctcatgaatttattaagagttcacagatttgtgagaaccaccccgactacaaaacttactaccgtcataaatcaaaaggttcatggacactttcaacagcagataatggatggtcagtatctgactgtactgctgaagcagtgaaggcattgatgttgttatcaaagatttccccagatcttgtgggggaacccatagaaggacaaagtttgtacaatgcagtggattgcctactttcttatgtgaacaatgatggcaccttctcaacatatgagtgtaagagaaccacacctttattggaggttctcaacccttcagagagctttataaatattgttgttgattatccatctgttgaatgcacatcatcagtgctacaagctctgattatgttcagagacctagatcatgggtatcgcaaagaagagataggaaattgcattgaaagcgcaactaagtttattgagaaagaacaacgaaaagatggctcctggtttggcagttggggtgtatgtttcacatatgggtcgttctttgcgataaaagggttagctgcttctggaagaacttacaaaaatagtgataccatcaggaaagcatgtaactttttgttgtcgaagcaactacatacaggtggatggggagaaagttatctttctagtgaaactgaggaatatgtggatgctagtagacctcatgctgtgaacactgcttgggcaatgttagccttagtttatggtgggcaggtggaacgtgatccaacaccattatataaagctgcaaaagtgttgatcaatatgcaactagaatctggtgactttccacaacaagaacatgttgggtgctttaatagttctttgtacttcaactacgggaactaccgcaacttgtatcctatatgggctcttggggaatttcgtcaacggctccttgcaagaaagaagtgaaaccaaaatccatgaaatctaggctattttactttattacaaagaatatacaaaatgttcagaattactgttatatgttagtaattgtgcttacggtccggttatgatag

SEQ ID NO: 446 - DNA, 860 bp, Sorghum bicolor
ccattccattccaccagtctatctatctcattcccaaattttcctcatcggcttcgcttcccccaaatcgaatccccatcgctctgctccatccatggcaactctcaccatgcagccgatcggtcccacccccgccccggctgcgcaggaagaccagaggaacggggagaatcttcctaccgtggatgctaccgatttgagtgacatcgactcgggttgggttatcctcaagaactcggatattgtttccgcggatttggcagccgccgccgtcagtggaggtcagcgtctaggctcttcaacgattcctagctgggcacggtgggttctgggaggtgtggtgtacacggtcgtgccgttctacaacagagttaggcatctcgaagacgagaccgtggggttcgtggagaatgctgtggaggttgtggagcatatagctgaagtaacagagaagctagctgcgaatgtggctaagcaacttcctgaagatgggtctctgcagaaagcagcagaggatgttgagcacattgctgaggtggtggatgatgatgcagagaagtttgaagcagtcgctgaaaagatcgacaaggtctgtgatgagattgatgctgctgtggagccagtcatcgaggagcttgaaaaggaacttgatcagagtacaacgtctgagaaaggagttgacacaaagaattgatcaacatcatgttaggggtactcctcattgtatatagcgtctgtactattgtttttcttctctcctctttggaaaaactgcttgtacatatgtatggtgttgtgtatgaactgcacttgcaagatgcaacccaccatgatcatagtaaggcatggagattgtgtgc

SEQ ID NO: 447 - DNA, 633 bp, Sorghum bicolor
tatacaaccgacatcgaagaggaagagaggctgctgcggcggcatccatggcggcgctggcggtaacgacgacggcgacgacgagcagcaggcaggtggaggaggcgccggcggggcggatgtcgtccatagagtgggagcccaagacgctgaccctcgaccagatcaagttcgcaagggaggcggcgctgtacgtggtgagcaccaagacggaggaggaggcgatccgcatcttcaccgagggcctcaagcccgtgcagatgacgacggcgaccgtccgcaagtccagctccatcgactcctcgtccgacgacgacgtcgagctcggctgctgctgctgctgctcctccgccggctccaacaaaggctgttgcggcggcgggagcaaaggcggccgccgtggtcgacggcggcgctccatggacgacgacagggacgtcgctacggcgccattctagtagctacctagttgttcttttttttccacttcttattatagacgtaagtaaagctattagctgcgtgcgtactaggaatagtctagagtctacctgtgtgtgtgtgtgttttttttttacctcgcctgtttttacttggttatcctttggctggcctctggttcgtttgaaggag

SEQ ID NO: 448 - DNA, 1756 bp, Sorghum bicolor
gccactcagttggttctctccctcctcaatcgggaccgagagctaaaacctagcccgcgccggccatgtcccgccgtgcgccgttctccaacctggaccccgcgacggcggccgacacgcggcgccagcgctacgaccagcacgagcaggacgggtacatggagcatctcctgccgtacatccacagctgcgtccccgacccgcccgtctccaccaccgcccgcctcgtcgcccgccgcactggcccttccgacggcgtcgaccgcatcagcagcctctccgacacgctcctccgcgacatcgtctcccgcctccccttcaaggacgccgcgcgcaccgccgtgctcgccacgcgctggcgcgggctctggctcgccgcgccgctcgtcgtcgccgacgcgcacctcctgaaccactggcccccgacgcccgccgacgcggcgcccgtcaccgccgccgtgtcgcacgccctcgccacgcacccggggcccttccgctgcgtccacctcgtctccacccgcatggacgcgtaccagccccagctcaagcgctggctccgtctgctcgccgccaagggcgtccaggagctcgtcctcgtcaaccgcccgtgcccgcgggaggtgcccctccccgacacgctcttccggatcgccaccctcacccgcctctacatcggcgtctggaagttcccagacgcggcccacctccaaggcgcctcctttgccaacctacgcgaactcggcatcttcagcgtcgtcgtggaggacggggacatcgactctgtcgtcgccaggagccccgtactggagatcctcaacatccaagggaccattaaggggttgcgtctcgtcggcaacagccttcggtgcgtgcagatctgcgcttccgtggtggagaacattgccgtggtgcacaccccttgtctcgagcggctcatcctgtgggacgtacggggatctcccaaccctgccagtggcttgtgcaccaggatcaagattggaaaagcccccaagctgcgcattttgggatatctggagccaggaaaacacgtgctagagattggaggcaccaccatcatggctggcattaaaccaagcgcaagcacaatgctcaggacggtcaaggtcctgagcatcaaatcgtgttttggatccaatgacaccaagatgttgcctgacttcctgaaatgctttcccaacgttgaggctcttcacgttatttctgtcaaatgtaatgaacctggtgacaagctcaacaccaagttctggcaagaggctggtcccattgtaagtgtgcttatgcgcatcaaggtgatgacagtccgtgagttccgaggggagcaacatgagcttgccttcctccagtatttctacgagaatgcacgggtgttgaagtatgcatcagtcgtggcagccaatgcaagggtcactggaatatcagacaaacagatgttttccattctgcagaatatgaatgatgcaagatgggctagtaaatttggactggctatcatgggaagcaatggtcccgaaggaggtagaccctggatgtttgaacgaggatcaaatttttctgatgatgacccttttgcaccagttaaatttcttgaacatggccctgcctctgcgccaagatagaacaagactgcttgtggtggcacacgctgcatctgagatcttcaacctatgaagcatgcatgtgttctggttctgtaatgagtaactactcttgaagattccctcccgttcttagttct

SEQ ID NO: 449 - DNA, 1906 bp, Sorghum bicolor
agagcacgagatcgtagcagtcaccacgccaacaaaagcagcaaagcaaaagctaccgtcaccgacccgacgttccaagaaacgaaacggccatgatgatgatgggagagggagcttacgcgccgccgtggcagcagtcaccggcggccagcatggacgcggatgaggcggcgtcgccgtacgccctcctggcggcgctgcagcattacctgccgtccaacgaggtgtcggcggcggcggcgccgtacgacgaggacgacgaggaggcggccctggcggccggggtggacgcgtacgcctgcgacgagttccggatgtacgagttcaaggtgcggcggtgctcccgcgggcggagccacgactggacggactgcccctacgcgcacccgggggagaaagcccggcgccgcgacccgcggcggtaccactactccggcgcggcgtgcccggacttccgcaagggcgggtgcaagcgcggcgacgcgtgcgagtacgcgcacggggtgttcgagtgctggctccacccgtcccgctaccgcacgcagccctgcaaggacggcaccggctgccgccgccgcgtctgcttcttcgcgcacacgccggaccagctccgcgtcctgccgcagcagcagcagtccagcccgaggggcgcgtcggcggcgtcgccgctggccgagtcgtacgacggctcgccgctccgacggcaggcgttcgagagctacctcaccaagagcggcatgatcatgtcgtcgtcgccgaccagcacgctcgtctcgccgccgaggtcgccgccgtcggagtcgtccccgccaatgtcgccggacgctctccgccgcgggtcgtggccgggcgtcggctcgcccgtcaacgaggtgctcgcctcgctgcgccagctccgcctcggcgcgggcggaggctcgccgaggtcagccccatccagcgggtcgtcgttcttggccggcggcagcggcggcggctacccgttcgggtccccaaagtcaccggcggctgggctgtacagtctcccgtccacgccgacctgtaggccgtccccggtgacggtgaccaccgcctccggcgccaccatcatgaccgtggaccgcctcaacctcggactcatcggcgacgaggaagagccggtcatggagagggtcgagtccggcagagccctccgcgagaaggtgttcgagcggctcagcaaagaagccaccgtgcccaacgacaccgccgcctccgccaacgttgagggagcagctccggatgtcggctgggtctccgacctcatcaactgatgagggaaactcatgaaactatcagcatcaaccgtgcctcctctgaaactgtgcttagccatggtaagtgggaagcttggaggcatcactgcacaacaggagaagaaatttcaggggaaaaaacaaaaacaaaaaagatttttttcttagatttctactaagattctcctgatctttctacatatgttcctctctgtgtgaatattcttggatggatggttgttcaagggagggcagggaggtaagaggcaggaagacgggcatgtcagtgaagtgtgaaggtagaagaagcctaggaggagacaagaggtggcagcaaaacatggtgtggggaaaatggatcaagaagacatggcaggcgaccatgcatgtatatgagttatctagatgtacatagcgtatgtgttcgtgtgtgcgtgtgcgtgtgtggaggtgtagcgtggagggaggcgatcatggcggcgatccaagaccggagaagaagaagactgggatttatgtcaccgccggcgcctccggtgaggttatccgggaagcaggcctggaacttctaatttccgcaagcgattccagaaaaagcgtcgtcttttgagttgatgtttactcgcattcca

SEQ ID NO: 450 - DNA, 1841 bp, Sorghum bicolor
aaactcgagggcggcaaataagaggaatatagaagaaatagcaagagccccgagccagagggggcaacgaccaacggcacgccgccgccgccgccgcggacgctcgtgctgaggtcggtcgccgctgccacgacacgaggcgatggcgcggttcatcctgagcctgatggagctcggggtcagcgccaccgtgcacatgctcttcggcctctacgtcttcagcacggccgtcgccgccgacatctcgcaggccgccgcggcgtcggggtgcctcctgctgcgccgcccatgggcgcctcccgagggagcgccgctcgtcgacgtcgccgccgcgggggagagtgacgaccgcaggggcgccgcgcccgtcatcctccacgcctcgccgccgcccatcgtcctcgtccacggcatcttcggattcggcaaagggaggctcggtggcctctcctacttcgccggcgccgagaagaaggacgaccgcgtgctcgtcccggatttggggtcgctcaccagcatccatgacagggcgcgcgagctgttctactacctcaagggcgggcaggtggactacggcgaggagcacagcaaggcttgcggccacagcaggtttgggagaatatatcacacagggcactatcctgcgtgggacgagcacaacccggtgcattttgtcgggcactctgctggcgcacaggttgtgagggtgttgcatcagatgcttgccgacaaggctttccctggtcatgatacttctgaagattgggttctgagcctgacttccttgtcgggcgcacttaatggaaccacaagaacttactacgatggcatgctggttgaagatggtaggtccatgaaatatatctgtcttcttcagctctgccggctcggagttattgtgtacgattggctagatattccttggctgaagaattactacaattttggttttgaccactatgagatgtcacggaggaaagtaggcttttcaggtctaattaatctgcttgtggggcacacaggcccatttgccagcggagattggattctacctgaccttacaatccaaggatccatgaaactaaactctagacttaggacctttcccaatacattctacttcagttatgctacaaagaaaacaagaaaattatttggaattacagtgccttcaagtgttcttggagtgcaccccatgctctttctgagagtcctccagatgtgtatgtggcggcaccctcaaagtgcacctctgccttacaaaggatacagggatgaagattgggaagacaatgatggggctttgaacacaatctctatgacacacccccgcattcccattgagcatccacaccgtctggtagtggacgattctgactgccatcctttgcaacctgggatatggtattacaagattattgaagctgaccacattctattcattgtgaatcgcgaaagagctggagtgcagtttgatttgctgtacgatggcatttttcagcgttgcagaaagcatgcctttaggaagagcccacctactgtaccaaacgaaacaagtcaatagcagatacgaagacaaagtatttgtaggtagtacataggaagaagagaaacaaggtgccacagcatttttattaactgtaaattatattgttgattgaacgggaatagcatatttgcttctccaattcttggaatggggttcaaggagactgggatcaaattaatgctccgccatacagtctaatgcaaggagatttgccttgcagtgttgatttaccatgaatgaacaggagacgatggatccgcagttgcctatggcctgactgtaggaattcttt

SEQ ID NO: 451 - DNA, 1174 bp, Sorghum bicolor
cctagttggagtccgatattgctggaggtcgccgcgttccaaaatccgttaggcaatggcgccccctctcctctcgccgccggtgctcgccgacgcactagcgacgccgccacggtctttcccctgctccctccccacgcggcgactgcctaccgtcgggttcgccggagccgtacggagcgacctgcagcagagctggagtgcgcggaggagggatctcagggtctgtgccactgcgacggaagcggatcatgaaagggaggaggatgtcgccgacgattactactccgttctgggtgtgatgccagacgcaacccctgaggaaattaagaaggcatactacggttgcatgaaagagtgccaccccgaccttagtgggaacgaccctgacgtgactaatttctgcatgttcattaacgaggtttactcggtgttgagtgatcctgcacaacgtgcagtgtatgatgagatccatgggtacacagcaacagcaatcaaccctttctttgatgacagtgcacccaaggatcatgtgttcgttgatgagtttacctgcattggatgtaaaaactgtgccaatatctgccctggcgtctttgagattgaggaagattttgggaggtcaagagtctactcccagtcaggtagcacagagctaattcaggatgccattgatagttgcccagttgattgtattcactggacttctgctgcacaactgtcactcctcgagaatgagatgcgtagagtagagagggtgaatgttggtttgatgcttgctggtatgggagcttcagtcgatgttttccggatggcaagtgctcgctgggaaaagaggcaagcaaaagtcttgggaaaagtcagaacacggatggtgaaacaagagaattcagacacgagaagctcttggagtgacatttggggatccccaccacaagatcaaagcaacgaggaggaagtatcagagagggccaagagagcggcagctgcagctagacggtggcgagagttctccagacgaggcgcagacaggcctccgacacacaagctcccggagtcagtgggcagcaaagattaattagtccgtggaacagagaaacatctggcatcattaatttgaccatatctggcatattggctaaaatgtacagtgtcgttgtttgatacgtacgga

SEQ ID NO: 452 - DNA, 429 bp, Sorghum bicolor
acgtacgcgtgcttctcgatcgatcgatcgaacctgcagcaggtgtccaagcgtcatggcggcagcgagcagggcgtctctggtgctgttcctggtggtggcgacgagcgcggtggtggcgagcatgctggccgtggccccgggcgcgggcgcggcgacgacggcgtgcgtcccgacgcagctgaccccgtgcgcgccggccatcgtggggaacgcggcgcccaccgcggcgtgctgcgcgaggctcaaggcgcacccggccagctgcttctgccagtacaagaagaaccccaacatgcagcgctacgtcaactcccccaacggcaagaaggtcttcgccgcctgcaaggtgcccctgcccaagtgctgaatcaagtgcatgcaccatgcatgcctgcccccagtagtgccctagtctgttccttgtcg

SEQ ID NO: 453 - DNA, 1290 bp, Sorghum bicolor
gtttcttctccgtcgctttgcaagcgaggacagatggacggatacatgagggagacaagcgccgccagggatgagggcggccccgccgtgtgcaaggctgtggcgggcgggaacgtggaccggaagggcggcgcgtccgcaaggcgccgccgccgcctcgagctccgccggctcgggcgggccacggaggggtcacccgtgccggcgaagaggatccggtcgggttcgcacagatcgtcgtcctccgactcgtcgctggagactgcggcggcgggctgctggccgccgcgcctgtcgcacggcgccgtgtcggtgatcggccggcggagggagatggaggacgcgttcgccatcgcgctctcgttcctggcctcggacccgtcgtcgccgggcgccaaggacgagcaggagcaggacttcttcgcggtgtacgacggccacggcggcgcgcgggtggcggaggcgtgccgggagcggatgcacgtggtgctggcggaggagctcggcctgcggcgcggcgtcggcagcgacgacctgcgctgggaggaggccatggcggccagcttcgcccgggtggacggcgaggtgaccggcggcttctcgcccccgcccaagccgccgccgcagcagacggccgcggacgccgccgacaccaacgccggagcaggcaacctgccctaccgcaccgtgggatccaccgccgtggtcgcggtcgtgggccaacgccgcatcgtcgtcgccaactgcggcgactcccgcgccgtgctctcccgcggcggcgtcgccgtgccgctctccaccgatcacaagccggatcgtccggacgagatgcagagggtggaagcagctggcggcagagtcatcaactggaacggctatcgcgtccttggagtcctggcaacttctaggtccattggcgactactacctgaagccgtacgtgagcgcggagccggaggtgacggtggtggagcggacggagcaggacgagttcctcatactggcgagcgatgggctgtgggacgtggtctccaacgagatggcgtgcaagatcgctcggaactgcctcaacgggcgggcggcctccaagttcccggggtccgtcgccggccgcaccgcagcggacgccgccgcgctgctcacggagctggccatgtcacgcggcagcagggacaacatcagcgtcgtcgtggtcgagctgcagcggctcaagacgagccctggcgcggcctagtgcaagttgttggtttttgctgagactgaactgagagcatgtagctgtagcgtgtag

SEQ ID NO: 454 - DNA, 1673 bp, Sorghum bicolor
ggaagcagaggatgcagtaatagtaagtgcagatagcaagatacacagccatggttgtttcgccaatattgtttctcttgttgggttgtccaacttcccgtgcagctgatgaagaactcgagctcactgtcgtggacgtgagcttgctgcaggaaccgcgtgccagctgctccggacacagggtgatgccaccccacccctacaacaacagctgggtgccgctgtttcgtcctctcggcccgtgctcgccgtcgttcaagggtgcggcggcggcggcggcgaggacgaagccgtcgctggccgacgtgctccggcaggaccggctccgcgtccaccacatccatagaagggtgtccggctcctcccgcggtgcgcgcgcgagcaagggctccttcaaggagcccgtgtctgtcgaggaaacccagctccaccaccaggccgccatttccgtcgaggttggcacttcacagacgagctccgagcctagtagcggcattcatccggcggcggccaccgacggcagctcaagcccgccggtgacggtggtgctggacacggccggcgacgtgccatggatgcggtgcgtgccgtgcaccttcgcgcagtgcgccgactacgacccgacgaggtcgagcacctactccgccttcccctgcaactcctccgcgtgcaagcagctcggccgctacgccaacggctgcgacgccaacgggcagtgccagtacatggtcgtcaccgctggcgactcgttcaccacgtcggggacgtacagctccgacgtgctcaccatcaactccggcgaccgcgtcgagggcttccggttcgggtgcagccagaacgagcagggcagcttcgagaaccaggcggacgggatcatggcgctcggccgcggcgtgcagtcgctgatggcgcagacgtcgtccacctacggcgacgccttctcctactgcctcccgccgacggagaccaccaaggggttcttccaaatcggcgtgcccatcggcgcgtcctacaggttcgtgacgacgccgatgctcaaggagcgtggtggggcgtcggcggcggcggcgacgctgtaccgcgcgctgctgctggccatcaccgtcgacgggaaggagctgaacgtgcccgcggaggtgttcgcggcggggacggtgatggactcccgcaccatcatcaccaggctgcccgtgacggcgtacggggcgctgcgagcggcgttcaggaacaggatgaggtaccgcgtggcgccgccgcaggaggagctggacacctgctacgacctcaccggcgtccgctacccgaggctgccgaggatcgcgctcgtgttcgatgggaacgccgtcgtggagatggaccggtcggggatcctgctcaatggctgcctcgccttcgcgtccaacgacgacgacagctcgccgtccatccttggcaacgtgcagcagcagacgatccaagtgctccatgacgtcggcggcgggaggatagggttccgcagcgccgcctgctgatcggaatcttagcttaattggttccttttgcatgttaattgtagtgcacgcctatgcacaaaactgatgagcatgttctgttagtgccagtattgaccttgcgtaatacgtattgttaggcaataatggaaattctatttcgtcgagcacatagagagtgtc

SEQ ID NO: 455 - DNA, 1528 bp, Sorghum bicolor
ccgaagcaaagacgatggcgcccgccgcgtcatccccgccgccgcacgtggcagtggttgccttccccttcagctcccacgcggcggtgatgctctccttcgcgcgcgccctggccgccgccgccgcgccgttcggggccacgctctcgttcctctccaccgcgtcctccctcgcgcacctccgcaaggccagcggcggcgccggcggctccgcggggaacgggctcccgatgaacctgcgcttcgtcgaggtccccgacggcgcgcccgtggccgcggccggggaaaccgtgccggtgccgcggcagatgcagctgttcatggcggccgcggaggccggcggggtgaaggccggcctggaggcggcccgcgtcgcggcgggcggcgccagggtgagctgcgtggtgggcgacgcgttcgtgtggccggcggctgacgcggccgcctcggccggggcgccgtgggtgcctgtgtggacggccgcgtcgtgcgcgctcctggcgcacctccgcaccgacgcgctccgagaggacgtcggcgatcaggccgcgaaaatggcggacgagctgctgatctcccacccgggcctcgccaggtaccgcgtccgtgacctccccgacggcgtcgtctccggcgacttcaactacgtcatcaacctcctcctgcaccgcatggggcagcgcctcccgcgctccgccgccgccgtcgcgctcaacgccttcccgggcctggacccgcccgaagtcaccgcggcgctcacggagatcctgccgaactgcctcccattcgggccctaccacctgctcctccccaaggacgacggcgtcgacaccgccgacccgcacggctgcctggcctggctggaccgccaccccgcgcgcggcgtcgcgtacgtgagcttcggcacggtggcgtccccgcggcccgacgagctccgcgagctggcggccgggctggagtgctcgggctcgccgttcctgtggtcgctgcgcgaggactcgtggccgctgctcccgccggggttcctggaccgcgtcgccagcgccgggtccgggctcgtggtgccctgggcgccgcaggtggccgtgctgcgccacccttccgtgggcgcgttcgtgacgcacgccgggtgggcgtcggtgctggagggcgtgtccagcggggtacccatggcgtgccgcccgttcttcggcgaccagcggatgaacgcgcggtccgtggcgcacgtgtgggggttcggcgccgcgttcgaggcgggcatgacgcgcgacggggtggccgccgccgtggaggagctgctgcgcggggaggaaggcgcgcggatgagggccagggcgcaggagctgcaggccgcggtggccgacgcgttcggccccggcggcgcgtgcaggaagaacttcgacaagttcgtccagatagtttgtcgcgcgtgaatgtcgtcgtcttgctgttagatacccctacccattcgttcagaggtttcagtgttttaccaaaagaagaatggactacttccgctctccttgtg

SEQ ID NO: 456 - DNA, 12427 bp, Sorghum bicolor
atccccaatcacatgctagttcacaaatggcttcatcacagcatgctagttcacaaatggcttcatcgcagcatgttgagatggaggccgcaaaacttctacataaacttattcaggagtcgaaggatgagcctgctaaactagcaacaaaactttacgtgatatgtcagcatatgaaactaagtggaaaggagcagtcactgccatatcaagtcatatcgagggctatggagacagttgtgaaccaacatggaattgatatggatgcattgcgatcatcgcgaattccatttgctggtggtcctcaggcaggggattctagtggtgccatgtcaaaggacaaggaggtcattggtaaccagtctccgatggttggaagtgatgcatcccaaactagtggacaagctggactgtggcagcttccatcaggttcaactgatatgacaaggcatgggacatctatttcgggtaggctacctacagggccaaataggggagatttctcagcagctgaaattcatcaagcctccatgtcacaaaagagcggtagatcctctggcattgaaagccctgcaagcctgcagatggaggataccagatctatgaattcacacgattctttgaaatctgatgagaaaacaagcaagaaaacctcttccaagagaaaaaggatggattcaaaaggagctggggatttgcattctgaagacaactcaaagtcagatgctatgtccactggaccgaataccagaaaggggaaacaggttggtaaggctggtagacaaggtcaaccttccatgggaattgagcatgagcaaccgcatatactgcaaggtggtactgctcaggtgccaccgatacatggtggtgcaccttttctcaggactcacccagaaggtccttctgggaggacaatggacaagacgaaaccatcaaatccattctcaatggctcaaattccaagttttcctgaaggactggcttctagtggtgccaccatcgagttgcaaaaaagtatacagggtggagcaaatttatttaatcctagttttggttggaaccaaaacccacaagttccaaccttgaagaattctcaaggttctattcccaatttagtgaggtctggagttactatcgaaggcaaaattaatgtaggggcacaaggagcttttaactctacctcggcaccacaaatggaatttcccacaattcctccttacaacccctcttcctttggagttagctcacagtttctggacaaaggcaaggagttggcttccagcagtactggcgctgaacttcattccacgtctaaagttgcatctcagcctggaattcctcatggaagtcccatgcaagaaaggcaaggtattatcagggtgccacagagagctgatccatcttcacttccgagcagaagtaccgggccaagtccaatgtctcacacttcttccaacacaccatttaaagaacaacagctgaagcagctcagagcacagtgcttagtatttcttgcatttaggaataatttgcagcccaggagggtacatcttgaaattgctttgggcagagggcctcctgcagaaagtgacagtgcaggtcagaggggcagcgagggcagagtgtctgatgctttgggaaaggaaaatggtagcagtcgggagaattctggtgtcttttgtaggcaaactgatatctctagacttccatccacatctgcaggaagtattgcagaggttgattccttactgaaggacccagaaaatgctacaaaaaagatcaaggttgctgaacaggagaagtcattgatggaagtagaaaatatccagcaagcttcagctagttctggaatgcgttcccaagaaactgcatctcaaaatccatctgggccacaacagtcatactttcagggagatacaagaagaattgcctctgatatccataggactgatgctgaaaatttgagccggaatttaagttggggaggccagggatctactgttttgggtggtactagacagcatctgaatcaggaaactaaagaatcacttccaccttcaaagtcacaccatatgcctggtgatggtttcaactccaatataccaggaatagatcggactccagagacagccggagctggtaatgatgttgaaaattgtagccatgttgtggatattgtgcctgagcaggctgctgatgatggagatgaggaccttccagagcatgaggatttattgtcatctcctccaaagcacacaatgacagaaaaatggatcttggattaccagaagagaatttacaatgagagacaaaagagggcatcggagcagcataaattacacagcagaatgtcagcatcatatgagaagctaaaggagagtgtcaattcttctgaagatctttccgcaaagacaaagagtgtcattgaattgaaaaagcttcagcttctgccacttcaacgtcgtgtacgcagtgaatttttgctggactttttcaagcctaatacaaccgacttagagcgcataaaatcactgaagaaacataggcatggccggcgggtgaaacagcttgaaaaaattgaacagaaaatgaaggaagaaaggcaaaagagaattcgtgagagacagaaggagttctttgctgatatagaggctcacagagagaaacttgaggataacttcaaggctaagagagagcgcttgaagggattcaatcgatatgcaaaagaatttcacaaaaggaaagaaagaattcatcgggagaaactggataggatccaacgggagaaaatcaatctgcttaagaacaatgatgttgagggttatcttagaatggtccaggatgcaaaatctgaccgtgtcaagcaactattgcgtgaaactgagaaatatctacagaaacttgggaataaattacagaatgcaaagtccacagatggccgctcatcttttgttactgataagagtgacgctgcaaacgacattgaagatgagagctaccagccacagcattatctggaaagtaatgagaagtactatcaactggcacacagtgtgaaggaaactgtaaatgatcagccgtcttatcttcagggtggcaaattgcgagagtaccagatgaacggtttgcgttggctggtttcattgtacaataataatttgaatggtattttagcagatgagatgggtcttggtaaaacagtgcaagtaatctctttgttatgctaccttatggaaacaaaaaatgaccgtggaccttttctcgtggttgtaccatcgtctgttcttcctggatgggaatctgaactcagcttctgggcacctagtataaataaaattgcttattctggtcctccagaagaaaggcgcaagatgttcaaagagatgatcgttcatcagaagttcaatgttcttttgacaacatacgagtacttgatgaacaagcatgataggccaaaactaagcaaaatacaatggcactatataataattgatgaagggcaccgtattaaaaatgcttcttgtaagcttaatgctgatttgaagctttatcggagctctcatcggctattattgacaggaacacctcttcagaataatcttgaggagctgtgggcacttttgaattttctattgcccaatatatttaattcatcagaggacttctctcagtggtttaacaaaccatttgaaagtaatggtgataattcacctgatgaggccttactttcggaggaggaaaacttgctgatcataaatcgtcttcaccaggttcttcggccctttgtactccgaagacttaagcataaggtcgaaaatgagctgcctgagaaaattgaaagacttgtgagatgtgagccatctgcttatcagaaacttctcatgacaagggtggaagaaaatcttggtgggattggagccgttaaggttcgctctgtgcacaactctgtcatggaattgaggaacatatgcaaccatccttacctgagccagcttcatgttgaagagattgagggctatctgcctaaacatttcctgccatctattgtgaggctctgcggaaaacttgagatgttggacagattgctgcccaaactcaaagcaactggccatagggttctacttttttctacaatgacaagattgcttgatgtaatggaggattacctggtttggaaaaagtataaataccttcgattggatgggcacacttctggtcaggaaagaggagctcttatcgataaatttaatgatcctaattctcaagcattcatttttcttcttagtatacgagctggaggtgttggggtcaatcttcaagcagccgatacagttatcatatttgatactgattggaatcctcaggttgacctgcaagcacaggctagggcccacaggattggtcaaaagaaggaggttcttgttttacgtttagaaacggtccgaactgttgaagaacaagtcagggcttcagcagaacacaaattaggtgttgctaatcagagtataacagcgggtttttttgacaataacacaagtgctgaagatcgaagagagtatcttgaatcactcctacgtgagtgtaagaaggaagaagcagctccagtgttagacgacgatgctctgaatgatattctagctcggagtgaagctgagattgacatatttgagtctattgacaagcaaaggagagaagaagaaatggcaatttggcaaaaggtggttcaggatggttcaactagtgggctagaccctgcagtattgccttctcgtcttgtgactgatgatgatctcaagcccttctgccatgctatgaaactttacgagccatcatcaaatgtgaaaacagtaaaggtgaatgtgaggaagaagggtgaacttggggggcttgatacacaacattatggaaggggtaaacgagctcgtgaggttcgctcttatgaggaccaatggactgaagaagaatttgaaaaactttgtcaagttgattctcctgaatcaccccaacctggtggcatgtcaaaggatttggatattcctaataaaggcattaagactgaaattgctgtggagagttcaaaagaaccagaacaaatgaggatggaggcatccccaactgttggggactccccaccagccaaacgacggagaggcagacctaaaaggtcagatgttttcttatctcctactgcagatctgactgatgctgtcaaacaagacacaggaaccacacaggatggtagtttggccacaccagcaagtaccttccattctgatacaccagctactccaatccattctgctgcttcagatgttaatatacattctatttcaccagctgatatcaagaaacaagagttcagtactgatactaagccttccagttctgtctctgttttggaaggatccacggcgaatgaaattggtacaccattacagagtgttcataatgtagcagctcctgcaccaccgcatcaatcagctagggggagaaaatcccaagcaggagaaacacctcgcaggcgaggccgaaaaccaaaatctctatcttcatctggtgtagatgatgttagtcttaacccaactgtttcaactggtagtggggtagcagacactagttatgtttcttcatattctcatgtgaatatgccctcatcacaaggcactgctgtggcactggcaggaatccagaaggatttggtcacagttaaattggatacattgttgccagatagtggtaagaatatttctcctgttaatgaagataaaggtgctactgttacaacacctgtggcaaaagatatctgtgctggaactgtgacaacatcagacaacactatcaccctgacaccgaatactcttaaggaaaacattggattagttcaagtagcatctgcacctactatgcctatgcctgtggcttcagaagaattattgaaaacagcagcacatgttgtggtggcagataagcctgttgagaagcaaactgcttcacgtcgccgcagaaagaaaacatctagtagcgaggatactggagtcagcactagacaaagatcagctatgaaaaaatcttattacagtacttctgttgccattgatgaagttggttctgccatgaccccaaatgagaaatcaggtatagagaaggaaagagatgtcagttcaattcaagatactcccaatcagctgccaaatattaactcaccactgtatgagaagtctggatatgattctcaaccaagcacacctatagctgtccccatcaatgaagctactcttcctagtggctttgatacccgcactactcattctaagataactctagcaacatctgccaatcctgctgatcatgataaaccggttgatttgcaccttaatgcgcctgtttcggttgattcccaaaatcatgaacaactcaagacaggaaaggaccatttggcagtgagttctggaatcttttctactcaattgcaaacagttactgcaaatcctactagtgataataaaccaggaactacccagtttgaaccatctgcttcctctgttcagaattcaggtaaggatgccactgcactgacttcttctgaggttgacagtgctgctccaaataaggcaccaagcaggaggaggaaagggtcaacgcgggaaccacgcaccagaagaacttctgcagcagctgcaagtgaacgccgtgcccgacttactggatcgaagcaggcagaggacacaaagaagttaaagatgtctgcaacgccaactacaacagtgtgtgttttagcggtagagcaacagggagctgcctctttaagagctgaggttaccaatgcttctgtttgtgaagagcagaagaatcctgggagtcacgtgtcttctgacatttcaattcctgtggggagtcatgtgctgggcgcaataagtactgaagaaacaactgccactgtgataactcagactcctgcagtggctaaatcagaagaaagaaaacttccagtaggggatcaacaaggtattcagtttgatagtacagtaccacaaacgaagatggtatcaaatgatgaaagcatgcaaggtactgaagttaataattcggaacagacaaaaatagtttctgctgctgaaccagcacctgcaaatgatgaacacatgcaaggtactgaagttagtaattcggaacaaacaaaaatggtttctgctgctgaaccagcacctgcaaatgatgaacacacgcaagctatagaggttggtagttcagagcaaccaacaagtatggtttcagctgtggaatcagcaccttcaaatgatgaagaacacacaacgcatgaagtgtatcttgagactgctgctgatgatatgcttacctctagtgcagcaacagatatattgcgggatacagttgagcatgcagctcgccaggccaatgcagcatgtacagatggaaccacaaggcagtctgaagcatcacaacttgatagcaaagcctctcatgatgcctcgtataaagacactactactactgtctccaccaaagatgatagcaaagcctctcgcgatgcttcttacatcttgcccagtgaaggcactgctgttgatgttactggttctaagcaagatgatgtgaacattgttggcacacaaactgctgatgcttccaggggttcttctagtcattttcaagctactttacaatcaactgagtcagattggcatccaggtcaagaggagaatttggagagtaggaaggagcaggtgaaaacggaagaagctttggataacagttctggtggcaatcaaactcacagtttgggcgatgaaccttctcatgatacatcattagcaagaaattctcctttggaatactcgaatgagcgttgttctgctcaagtaattggtgaaactttcaaaagtaaagaaaatattgttgaagtccattctgccatgaatactgatggccctgatgaagctctggatgcattgtatgtccaatctaaggaggccagcataacagatagtggtgtagctaccgatgttgataaatttgaaggtaaagagactagtgtcgaggtccgtgatgacatgaatactgatgggcctgaggatgctcaggatgctttgtccacccaatctgataaagaggccagcatggtagaatttggtgtgtctaacgatggtagtcccacagtttgcaaagcacacaatgatctcgagggtcatgtatcttgtgaagataggactggtggtgatatccataccaatgcaaattatggttctaataataaaagtgaggacaccattgttaatcctgttaaaaccacacgagaaccgttggaagaaagcaccgttattgtatcagagaattctgatttgaataagcaaagccacacattgcatactggaaatgatcctcctgcaagtaccctgttgatagttgagtctaacaaagttacttgtgatgctgaaattgtttgtgctagcagattagagtcttcttgtattgaggctgaaacagtggctatccaagagtcagctgttactgattttgagggaacaaaaggaactggggatttgggtcacaaaactggcagtccgctgtgtgatgatgttcatgatacatcatgttctgtgattggtcttgtgtgtgagaaagaacctactgaagatcttactgatggtagccattcagaagcacctaatttacttgctgctgtagtacaaactcgagaaactactgttgcaaaccaagaggaaatcatagatgcagtagtgtttattgatgcctgcaaggcagaacctgatggtgattgtactgttgctaaaggagctgaagagactgtagaaatggttcattctgttgaaaagcaatctgctgtattagaacatgttgagagacagacgaaacaaactacgatttgtggttctgtgctaaatgagtcccctcaggctgcagggttggaagaggactgctctgtactgaagcatggcggtcctactgcctcatctgagcttcttgctgtagcacccaatccaatcagtgaaacttctgttattcaagccgaaccagaggcaacaaactcggatggatactgcacaacagaggttggcagtgctttatctgaaactgtcaggggactggagccaaataaagaaactgctgttccaatgcaagaggatattgaagaagctaatgatacttctaataattgtgaagcacacaataattcggggattcatgcatttggtgaagtgttgatggaaatgcagtcatcagaggtcaaggaagtatcttttattcagtctggtgcagcaaatttgagcacacagactcctgtactgcctgatgaaacaggacaaaccaatgtggcttcgactgcagaactagtacctacaaatgatgatgaacacatgcaaggcactgatgttaattctgagcaacaaacaaagatggtttcacctgctgaatcagcacctggtaatgatgaacacatgcaagacatcacggttctaagttcagaactgcaaacaaagatggtttcagctgcagagattgatgcattatgtgtccaggagactgcaattgttgatcttgggggaactagaggaacagttgatctgaatgacattagtacacaggttcctgcattacctggaagtgatgtgctaggtgtggaggcacataattcagaaccaaaaaaagcatcctcaccaggtgatgaaattattagttcagaacaacaagcagaaattgaaacgattgcagagacagaaacagtgagcgttaaggagaatgccattgctgatcatgaggaaacaggtgaccagagtggcgtaagtatacatgctcctctattagctgaatctggagaaaagggatcacatggagttgaattgtgtggtattgagattgaggctaataattcggaacaaggaaagatggtttcaactgtggaagcagcctctacaccagacgatctagggcgtcacacacatgaagtgcatgtaactggtgatggtgctatattatctagtgcggaacaggacacattgcaagataacataagcagtggtgctgatgtggacctaacaaccagccaaaggaaaacagactctgaaggtatcaaggatccttctattgggactaacatagaggagatccaaggcccttatgaaacctcgaacaaggaccattttactgatcctcctgcgactaccctggtgatagctgaatctgataaggatacctgtgatgcagaagttgtttgtgctggcaagttagaatcttctggtgctgatgctgttggaacggttgctgtccaggaggttcctgctgttgctggcgatagagcaggagggataggtgttgaaggtcattgttcagaacaagtaaagatggcttcggttgcagaagcagcgtctagcctggctttagtaggatattcttcttcagaagactcaatggtggatgctgctgcccgagtagctgatggtgattttgcggatagtaaaggggctggtgttgattgccaagaaactatgcctactcaagccacctctaccctcccagagaacatggattggcagaatgattctcttgcagctgctgcggtgacggttgaaccaatgtttgcttcctcatctgagcacgctgcagaatccaagccaattgatgaaacttctgttatgcaagtggaactggcaaccagtacaggggatgaatgtgcagcagagggtgacaatgttgtttcatctgaaactgttgtggaatcagagcctgttcaagaaactgttgttcctagtcaaggaggtagcatagaagctaataatacttctaccatcagcgaagtaaacaaagataccgagtctcgtgcatctggtgaagtatgcaaagatgctcagtctcatggcggtgaatcttacactgaactgcaattggcaccttcctctggtgaggaggccatgatattgtgtagtgagctgcccagccaggaggtgaaggaggctccaagcagtgaacctttggggtataatgaaaatgtgaaaacagaaaatgattcttcttctcaagaaccagtcaatgaggaatctgctcctggtgctgaaaatgcaaagattgatgaagctgacacagaacagcaactgcctcctgggcagcaggtgaaggaggctccaagcaaccctttggggaataatgaaaatgtgaaaatggaaaatgaagcttctgctcagggaccagtaaatgaggaatctgctcctcgtgctgaaaatgtaaagattgatgaagctgacacagaacaactgcctccatctggtgaggccatggtagacatatctagcgagctactcagccatgacgaaaaggtggctccaagcacagtccctttaggaaatgatgaagatgcacatatggaagaggcttctgctgcacagagagagctaagcactgaagttgctcatggtagtgaaaatgcgaaacttagtgaagctggcacgtctggtgaggccatggtagacgtatctagcgagctactcagccaagatgaaaaggtggctccaagcactggccctctaggaaatgatgaagatgcacagatggaagaggctgctgctgcacagagagagctaagcactgaagttgatcatggtagtgaaaatgtgaaacttggtgaagctggcacggagctgcagttgccaccaccttcatctggtgaggcactggtagacatatctagggagcaactcagccaagaggtgcaggaggttgcaagctctgggccctcaggaactgatgaaaatactgagatggaacggctaaacaccaaacattcacctggtggtgaaacctcaaaacttgttggagctgatccgggaatacaattgccaccgtctggtgaggctgtggtagatatatctaatgagccacccagctgccaagaggtaaaggaggccccgagcagtgacagtttgggaaatgatgaaaattcagacaccgagaagactgctgctgccttacagggacggctaaacaccgagcttgctcctagtggcgaaaatacagaatctaatgaagctgacactgggaaacaagagacacccgtgtctgctgatgctatggtagaatcatccagcgagcctcccagcgatgaggcaaaggaagctccaaccactgacctgtctggggatgatgaaaaagcaaagtcggcaagggctgctgttgttgcggaactttttggagatgcaacagaaggtggttcggatcagccattgccgtctccaagagaacaaggcaaggaagcagaggctgatggtgacttgtagagtaaattatgcaaatattgtattaagagctactagaatctgtgtaagtaagaaatgatattagtgctttagttgtaactgttggaagcttttactcagaatcaaaagcaacgtgctga

SEQ ID NO: 457 - DNA, 1751 bp, Sorghum bicolor
ctccctcttgctcagttggtccccatggggcggcggctgagcgcctccaccgcggcggcggcgtcggcggagccgctgctcccgcgggcgctgaagcgcggggtgctactcgagcggtgcgcgtcgcgcgccgacgacgagctgcagtggttccgctcctgcctgcggtgggtgtgcatggaccactcgtcgggcccagcgcaggccgcgctctcctggctcctcttcctcgtcctcgccatcatcgtcccggccgccgcgcacttcctcctcgccttccgggcctcccgccggcccttctccgccgtcgtgcagctctcgctctcggccgcctcggcggcggggttcctctgcctctcctcctccttccgccgcgtcgggctccgccgcctgctccacctcgacaagctccggggcaagagcgaccgcgtcaggctcaactacaccgcgcgcctcgccttctccttccgcctcctggcctccctcgtcgcgccctgcttcgccgccgaggccgcctacaaggcctggtggtacgccacctccgccgaccgcgtccccttcttcgccaacgacgtcctcagcgacgtcctcgcgtgctccctcgagatggcgtcttggatgtaccgcagcgccgtctacctcctcacctgcgtcctcttccggctcatctgccacctccaggggctcaggctcgaggacttcgccggatcgctgctcgaggaggtcgaggaaggacgggctggggtggagaccgtgctcagagagcacctcgacatccgcaagcagctcaaggtcatcagccatcgcttccgcaagttcatcgtcgctgctctgctcatcgccaccgccagccagttcgcatccgtgcttctcaccacgcgacgcgactccgtcgacgacctcctcaacaccggcgagctcgcgctatgttcagttgtgctcatgtccgggctcatcataatcctgagcagcgccgccaagatcacccaccaggcgcaggccctcaccggccacaccaccaagtggcacgcctgttgcaccatcgagcccgtcctggaggacggggagcccgggtccaaccagaactccatgatcgagcaagaacccgagagcgacagcgacacagagtacagcgaggagaccggcgacgaagatctcctggagaacaccaagattcatatgccgcatgcgcatgtcatctccttccaaaagaggcaggcacttgtgacatacttggagaacaacagagccgggatcaccgtgttcgggttcacgctggaccggtcgtacctgcataccatcttcatgctcgagtggacgctgttcctgtggctgctcggtaagaccatcggcttctcgtgaaaaaaaaaaagaaagacaatgtaaaaggagaggtgtgtcctgtgtccaacgtccgggactccgggtggtcgtttctgagagttgacgcatgtcgtggttgccttttttggggatggatttggatgtgctttgtctttcggccatttgtagaagggggttaggggggaggctttttcgcgtgaaccgggctgctggcacgggagcgttcagcttgagcatgtacgcctcaacgcctgtgcatgatagcgattttgtatgacgtgtgtaaattgtgatctgtgaatctgtgattgcccgtgtcaacagcccttttgtaactgtgtgttgtacagtctcgttagtgggcgtgcatataggctccgtgtgcgtcatacagcgtggtgtactgg

SEQ ID NO: 458 - DNA, 693 bp, Sorghum bicolor
aatcaaagacgccatttccttcgtgctccttcctgttcattcctttccttgaaacccttttccccgtaaagctctccgctgcgcgtacttcgaatggccgtcggaggaggcgtgtgcgtggcgtcgccctcgtcctcgccgtcgtcgtcggttgaggcgccgtgggggacgaggaggacgaggacgacgacgacgacgagcggggcgcgacgcggcgccgcggcggcggcgaccagcgtcaggtgcagcatcgtgggcgaggccggcgggccgggcgcctccggcagactggcggaggacccttaccggacgctgcggctgcgcccgggcgccacccgcggcgaggtcaagaaggccttccgccgcctcgcgctcatgtaccatccggacgttcgcaaggagaagggaagggaaagcgacggcgtcagcgacgtccaattccagaggattaacgtggcgtatcagatggtgatgagcagcatgagggaggccgacgagcggctggagtactggcggctcaagtacggcctcaccgacgaggatctcgacaggtacaggcaccacctcaaccaagaacacggtgacgacgactggttcgacatgtgaagcagccaatcggtagacaaggattttatgtacataataaccctgtttatccgcattgacccgattaaattcttgttgccattgtag

SEQ ID NO: 459 - DNA, 1361 bp, Sorghum bicolor
gatagatggcgtcgtcactgcctccgttcacggtgcgccgcggggagccggtgctggtgcggccgtcggcgccgacgccacgggagacgaagccgctgtcggacatcgacgacgccgagggcatgcggttctacagctccggcatccacctgtaccgcgccaacccatccaaggccagccaggacccggccagggtcgtccgcgaggcgctggccacggcgctcgtcccgtactacccgctcgccggccgcctccgcgaggagccagggaggaagctcgtcgtcgactgcgccgcgcagggcgtcctgttcgccgaggccgacgctgacctcaccgccgacgacttcggggacgtcaagtgcccgccgttcccgtgcttcgagcggttcatcctcgagagcaccaccgtcgccggcgtcgagcccgtcgtcgaccgccccttgttgtacgtccaggtgacgaggctcaagtgcggaggcttcatcttcgggcagcggatctgccactgcgtggtggacgcgccgggcgccatgcagttcgagaaggccatctgcgagttcgcgcgcggcgccaccgaggcgccgtcggtgacgccggcgtggggcagggagatgttcatggcgcgtcagccgccgcggccgtcgtacccgcacctcgagtaccgcgagccggcgtgcggggccgagcccgacaggatgatgacgactcccccgggcgacatggcgcgtgtgcctttcttcttcgggccccgggagatcgcggggctgcgccagcgcgcgccgcccggcatgcgctgctcccggttcgagctcgtcgccgcgtgcatctggcgcagccgagcggcggcgctcgagtacgcgccggaagaggaggttcgcctgtccttcatcgtgaacgcgcgcggtcggcgcgagatcccgctccccgagggcttctacgggaacgccttcgcctactccgtcgcggcgatcaccgccggggagctctgcggcggggacctcgggttcgcgctggacctagtgaagaaggccaagtcggcggtgacctacgactacctgctgtcggtggcggacctgatggtgctcacgggccggccgctgttcgcgctgtccaggacgtacatcgtgtcggacgtcagccacgccgggttcaagagcgtcgacttcggctggggcgaggccgtctacggcgggccggcgaaaggcggcgaagggccgcttcccggcgtcaccaactacttctcacgggccaagaacggcaagggggaggagtgcatcgtcgtgcccatctgcctgcccaaggacgccatggagaagtttctgctcgaggtggaaggcctcactgcggagctctaggcttag

SEQ ID NO: 460 - DNA, 1099 bp, Helianthus annuus
aacaaatggctagagttccaagagtgaaactgggttcacagggtttagaggtctcagctcagggtttaggctgcatgagcatgtccgctttctacggacctcccaaacctgaacctgacatgatcaatctcatccaccacgccgttaactccggtgttacctttctcgacacctccgattactacggccccaaaaccaacgaaatccttcttggcaaggctttgaaaggggggatgagggacaaagtggagctcgctaccaaatatgggatcaaactcagcggttcgtgggaggtaaaaggcgatcccgcctacgttagggctgcttgtgaagctagcctcaagcgacttgacgtcgattgcattgatctctattatcagcacaggatagacacccgtgtgcccattgaaatcacgatgggtgaactaaagaagctggtggaagaaggaaaaattaaatatgtcggattatccgaggcatcagcatcgaccatcagaagagctcatagtgtccatccaataactgccatacaactagaatggtccttgtggtcaagggatgttgaagaagatattatacctacttgcagagaacttgggatagggattgttgcatatagtcctctaggacgagggtttttcgcatctggttcaaagatgatggagaagctcgaagatggtgactatcgtccgaactttccaaggttccaacctgaaaatcttgaacacaacaagatcctgtatgagagggttagtgaaattgcgtcaaagaaggggtgcacaacttcacaactagcattggcctgggttcaccaccagggaaatgatgttgtgcctattccaggaaccaccaagatagaaaatcttgaacaaaatattggagctttatctgttaagataacgccagaagagatggctgaacttgaatccacaactcatttagtaaagggggctcgatgtaatgccggtactccaacatatctagactctgaaactcttccattgccatcatggaaatcttaatttatcaatgatatgagtcttttgtttatcctgtgttgctatacccaacatatcatattcaatttccagtaacgtgc

SEQ ID NO: 461 - DNA, 706 bp, Helianthus annuus
caaataaatccgccattcaaactccactttcctcatcatcctgttatacaacaactacatctcaattgttaatccaaattcttcaatcgctttctacaacaatcgaaatggaattcagtctgatgggattagacactccgttcttccgcaacctccaacacatcctcgaatccaccgatgacaacacaaccggcaacaagtccaacaacggcggtccatctcgggcttacgtccgcgatgcaagggcaatggcggcaacccctgctgacgtcaaggagtatcctaactcctacgcgtttattgtggatatgccggggctgaagtcgggggatataaaggtgcaggtggaagacgacaacgttctggtgataagcggagagaggaaccgagaggaagagaaggaaggagcgaagtatgtgaggatggagaggaggattgggaagttcatgaggaagtttgcattgccagagaatgcgaatacggataagatatcggccgtttgtcaggacggagtgcttacggtgactgtggagaagctgcctccgcctgagccgaagaagccgaagacgatccaggtgcaggtggcttgaagaatgcgtatgcggtagtatcggatgtttgatctgtaatgggaatgttatgagtgatggggtttaaagaatgttagtggatatatggtttgttgtttggctctgtttgctaccat

SEQ ID NO: 462 - DNA, 255 bp, Helianthus annuus
gaaacgatgtcgtcttcttgctgtggtggaaactgcggttgcggctctggttgcaagtgcggtaacggctgtggtgggtgcaagatgtacccagaaatggtctccggtgagagtactaacaatgagacacttattcttggtgttgcacctactgaaactggaatagagaccaccggaggcgtggcaacagcggctgagaacgaaggatgcaaatgcaacccttgcacatgtaatccatgcacctgcaaatgatga

SEQ ID NO: 463 - DNA, 527 bp, Helianthus annuus
cgaaaatgcagatcttcgtgaaaaccctaacgggtaagacgatcacgttggaggtcgaatcctccgacacgatcgacaacgtgaaggcaaagatccaggacaaggaaggcattccaccggaccagcaacggctaattttcgccggaaaacagctcgaagacggcagaaccctagcggattacaacatccagaaggagtcgactctgcatctggtgttgcggcttcgtggtggggcgaagaagaggaagaagaagacgtacacgaagccgaagaagattaagcacaagcataagaaggtgaagttgagtgtgttgcagttttataaggtggatgatgctggaaaggtgcagaggttgaggaaagagtgtccgaatgctgagtgtggggcggggactttcatggcgaatcattttgatcggcattattgtggtaagtgtgggctcacctatgtttaccagaaggcttgaggttatgtttctttaagttttgttatgtgtttttgtcaaactgttgttgaattggattag

SEQ ID NO: 464 - DNA, 1151 bp, Solanum lycopersicum
aaaggatccgaaaaaaatggcaaaatcatttgaaaatgaacatccaattaaggcatttggatgggcaactagagacacttctggagttctttctcctttcaatttttcaagaagagtgacaggtgaaaaagatgtgcaatttaaagttatgtattgtggaatttgtcattctgatcttcatcaactcaagaatgaatggggaaatagcaagtaccccatggtgcctgggcatgaggttgttggtgttgtcactgaggttggaagcaaggtggagaagtttaaggttggagacaaagtaggtgttggatgtatggtaggatcatgtcgaaaatgtgagaattgtagcgttgatctcgagaattactgtcctcgtcagattcctacttacaacggctatagcttagacggaaccctcacgtttggaggttactccgatgtgatggtatccgatgagcattttgtagtacgttggcctgaaaacttgtcgatggacgctgctcccctgttatgtgctggaattacgacttatagtcctttgaaatattttggactcgataagcctggaatgcacattggtgttgttggtcttggagggcttggacatatggctgttaagtttgctaaggcattcggaaccaaagtgactgtcatcagtacatctgctaataagaagaaagaagcaattgagcgtttgggtgcagactctttcttgatcagtcgcgatcctgagcagatgaaggctgcaatgaacacattggatgggattatcgacactgtatctgtcgtgcaccctattcttccattacttatgttgatgaaatctcatggtaagcttgttatggttggtgcaccagaaaaaccggtggagttgcccgtgtttcctctacttatgggaaggaagctagtggctggaagttgcataggagggatgaaagagactcaagaaatgttggactttgcggcaaagcataacataacaccagatattgaagtggtgccaatggagtacgttaacaccgcgttggaacgtcttttgaaatcggacgtgaaatatcgttttgtgctagacattggtaatacattgaacaagaaatgagaatagggaggggatcaattatgtagctagcagtgtttcctccatcggtaccttt

SEQ ID NO: 465 - DNA, 1795 bp, Gossypium hirsutum
agtacatggggagcttcaaaacctcagcattgaattttttctttcatttttggataaacaggaaggagacggagagggagtatcgacggtgatggagatgcgagacatcgacgaccttccaaagaacgccgttaactacatggctttgacgccgttgtggttcttggaacgagccgccacggttcatcccaccagaaaagcggtgatccatggatctcgaacgtacacgtggctccaaacttaccagcgttgccgtcgcttggcttcagctctttccaaaagctccatcggcgttggtagctcggtagccataattgcaccaaacattcctgctttgtatgaagctcattttgggattccaatgtctggtgctgttgtaaacaccatcaatattcgcctaaatgcatcaaccattgctttccttttgggtcattcacaatccaccgtcgtcattgtggaccaagagtttttcaatttggcagaggatgctttgagaatcatgaaggagaaaagccaaggcaatttcacacctccgcttgttattgtcattgctgacgaaagctgcaacccggaaacacttaagtatgctttggggcaaggagccattgagtatgagaagttcttagaaagtggtgaccctgactttgcttggaagcctcctcaagatgagtggcaaagcattgctttgggctatacttccggcacgacagccagcccaaaaggggtggtattacatcaccgaggggcatatctaatggctttgagtaatcctattatatgggaaatgaatgaaggagctgtatatttatggactctgcccatgttccattgtaatggttggtgttttccttggacacttgcagctgtttgtggaactaacatatgcctccgacaggtaacagcgaagggcgtatactcggccatcgcgaagtacagggtgactcacttctgtgctgcacctgtggttctcaattccatagttaatgccccgcctgaggaaaccattctgcccctcccccatgttgttcgtgtaatgacagctggtgcagccccacctccttctgtccttgctggaatgtcccagaaaggtttccgagtcacccacacttacggtctctccgaaacctatggtccttctacagtgtgtgcatggaagcctgaatgggactccctaccacctgaaactcaagctcgtctaaatgcacgtcaaggtgtccgatacgttggtttagagtgcctagatgtcattagtactcaaactggtcagcccgtacctgctgatggaaaaaccattggagaaatagtgtttcgcggtaacattgtgatgaaaggctacttaaagaacccgaaagcaaatgaggaaacattcgcaaatggctggtttcactccggggatctgggtgtgaaaaatccagatggatacattgaaataaaagataggtcgaaggacataatcatatcgggaggcgaaaacatcagcagcgtggaagtggaaaacagtctctatttgcaccctgcagtaatggaggcatcggtggtggcaagggcggacgagcggtggggagagtcaccttgtgctttcgtgaccttgaagcctggggtggacaaatccgatgaacaacggttagctgaagacataatgaagttctgcaggtccaagatgcctgcatactgggttccaaaatcagtgatatttggtccactgccaaagacggccacaggtaagattcagaagcatgtgctaagagcgaaggcaaaagagttgggacccgtcaggatgagtaagttataataa

SEQ ID NO: 466 - DNA, 880 bp, Hordeum vulgare
cggagatggcgcggtgcagcaacgggctgctgggcctgctgaacgcgggggtgctggtcctggccctggcggtgctgggcggcggaatctggctgagccaccgggcggccaccacggactgcgagcggttcctggagcggccggtcatcgcgctgggggcgctgctcctggcgctgtccctcgcggggctggcgggctccctctgcggcgcctcctgcctcctctggctctacctcgtcgcgctcttcatcctcatcgcgctcctcctcgtcttcaccgccttcgccttcgtcgtcaccaaccgcggcgccggctccgtcgtctccggccgcggctacaaggagtaccgcctcggggagtactccacctggctccagcgccgggtcgaggactcggagaactgggccaggatccgcagctgcctccgcgacggcagcgtctgccagaggttcggcgccaggggggagtcgctccagcagttcgtcaccaacaacctctccccgatccagtctggatgctgcaagcccccaactgggtgcaacttcacttaccagagcgagaccatgtgggtcaaaccttctggcttcaacgctaccaatgaccctgactgcaacacgtggtcgaatgatcagagggccctctgctacgactgccagtcatgcaaggccggcgtgctcgcaaacctgaagaacgactggaagaagatcgccaccgtcaacatcgtattcctcatcttcctcatcatcgtctactctgttgggtgctgcgctttcaggaacaacaggcgggacaactcgtacccagcctggaagtgagtgagatgcctggtgaggcttaggtaattaggccggtgttcagcgttaacgactggctcattgtc

SEQ ID NO: 467 - DNA, 744 bp, Oryza sativa
aacgataagcccgtgaacccgaccccgcgcgccacccgtccttcccacccccgagcgagctagagaggaagacgatgcagctcatggcggccaggaagcttctagagcagccgggcaccgccgcgccgccggtgctgggcggctccatcgccgacgacagggacatcgtcatcatcctcgcgtcgctcctctgcgcgctcatctgcgtgctcggcatcggcctcgtcgcgcgctgcgcgtgctcccgccgcggcggcggcggccccgacgcggccgccgccaacaagggcgtcaagaagtccgtgctccgcgcgatccccaccgtcgagtacgtctcccccggaggcggcggcaaggggaaggaggaggaggaggcggcggcggaggagggggagcagtccgagtgcgccatctgcctctccgacttcgagcacggcgacgccatgcgcgtgctcccccagtgcggccacgcgttccacgccgcctgcatcgacaagtggctgcgcgggcactcctcctgcccctcctgccgccggatcctcgtcctccagcttccccaaggcgagcggtgccagcgctgcggcgcgcggccagagccagccgccgcctccgcggtctggaagccgacacactacagcgaggtcccgcccttcttgccgtagaaggcgcagccgcatcgcgcgctccggagattccggggggctagagctagaagaggaacagagaaaccgaccaaaccataag

SEQ ID NO: 468 - DNA, 1327 bp, Sorghum bicolor
actgtataattgtgctcgctcgccggccccagggacgtgacacatcgcacggccgaagcagctcggtgcttttgcctccgcctgccgtgccgcccgtgaggccggcagctttgcatgaggaggaggaggatgggggcactgcacgtcgtcggtgagcccagggtcgtcagcttccagcagcagcctgcagccgtcgtcgccaagaacggccacggccccgtcgtcgaggagatccacggcctgatccgcgtctacaaggacggacacgtcgagcgcctcccggcgatcccgaccgtgccctgcacgtggggcggcaccggagcggacgcgcctggtggcgtcgtcgcgagggacgtggtggtcgaccccgccacgggggtgtgggcgcgtctgtacgcgccgatgacgacgacgacgtccgcgggaggcggaaccggaggcagcaggccccccgtcgtggtgtacttccacggcggcgggttctgcgtcgggtccgcggcctggagctgctaccacgagttcctcgcgcagctctccgcgcgcgcgggctgcgccgtgatgtccgtggactaccgcctggcgcccgagcaccgcctgcccgccgcgttcgacgacggtctggccgccgtgcggtggctgcggcaccaggccagccgcgccgcggcgtgcgacgacctctcgtggtggcgggcccgctgcggctttgaccgcgtgttcctcatgggcgacagcgcgggcgccagcatcgccttccacgtcgccgcgaggctcgggcagggccacctcggcgcgctgtcccccttgaccgtcaggggcgccgtcctgatacagcctttcttcggcggcgaggcgcgcaccgtgtccgagaagagcatggcgcagccgccacggtcggcgctgacgctcgccacctccgactgctactggcggctggcgctgccggccggagccagcagccgcgaccacccctggtgcaacccgctgtcccgcgccgcgccgcgcctggagaccgtcccgctgccgccggtcctggtgtgcgtctcggagacggacatcctgcgggaccgcaacctggagctgtgcagggcgatgcgcaaggcgggcaagtgcgtggagcaggccatgtacggcggcgtcgggcacgcgttccaggtgctacacaactgccacctgtcccagccgcggacgcaggagatgctcgcgcacatcaaggccttcgtcagcgccaggtagcagccgccgccgccgccgtcgttcgtcttcgttggactggacccctagctagctaacacactcgccgtcgccgtgttaatcaatccaccatgca

SEQ ID NO: 469 - DNA, 1802 bp, Zea mays
gattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtattcatgtgtttgtttgcttatgtgtttgtttgcttgtatttgctggtgcttgtatcgcgggatgcaatgagttgttgtttggttgttgtcaaccaggctctatgtgtgtgtgcgaggtgtgtgtttggttatctgtgtgcagatatggagtcaggctcgtacgatacttaaagcactctgggctaggacgttaggctctgcaggcgcgagtaaattaatcgcatctttgaagttaggctcccgccgacctggctcatatagctgggctaccgggagaagccgacctggctcatacagctgggctaccgggagaagccaaccaaacatgcgcatgtatctctctcgacggat

SEQ ID NO: 470 - DNA, 1647 bp, Sorghum bicolor
gatcgcggaatccttatctgctcgccgcgccatggccgccgccgccgccgccgcggtagcccacctctccgtccacggccgcctccgccgctctccggagcatcgcccgtccacctcctcttcctccgcacccgcgcaccggccgtccctgctgcggtgccgcgcgttcaagcaggagaccgacggcggcggtggcgaccgcgacagcgacccgtccgagcccgacgcgcggaagcgcaggaagggcccgctgtacaagctcaaggcggcgatccagggcctcgcgggctcccgctccgccgccgcggaggtctacgggggagagcaccagtaccagcgcgccgtcgagaaggcggaggagatcttcttctcggttgctactcagctaggcagatatgctatcactatgatgagcagtggtgttgtacttggggttggatttcagctgtcaggtggagacagccaaatgaacgaactaatttggtatagctggcttggtggggtgattatcggtacaatgataggtgcaaacagtgtcctggaggaacactgcaaagctggacctcgcaatgtcgtcataactggaagcacaagagggttaggaaaagcacttgctcgtgagtttcttctttctggagaccatgttgtaattacttcacgaagtcctgaatctgtccttcagactataacagaacttgaagagaacatacaggaagggttatcagttgccaaaaagaaagagaggaaaattttatcccatgccaaggttgttggtacagcttgtgatgtctgtaaacctgaagatgtgaagaaattagtgaattttgctattaatgagcttggctcagttgacatttggataaataatgctggcacaaataaaggttttaggccactggtaaccttttcagatgatgacattactcagatcgtctcaacaaacctagttggctctctactgtgcactagagaagccatgaatgtcatgcaataccaagagaaaggaggccatatatttaacatggatggagcaggttctggaggatcaagcacaccactgacagctgtctatggttcaactaaatgtggactaaggcagttccaaggatcacttctgaaggaaagcagaagatcaaaagttggagtgcacactgcctcacctggtatggtcctcacagaccttcttttaagtggttcatccatcagaaataaacaaatgttcaatttaatatgtgagcttccagaaacagtagccagaacattggttccaaggatgagagttgtaaaaggaagtggaaaggcaatcaactacttaacaccaccgaggatcttgcttgctttggttactgcatgggttcgacggggccgatggtttgatgatgaggggagagcggtgtatgcagctgaagctgacagaattcgcaactgggctgaaagtcgagcacggttctctttcaccgatgccatggagatgtacacggaaaacacatgggtttctgtattctcactctccgtggtttgtgcgttcataattctttccagctcaggtggacctcttccaggcacatgatttccagagttgccaaactagtagatggtcatacatatactcaattttgtcaacaccaaaggcattctactatggga

SEQ ID NO: 471 - DNA, 1432 bp, Sorghum bicolor
ccgtagtacacaagcacacaccacctcgtctccacctcccctgttctcagcgtgcttgccctgtttcgacctcctctgctcatccgcctccctcgcccgccacgccccaccgtagtacaggccggcagacagccatggtggtgctcgccaacccgcctgtcgtcgaccagatcccgctgctgcggtccccggggcccagggacaccttctcgggcgtgccggtcgtcgacctgtccagccccgccgcggcgcgcgcgatcgtcgacgcctgcgagcgcttcggcttcttcaaggtcgtcaaccacggcgtgcccgcggccaccatgggcagggccgagtccgaggccgtcaggttcttcgcgcaggcgcaggccgacaaggaccgcgccggcccggcgtacccgttcggctacggcagcaagcggatcgggctcaatggcgacatggggtggctcgagtacctcctcctcgccgtcgactccgcgtcgctctccgacgcctgccccgtcccctccaccgccgccttccggagcgcgctgaacgagtacgtcgcggcggtgcggaaggtggcggtgcgcgtgctggaggcgatggcggaaggcctgggcattgcggacgcggccgcgctgagctcgatggtgaccggcgccggcggcgaccaggtgttccgcgtgaaccactacccgccgtgcccggcgctgcagggcctgggctgcagcgccacgggcttcggcgagcacaccgacccgcagctcatctccgtgctccgctccaacggcacgtccggcctgcagatcgcgctccgcgacggcgcgcagtgggtgtccgtgccctccgaccgcgacgccttcttcgttaacgtcggcgactcgttgcaggtgctgacgaacgggaggttcaagagcgtgaagcaccgggtggtgaccaacagcctcaagtctagggtttccttcatctacttcgcgggaccggcgctggagcagcggatcgtgccgctgccggagctgctggcggagggcgaggagagcctgtacaaggagttcacgtggggcgagtacaagaaggccgcgtacaagacgaggctcggggacaacaggctggcccagtttgagaagcgtagcatctagctggcctagccatgcaggccggcccggccggtcaagcacaacacatgctttacaggacgacacacaggcaaccatgacgaacgaacgaacgaacgaacgaacgaacgaagacgagcgagttttaatgatggcgaagaagaaggaggaggtaaagacgatgatgacatgatgtgtacagctggggaacggcgactactccggtagctagatttttgtggtgggtgcagggtttccgcaagttgctctaatggcctgttttggggcgtgcggtggggctccttgcctatttcggtatgctggagctg

SEQ ID NO: 472 - DNA, 616 bp, Gossypium hirsutum
gagcagatcaatggattctttcctgcttgagtccccaaattccatttcctcatcggaatcatcattcgggtcgccggaattttctccgttcaaccacaactctcttcctttcaacgaaaacgactccgaggagatgcttttatatggcctactcaccgaggtcaaaacggaaacatcaagctcaacggaaaagggtagtccgacgaaagaaaagtcttaccgaggagtaagaaggcggccgtgggggaagttcgcggcggagataagggactcaaccaggcatgggacaagggtatggcttggaacatttgagagtgcagaggcagctgctctggcttatgatcaagccgcttttgctatgagaggcagcgccgccatactcaactttcctgtggaaagagtgagggagtcactggaggaaatgaagtgtaaccaagaagaagggtgttcgccggtggtggctttaaagagaacacattctatgagaaggaaaaggaccagtagaagtaagaaggaaagagatgcgaggataaacaatgtgatggtgattgaggatttaggtgcagattacttggaacaacttttgactcaaactgctacaccttactaattctaa

SEQ ID NO: 473 - DNA, 1031 bp, Hordeum vulgare
gctttggctcctctccttgcctccaatcgccgccatggccgccgcccctccattgctaaattcgcgtggtgcaggccccttctcttccttctgacctcgcccttgtcctcccctctgcggcgtggacctctccaacccctctcctagccctctgacagccggtagtcgccgcaccattcggcgcccgagccccgcccgccatggctaggggcaacctcgcccgggttctccccaggctccgccacctacggggatggatgcagcttggtcccctgagcttgttggtggccagagagcgacgaatgatggccggagcaaccggcagccgtcgccggcgtcgagcccctccctgtcccctgtcctgtcgggaggaagaagatgagcgaggggagggaggagagagagagagagaggaaggagatgccattggccccattcgtcagcctgtgaggcgttgatcagccccgggcccccgcgcttaagtgaaaatgtattctccggaatgcgctttctcttttgaaaagcgtactcggcccggaggcgcgttctgtttccagtcagggacctgtttgtaggaatttatttttatggataggtccctaaacttcatcgggtcttatctttttgctcgggactccgattgaggtgattccaaaaccctcggcttcgtctcgtcgatcccgtcatgttgatagcattttcacaaggtggtgagactgtgaaaatgacccttttgcccttgtctccaatcagcccccttcaagagagagcgatgtctggcgatcctttccgcggactctcagcacctcttccgggagtattcttcaaccccaggttcacataaggatccgtcgttcgtcgctaaggagacagagcatttgcggtctaggagcgtaaccgagtcagatccctgtggattggagctgcatcaagaccatgctgccttagatagagcttttttcgctgccattaaccttgtagctcattgtgtaaaactcttatattcattaatagaaatgcctatgttcatg

SEQ ID NO: 474 - protein, 160 aa, Hordeum vulgare
MLHVARAISEKSPGSNMEKYKIFAALAKVSVEIDDTDYSLIACFKALAMLEHLLECDHHHIINLNLQVRFAFELESMIGDAKAISLFKSRIENLKRASEDLLADNGDDASFTEVGSEKSFPAKEIRFLTDTLLGALEHKLEDLEQANINPSFRGKCWSRP

SEQ ID NO: 475 - protein, 720 aa, Hordeum vulgare
  misc_feature (241)..(241): Xaa can be any naturally occurring amino acid
LICSSISSEGNKVFMMDYKYSDMIDSAEVPIADNRTLPDWAEPLEPVRKLPTNVGTRIRKCVYEALDRKPPEWARKILEHSISKEVYKGNASGPTEKAVLSVLSEACRVIVPQKPENPRNERKTISISEVVLKKCRIALRHAISSDESKLFGNLLGTTLVNSNENEDEGILGFSGMVPRPLDFRTIDTRLAMGAYYGSWETFFEDVQEVIRNLYTAFADRADVVEMVAELSQSLESLYKTXVLDLVQKFDCHLSNENTDSEIQEELQDILTAATKLPKAPWEDGVCKVCGIDRDDESVLLCDECDSEYHTYCLNPPLARIPQGDWFCPSRMLKPKKKSRLDQGAQDSKRQRKGAESNAFHDKPSCMSGQKKSHLDQGVQDLKRQRKGAFHDILIKLAAAMEQKEYWELSTQERVNMPKFLCDEMLNTVLVREHIEKCPDKLNDLQQKFRALNSELKDLKYKEEMRTSYARQSRWGKTEQHISNCSGLAENQQNEVAIASDHVEESEQGNTGVSLNHPAEGSPPGQLNVGKPCKSDNGMPMVEENKSLGLSEQPSGTGSDLIEGNIMNEGSRDNFNLVDTPISEREPVATPLNTPGGELPDENASTSQDNLKMSTTRSLEQGADNGEMDTLSDEISKVQESIGTVESQLNMSSPRRDCLGKDSLGRLYWVLGRSGKRPLLVADGSTLICKERDINMVNSYPPSTSDCKGWNSASIVIYESD

SEQ ID NO: 476 - protein, 340 aa, Hordeum vulgare
MASLVPRLLSRRRILQPAVALCSPCDPWMRFRGASSPRPCPLFRPSLGGDGRGEPAGICWFLSPVRHGSTAVTLDTGGGFARFSFGDPGTTKQNGGQDQPPAEKRKKMSKKSKVNQLKWFRLKAKKKMKSPNPEVRIRYKLEKAKRKEEWLIEKLRKYEAPRAPEPVHDPEILIKEEKFYLKRTGEKKKNYVPVGRRGVFGGVVLNMHLHWKKHETMKVVCKPCRPGQVYEYAEELARLSKGTVIDIKPNNTIIFYRGKNYVQPKVMSPPDTLSKQKALEKYKYEQSLEHTSKFIEQLEQELEDYQKHVALFKKREGANSEQISNEDSAVDDLTTSSDTD

SEQ ID NO: 477 - protein, 124 aa, Sorghum bicolor
MRTQALFFLTFALLAVLAQSSNRHHHHHHHSQVQSRGQGGGGGGELASRGKAAARAWPCCDSCGGCTKSEPRRCQCLDAVPRGCHPACRDCVKSSLSADPPVYQCMDRVPNFCQRRCTAPAAAH

SEQ ID NO: 478 - protein, 111 aa, Helianthus annuus
MASKTFLLLALVFAVVLLITSEVAARDLASKHDGEVDGRSGYNRGSGGHGGYNNGGGRYNVDGRGGYNKGGGHGGYNGGGHGGHGKGSGGRGGHGKGGGGEEATAYKETQN

SEQ ID NO: 479 - protein, 371 aa, Solanum lycopersicum
MEKNELMKLKSSESQVMDGSDIMKLVGNEAVFSNFVDHKFEELDIDKDGKLSVKELQPAVADIGVALGLPPQGSSPESDHIYSEVLQEFTHGKQEKVSKTEFKEVLSDILLGMAAGLKRDPIVLLRMDGEDLLEFVKSPAFEPEMISLYSELELPDGSLKDYIIKAFEKLTVDQGMPPASDSWVMSNVVEPVVESCIGATNEQPVTQETFLAEFKKVAESAAQRLKEQPVIVAHSENTFDGSGIKRLLSNKFELDKTLDSALKTIPRDRNGKMSKEYLRVALDVLAPSAGLPPIGAVDQMDKVIQEVCKMLDADDGKMVKEEEFKKLLTEILGSMMLQLEGKPVSVSTNSVVHEPLASSSTLLQPPSISEM

SEQ ID NO: 480 - protein, 248 aa, Solanum lycopersicum
MKPYYTLKMKRKDLEDVNDEFSDFSLSSPARKIRRLDAVLPPIIEEVEEPEIPIAFEQATTYPSFGSNAVKRGLVIEELPSVPANEERAIVLFKPMNTQPMHSPSNFSVKVDPQFLNGFKSQVFWDNTANAFRLVDANEAAQQDDSSSAKECLAVVPWVPSQFPSAAEAEILSQPDVSDMMDAEDMEGVAMDIEDNSVDVEPRIAVDAGAVSVNDGLHHWQQQHCMTTTQPPQNTSTPIPWYSNWHKD

SEQ ID NO: 481 - protein, 80 aa, Solanum lycopersicum
MKNTSKSSKITPKSSQDARKDRRSATGISGSPKKGGHGGKFTWAGDGSYSSKKEEADAAVVVDANDPNFDEPEENSIDES

SEQ ID NO: 482 - protein, 353 aa, Solanum lycopersicum
MPPNPRVDRAFRSMKALGISGEKVKPVLKNLLRLYNKNWDLIEAENYRVLADAIFDDDEAKDAEIKKSTEDTEQEALVQDEPEPPLKRQRFKSQSSQPNESLESQLQNQSPGDFDSPQSMGNESQPGSHPSLDRNKGKQPMFADSLVPQEELPSSQPSDVDKSLPVPRRAGSTSGSGIPVSPTKNAIANHTLIKPKDEPITDDLPSLEVPVAIIRPGSSSKGKSSVASGSEGRHGDSNASATVVEADTNDGNPPSPVVANGKPETSTVKSSSALEMASSQSGEVKMILTYGSVLGRSDFQMPTLDAVVKLMDDKCQKEYKELDPNFSVMKVMTDICQCFLEMSGESTNKSSDE

SEQ ID NO: 483 - protein, 235 aa, Solanum lycopersicum
MATPSVQEIRPASLDSTSESPALFDGTTRLYISYVCPFAQRPWIARNFKGLQDKIELVPIDLQNRPVWYKEKVYPQNKVPSLEHNNKVIGESLDLVKYIDSNFEGPFLLPDDPEKQKFAEELIAYSDTFLKEIYANFKGDIEKHAGPQFDYLEKALDKFDDGPFFLGQFSQVDIVYAPFVERFQIFLKEGLNYDITSGRPKLAKWTEELNKLDSYIQTKADPKEVVDLYKKKYLA

SEQ ID NO: 484 - protein, 277 aa, Solanum lycopersicum
MSDNRSQRRRVGESSESEDSGIYNERILILVFASMNWDIPTLCRTASVNRKLRAVARRILWKELCVYRAPQMITALTDGGRIGGGWQAMAKLMFFCNGCQSTRHFQVCRPEAGHFVKTSRFSKTSGRSFLVKKCTSDLLYVSDPCEHSTGSDDLGLFRGVFWGFMKSRTRASLIRRRVELEEGAKCPFCRARVWSMTAARLIPKSAARRLGSMESGLEYFVCVNGHLYGACWLVPLSSDDEGESEEADRRFDDGGGGYFHRENQIVINGSLNYGLTS

SEQ ID NO: 485 - protein, 585 aa, Hordeum vulgare
MEEFISLGDDSTASEPPQPQDHGPTDKDIIDLDQAQADAVDRAAVNLNFNATLPVPSQQQPQDTVTTTKASTVIEIIDLEEGQIAFQESSGAQDAAAADNLQPKDQAQALTANGPEPPPPSQQQPQQDDIIDLEEGQVEDMDLSDDALVTKHGVSAETPKGSDPLVHASKTGSAFIDQSPTRGVKRARTESAEPSVRVVYNNLTRENKRKLMELMQQWSEWQARKQHALTETVEEVLDCGEETYYPALHVGSEKSCAVSFWVDSQARENAAADDGAVPPYDREFTLGSTPMGDSSNAEGKKDKDDSRCFNCGSYSHALKDCPKPRDHVAISNARKQHNLKRNLSNASNRGQNRYYQKTPGKFDDLKAGVLGSETRECLGLRENDPPPWLHRMRELGYPPGYLDEVEDEDKPSGITIFGGEGEANAEQQQQQHEEGELPEKDEPSPPRKRMTVEFPGINAPVPENGDPWLWGSAPPPPLQSSSSGRHQHPSSDSQRDRGPPPPPGVEQYSSSRYHSYDYGPATPGTGRRSSSGYDDGGAFTPHSAYSSRQHSGSGSRERERERERERERERERERHDRHYYSSNRR

SEQ ID NO: 486 - protein, 409 aa, Hordeum vulgare
MAARPPPSPASTPRRHHHLSPAARPGRRDRQLARCFPEPFPKPPNPPNPLLSLLTAVPDWADAVSERRIREPRPLYTHEQWREHRSSLRHLRHLLSSLSYRVILSLVPPVSAFTAFAAAVATYNTLVPDYALTASSLPYQLTTPALALLLVFRTEASYARFDEGRKAWMRVLAGATELAGMVMHSCAGAGERGDNDTGTGALVNYILAFPVALKCHITSNSDIRKDLEGLLAEDDLNVIMSSKHRPRCIIEFISQSLQILDFDEHKRSIMESKLSCFLEGICVCEQIIGIPVPLSYTRLTSRFLVLWHLTLPIILWAECKWIVVPATFVSAASLFCIEEVGVLIEEPFPMLALDAQCKQLHDSMRDMMSVQGLVRKQLVAKAKGRGRGSRLPQNGWPVSSPRSEQVKVD

SEQ ID NO: 487 - protein, 117 aa, Hordeum vulgare
MQAAKEKVKDGVSAVKAKTKITQAKASEKAEAATARSHAERELAHERGKAKVAAAKMELHQDKALHREEAMEHRIHKHGGGHGHHHHKHGVGIVAAPPPATGAGGYYPPPAAGGHYY

SEQ ID NO: 488 - protein, 243 aa, Gossypium hirsutum
MARIYNGKMQIPKSSMALRGAAMAGGACIGRQRATPFVLSSSPLFFRVRSLHSHSHPLLRFTSFPNPKTGFKYQIRAIQEVTADTVKSQKGKEDDEQSSPQNWKIKMLYDGDCPLCMREVDMLRERNKQYGTIKFVDISSDDYSPEENQGLDYKTVMGRIHAILSDGTVVTDVEAFRKLYEQVGLGWVYAITKYEPIATIADSIYGVWAKYRLQITGRPPLEEVLETRRKKKADICNDNNCKI

SEQ ID NO: 489 - protein, 170 aa, Helianthus annuus
MKETVGNPLHLKSLNHISLVCRSVEESIDFYTNVLGFFPIRRPGSFDFDGAWLFNYAIGIHLLQSENPDNMQKKSEINPKDNHISFQCESMGAVEKKLKEMEIVYKRQRVEEGGIYVDQLFFHDPDGFMIEICNCDNLPVVPIAGEMVRSCSRLNLDIISQKQIQTVVQL

SEQ ID NO: 490 - protein, 372 aa, Helianthus annuus
MAELNGGGQYTDFPAVPTHGGQFVRYNIFGNEFEITSKYHPPIMPVGRGAYGIVCSMLNSETNEMVAMKKIMNAFDNYMDAKRTLREIKLIRHLDHENVIAIRDVVPPPARREFSDVYIATELMDTDLHQIIRSNQNLSEEHCQYFLYQLLRGLKYIHSAKVIHRDLKPSNLLLNANCDLKICDFGLARPNADNDFMTEYVVTRWYRAPELLLNSSDYSAAIDVWSVGCIYMELMNRKPLFPGKDHVHQMRLLTELLGTPSESDLGFIKNEDAIRFIGQLPRHPRKSLQDTFPHVHPLAIDLVEKMLTFDPAKRITVEEALAHPYLERLHDVEDEPICPNPFSFDFEQQVLGEEQIKDLIYQEALAHNPEYA

SEQ ID NO: 491 - protein, 92 aa, Solanum lycopersicum
MKKGSSFIAILLVLFLSELLVTEAVTCSVTELVPCAAAIMSSQPPSKECCNKLKEQKPCLCGYLKNPSLKQYVNSPNAKKVAKTCGVSTPSC

SEQ ID NO: 492 - protein, 70 aa, Hordeum vulgare
MVNAIKGLFISCDIPMAQFIVNMNASMPASDKFIVHILDPTHMFIQPNMGDYIKSKMAEFRDQNSYEKPT

SEQ ID NO: 493 - protein, 407 aa, Hordeum vulgare
MPLPSSSSSSAAAAVAAGPAASPLAARSRGRLLRARSGHAAAVRCQRVDPVRLRAVNGSPPCVPLSDRSPWTPVTTPIFGDASIRKDDTRLRILSGTANPSLAQEIASYMGLELGKINIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNVAEVMNLIGDVRGKVAVMTDDMIDTAGTIAKGAELLHQEGAREVYACCTHAVFSPPAIERLSSGLFQEVIITNTIPLKEEKNFPQLTILSVANLLGETIWRVHDDCSVGHAPYSTLDID

SEQ ID NO: 494 - protein, 627 aa, Hordeum vulgare
MMMKMDIILNLQPQKGQGKNCHEKKHEELTEGSEHVLESEMDTSLSALRKSLASNFSPKSCSPRSRKNNFQAISRRIVDSCTVPMKGLGVHHASSENPTPQNESRADGIVEVVVHASSENPTPQNESRADGIVEVVVQEAPLDMMLSNGQLNSPVCGTVGDEAHDMLLTAVLRKQKMDPSCINNAVQKPQESPLDVQPLQVKKFSVRQKGGETHPIQALEGNSDTFDNIQLKGKSNSSCKEIICALTASTCNAPSPLDKQARATDAVSRGADSSSNTKVFASKKSAEKKGVKGLSGPHSSVHGTRTVQKRSAKKVAGRQKECFMERQVDSRGPHTQQQLNMEEKVGVNDGTNHELFPLIPPGFKLICNGQGLLHGEKVDERPIQLHIQDAGSSQCTMENTALRSCSAVGTSLHPPFLSCQISGERFPFIKTSSIWHHIEPMEVFRKVPQEPHFLPLQQFMPELREGMAIGLMVTYDSLVESVKRSCIEDSIELFERKINALAHLEEHGFDVKLLQHSLMKLLEAKWEHTKHLGHLDELKELVPRKESAMSQKHALLVEKEGAIFQLEQKLEYLRGEAEQIARETKDEDAELLRLKVGVNMAQEACVNVEVRFHDILADMSSRLQLSE

SEQ ID NO: 495 - protein, 922 aa, Hordeum vulgare
MNVFAGVGGSAGERGGAGAGSGAAARDAGSADFGALLELTPHKMAVCHLVQVFAPPAQQQAPPFPFESAAHHNRLGLFLFALTRSCEDFLEPPLEELLRQLKAVDDLVNGWLCEQLTTTLAGLNSPDDLFNFFDKLRGVLTSPEGGNVGDEFLDPNSQLGVFLRCCILAFNSMTFEGVCHLLANLVAYCNSADASYDLAEDEDFNSEIEMSDPMDADIGVRSGVFDRYTQGYATGSHMGESSSSLIQAPTSLHNFDEADIFKAEDSPTCLRSRWQLEAYLNQQADVLEKDPSSVPLNSFNNTMTQLQTLAPELHRVQFLQYLNALCHDDYVASLDHLHRYFDYSAGMQGLFSRSLSPHQDNIVGKYESALLCLGNLHCYFGHPKKALEAFTEAVRVSQMNNDDSCLAYILGAISNLLSKIGISSTVGLIGSRYSLGNNIGLGTPLSIQQQLLVLLKRSLKRADMLRLTSLLSFDHISLAKFDLKHVQRPLVSFGPNGSTKLRTCPADVCKNLRLSSHVLSDFGTDSLSISNDNGSFSTSWLRNLSDASRSWSNSSAKTRKLIANDFDNFHFHAQPSPIPTSVLQLAGSAHLMRATAWEHYGSAQMVRMNTLVYATCFADAASSSELSLAYVKLIEQLAVFKGYSAAFCALKLAEEKFPSSMNSQIHLLKMQLLHERALHRGHLRIAQQICDEFGVLSSSVSGVDIELKTEASLRRARTLLAAKEFSQAAAVANSLFTTCHKYNMQVENASVLLLLAEIHRKSDNAVLGLPYALASQSFCKSFNLDLLEASATLTLAELWLALGSNHAKRALSLVYQSLPMILGHGGLELRARSQLVLAKCHLTDPEFSVSEDPCAVLDPLNQAAEDLHVLEYHEMATEVYYLKAMAYNHLGKLDEREEAAARFKEHVTTLENPRDEEDSLAY

SEQ ID NO: 496 - protein, 600 aa, Hordeum vulgare
MGRWCSPASAGPRSVQLLPLGVALVAASFYAGTLFQSSASPALILPPSASRSSGSSEPQGASELTNKVALTYRTALISVPAHGLDVCPLEHSEYVPCHDAAYVSKLRELDRSRHENLEAKCPPREESLFCLVPPPNDYKIPIRWPTSRDYVWRSNVNHSHLSEVKGGQNWVHENGKLWWFPGGGTHFKHGATEYIERLGNMTTNSTGDLRSAGVVQVLDVGCGVASFSAYLLPLDIHTMSFAPKDGHENQIQFALERGIGAMISVLATKQLPYPGNSFEMVHCSRCRVDWHENDGILVKEVDRLLRPNGYFVYSAPPAYRKDKDFPIIWEKLINITTSMCWKLIAKHVQTAIWIKPEDESCRQKNADMGILNICDPSDTSSWQAPLMNCVRLNTDQLKIQKLPSRPERLLFYSRSLELIGVTPEKFENNNQFWRDQVRKYWSFLGVEKTSIRNIMDMNANYGGFAMALSTDPVWIMNIVPNTTINTLPVIYDRGLIGSYHDWCQPFSTYPRSYDLLHAFHLFSHYQGHAGGCLLEDIMLEIDRIIRPQGFIIIRDENTTLSRISDLAPKFLWDVTTRTLENEENRPEQVLICRKKFWAIV

SEQ ID NO: 497 - protein, 664 aa, Hordeum vulgare
MAAAPPDGQEKVIAAAPQIVKSLANSKNAADDMIRILSGFDNRFSLMSDLFPAAGTPDAAAGSELPEGDEEEVEYGRERGPGYGGDDDDLEDERDAAVEDALRLIEQWDSPATGDRLVLESPEDAEEYLAAAACLMGEAGPRVEAALQVAMARLEEEFRQLLIRGTASLAADDLHASLLRRLSLTVPTFHSASSVDLECPSFASQPDEGDEAASAAGRWSSVSDGEISPYLISPDTVSTLKDIADVMLRAGYGPELCQVYSEVRRDTLMECLAVLGVDKMSLEEVQRVEWGVLDGKMKKWIQALRVVVQGLLAEERRICGQILAADADTEEECFTEAAKGCVLQLLNFGDAIAIGKRSSEKLFRILGMYEALAELLPELEALFSGDARDSIKEEGEGILVRLGDAVRGTVAEFANAIRGETSRRSLPGGEIHPLTRYVMNYVRLLADYSRWLNHLLDGCETELENGGDNADMTPLGHCLLILITHLLDKIEDKAKLYDDEALQNIFLMNNLWYVVQKIKDSELKTLLGDNWIRKRRGQIRRYSTGYLRSSWTRVLACLRDDGLPHATGSSSALKAALKERFKSFNLAYEELYRTQTAWRVVDPQLREELKISISEKVLPAYRSFVGRFRGQLEGGRNFAKYIKYNPEDVENQVSDFFEGKKLNA

SEQ ID NO: 498 - protein, 448 aa, Hordeum vulgare
MSAGATINWIRTPFHTQRFHDFSSLSFRCRNTFGSIQPCWLATDQDSSLSKVRVAADYSDSLPDSKYMRDRGYHPLEEIKERPKKKDISLTDVETARTVVEANSKGLLIFPARVHNEPHGHVSWSEFQYVVDDYGDIFFQVPDDGNILEDDDANNPVTVLIGTDGAIIGETSVVTSDFNDHVVIEDSMDMHDDDSKVDTEITNILIEWGMPVTMRSIHPIYFAKCLTKAVHDNHGEKIDNPSNGVSIVGHLRPAFIEEESYLRSLFHSECNADGYSSEWREEYNREPRPASGTNGLIDGDKLRLDINDAGSSIDSTIYKLEMMTIELFSVYGKQFMIDPQDFQDAEPDLLSNHASDIIKRMEENSDQCTMALRSLCSRKKGLTVEEARLIGVDSLGIDVRAFSGLEARTVRFSFNAQALSERSAEKKIKRMLFPRYRKTVKASAEDEC

SEQ ID NO: 499 - protein, 1402 aa, Hordeum vulgare
MGSLTKAAVEGAFAAADWSDEAVIYVNGVRRVLPDGLAHLTLLQYLRDSVSLLWLARRPFCNRRISGVRSLSLYQIENLPDIGLRGTKLGCGEGGCGACTVMVSCYDQTTKKSEHYAINACLAPLYSLEGMHIITVEGIGDRQRGLHPVQERLAEAHGSQCGFCTPGFVMSMYALLRSSKHPPTEERIEDSLAGNLCRCTGYRPIIDAFRVFAKTDDSLYTASPSENANGQAICPSTGKPCSCRNETDVNANESSTSSSVKIYLPCSYNEIDGNSYSEKEPIFPPELQLRKIMPLKLNGFNGIRWYRPLKLEQLLHLRSCYPDAKLIIGNSEVGVETKFKNAQYKVMISVTHVPELHTLKVEEHGLHIGSAVRLAQLQKFLKNVIAERSSHETSSCHAILRQLKWFAGTQIRNVASVGGNICTASPISDLNPLWMATGANFQIIDVNNNVRTIAAKEFFLGYRKVDLKADEILLSVILPWTRPYEYIKEFKQAHRREDDIALVNAGMRMHITEAEGNWIVSDVSIVYGGVAAVPLTAAKTEKFLVGKKLDDGLLDETFNFLKEDIPLAENAPGGMVEFRSSLTLSFFFKFFLHVMHEMNIKGLWKVGLDAANMSAIQSYTRPVSIGTQGYESVGQGTDVGQSMVHMSAMLQVTGEAEYVDDTPTPPNNLHAALVLSKKAHARILSIDDSVAKCSPGFAGLFLSKDVPGSNHIGPIIHDEEVFASDIVTCVGQIIGIVVADTHDNAKAAANKVNIEYSELPAILSIAEAVKAGSFHPNTTRCISNGDVEQCFSSNTCDKIIEGEIRVGGQEHFYMEPQCTFVWPVDSGNEIHMISSTQAPQKHQEYVANALGLPLSKVVCKTKRIGGGFGGKETRSAIFAAAASVASYCLRRPVKIVLDRDVDMMTTGQRHSFLGKYKVGFTNDGKILALDLEIYNNGGNSLDLSLAVLERAVFHSENVYAIPNIRVSGKVCFTNLPSNTAFRGFGGPQGMLIAENWIHHMATELKRSPEEIKELNFQSEGTEVYYGQLLRNCTMHSVWDELKASCNLLEARKAVNVFNNENRWRKRGIAMVPTKFGISFTAKFMNQAGALVQVYTDGTVLVTHGGVEMGQGLHTKVAQVAASSLDIPLSCVFISETSTDKVPNASPTAASASSDLYGAAVLDACQQIKARMEPIASRGNHMSFAELAQACYMERVDLSAHGFYITPDIGFDWIAGKGSPFNYFTYGAAFAEVEIDTLTGDFHTRTADIVMDLGYSINPAIDIGQIEGAFIQGLGWAAMEELKWGDDNHKWIRPGHLFTCGPGSYKIPSINDIPLNFKVSLLKGVPNPRAIHSSKAVGEPPFFLASAVLFAIKDAIAAARAEEGHLDWFPLDNPATPERIRMACVDSITKKFASVYYRPKLSV

SEQ ID NO: 500 - protein, 496 aa, Hordeum vulgare
KTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSKETTQLNAVTTRTTNVHGDELIITTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHSKILENNKQWDGEKCIILTCSFTPGSCSLTAYKLTPSGYEWGRSNKDNGSNPHGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 501 - protein, 262 aa, Hordeum vulgare
MSAAAVAADTYSPAAEAGSKRRERREELRRHLAEDADWPRADGRSLHDCRPAFMQTGPTTAASGSAYAEFGKTKVIVSVFGPRESKKAMLYSDTGRLNCSVSYTTFATGIRGQGLENKEYSGMLHKALEGAVMLHTFPKTTVDVFALVLESGGSDLPIIISCASLALADAGIMMYDLVTSVSVSCLGKNVIIDPTSDEEAWQDGGLMVSYMPARKEITQLTLTGEWTDGKITNAVELCMDACSKLCEILRERLKDPASLASE

SEQ ID NO: 502 - protein, 204 aa, Hordeum vulgare
MAAAAGDGGSVPPKSPTAEAPPASQPRLTPNTMPWERCVAGVQSALKDPLARFLREQIEKAGCTVWPTLIRAAICTASGGYTSGKGIEVCCNHMRKQDEITQVIIHELVHAYDDCVVKNINWNNCAHHACSEIRANHLSGNCHYKRELMKGFLKIKGHEPECVKRRALLSVQNNPSCRGKAAKEAVENVWDTCYNDPRPFDKAP

SEQ ID NO: 503 - protein, 348 aa, Hordeum vulgare
MERWRRVSVLAMALLLLSACHGAEFSVKNHDQSLIYDHTLAKTIVEYASAVYMTDLTALYTWTCSRCNDLTQDFEMRSLIVDVENCLQAFVGVAHNLNSIIVAIRGTQENSVQNWIKDLIWKQLDLSYPNMPNAKGFFSSYNNTILRLAITSAVHKARKTYGDIGVIVTGHSMGGAMAAFCALDLAIKLGSDNVQLMTFGQPRVGNAVFASYFAKYVPNTIRLVHGHDIVPHLPPYFSFLSKLTYHHFPREVWIDDSDGNTTEQICDASGEDPNCCRCLSILSLSIQDHFTYLGVDMESDDWSTCRIITAQSVERLRKDLASNIIMTKHDADVSIVENSVQTDWSSSR

SEQ ID NO: 504 - protein, 203 aa, Hordeum vulgare
MGKSKSKGAKFAAVKKIISKKTIKKHKEKLLEEVLDPRKKAAEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 505 - protein, 320 aa, Hordeum vulgare
MSRLMAAMLLGGARVASATALTGNTAVKAIPRPCFLAPRPHAASWSPICMQTAPRSSQAYNNAPDDRRDIKDKYRGAAEQAKDATGDAKESAKGQASRMADETKDKAGDAAQRASQMTDKAKHETKETASQAADKAGEMKDRAKETAEEAAEKASRMTEKAKHETKETASQAADKAGEMKERAKETTGQAMDKAKETAGAAKEKTAEVAEGAMDRAGEAKDRAAEGTRSAGEKVAELTKEGASKVAETAQAIGEKAKQAAQGAWDATKGAAQGVKEKVVSESTTEEHSTWDDVEAATKERDRIAQEERKRQAREKGAGLP

SEQ ID NO: 506 - protein, 526 aa, Hordeum vulgare
MELATAAVVSTASIHHGRSHSSAPRTASWSSSSSPSSSWSLSIPASTSRSQRRRLPVTSAAVELREAAAGGGDSVRVIETPQPNSCVKFSVEVPPSICQECYQTTLLEYSKRFKVPGFRPGKIVPENVLLNYVGPQHVRAATVEAILRHTLPQALSSVEERALEDSVRILTKFDDMNEAFSLDHVFRYDVAVDVVPEVRWLSEDKYKNLKVVIEIDEIVDAEKAAELELKRRRKSLGLLRIVTDRGLQVGDLVVLDILAETITTDGSKGEKIPSAESTGFHLDTEENTNLVPGFLGSLIGIRPGETRTFPIQFPESFEQETLQGVRAQFTVVCKELFYRELPELDDSLAAKLLPGCNTIDEVKERILERCKEVEKTAIEQATDNAILDQLGKLVDVDVPRSLFQEQGQQLYGAKLLQLQAERKLDKDQLASLSSEKSVQEYLKSERENITRIIKQMLVVGEIFKAENLQYSTDQLVKEVENSIEEFKRYNQDYDEGNIKQQVQDVLEAAKVLEWLKENCTIEYIKK

SEQ ID NO: 507 - protein, 669 aa, Hordeum vulgare
MVQYNFKKITVVPPGKDFIDIILSRTQRQTPTVVHKGYAINRIRQFYMRKVRYTQQNFYEKLSTIIDEFPRLDDIHPFYGDLLHVLYNKDHYKLALGQINTARNIIAKISKDYLRLLKYGDTLYRCKCLKVAALGRMCTVLKRISPSLAYLEQIRQHMARLPSIDPNTRTILICGYPNVGKSSFMNKVTRADVDVQPYAFTTKSLFVGHADYKYLRYQVIDTPGILDRPFEDRNIIEMCSITALAHLRAAVLFFLDISGSCGYTIAQQAALFHSIKSLFMNKPLVIVCNKTDLQPLDGLSEEDMKLVMEMKSEAMKTIPQGGDPSEEGVLLTMSALTDEGVMAVKNAACERLLEQRVEIKMKSKKINDCLNRFHVAMPKPRDNRDRPTCIPQAVVEAQAIAAAKEKKKLERDLENENGGAGVYSASLKKHYLLADDEWKEDILPEILDGHNVADFLDPDILERCEELEREEGLRLEEEAAQDAFMIDGHDELTEEQREILGKIRKKKAMLIQEHRMKKSTAESRPIVPRKHDKDRKFTTKRMGRQLTSMGVDPTAAVNRLRSQSRGRKRERSLSRADGDNAMDVDGQHSDKKLRTRSRSRSKSRPIEEVVPGDGIRDVAQKKKAIKKSRDSVKNRNKEARRGEADRVIPTLKPKHLFSGKRGIGKTSRR

SEQ ID NO: 508 - protein, 235 aa, Hordeum vulgare
MGSLHKGGVWWLLLLAAVLLATAAAGAEQDDGAAATAVPEVEVEVEEVGRPVDDQGNDSCDIKCQHHKVPARKKQCVDECHSREHHHPSRASCERKCSHWRDPARKEQCVQQCMRYGLNLDVGGGDDVIERPHAEEVEVDDQSNDSCDHKCQHHKVPARKKQCVDECHRREHHHPSRAACERKCSHWRDPTRKERCVQTCMRYGLNLDVGGGDGDGDGEQLRRWEAVAGAIIEVV

SEQ ID NO: 509 - protein, 299 aa, Hordeum vulgare
MSMAATAPAAATATAWPSTSSSIHHHATPNPRALRSGFLGRALTLCPHPVDARAAAAVSVRAAWDGPLSSARLIMQGRNVKLTEKLKEHIEDKVGRAVSNHAHLVREVDVRLSARGGDLSKGPKLSRCEVTLFTRRHGVVRAEEEEESSYASIDAAAAVVKRKLRKIKEKETDVRHLKGTKEWQAADADATGFSDVEEESELELEEDDLVEVIGAEDEETVLTKVVRTKVFEMAPLTVDEALEQLENVDHDFYAFRNEQTGEVNILYKRKEGGFGLIIPKQDGHVDKATVNAKEHPVAG

SEQ ID NO: 510 - protein, 210 aa, Hordeum vulgare
MASGVFGTPISEKTVIATGEYKEPITQKDVADYTMKMINAGGKDINAQTFVDNLKERYGNGIAVKCLIYNATGATLSLAKYNDWHGHIYDTPYPSDIQNGQWGAFLHVHPSGAAVGSAGAVVYRTKIPSSTRSCDWLFSWTVPYIGANGVYTEIREEGHYPNVGSWGYIYGVKLANSDLNSTDKNYGYVSKTNIGEGSTMNARGVFQYPY

SEQ ID NO: 511 - protein, 75 aa, Hordeum vulgare
MSCNCGSGCSCGSDCKCGKMYPDLTEQGSATAQVAAVVVLGMAPENKAGQFEVAAGQSGEGCSCGDNCKCNPCNC

SEQ ID NO: 512 - protein, 262 aa, Hordeum vulgare
MSLQCTANSLRALAALPAPSSSRRLARNAFLMPCHTSRIGALVRAADSSPPAAPASSSGAADNKAVIPDDEFTLAKVSFGVIGLGIGGSLLSYGFGAYFNLLPGSEWSALMLTYGFPLTIIGMALKYAELKPVPCITYSDAFALREKCATPILKQVRSDVTRYRYGDEQHLDEALKRIFQYGLGGGIPRRSAPILQKIQEVTDDGKYCLVLEFEAKSLGLSDFEKRQAKFTSFFGPGIEAKIGKGGDDLYEVRLISETTEEE

SEQ ID NO: 513 - protein, 833 aa, Hordeum vulgare
MATLTSELLRPVHEAQALDEAALLRYAAAHVPGFPAPAPALALTQFGHGQSNPTYCLEASAPGGEPRRYVLRKKPAGAILQSAHAVEREFQVLKALGAYTDVPVPKAFCLCTDASVIGTPFYIMEYLEGALYLDNKLTGITPDKRRNIYLAAAKTLATVHKIDATAVGLHKYGRRDNYCKRQVERWGKQYLHSTGEGKPARYQKMLDLIGWLKENIPEEDSSTGLGTGLVHGDYRIDNLVFHPTEDRVIGVLDWELSTLGNQMCDVAYSCMPYIIDGALSENSSYGGFEHSGIPDGIPQLEEYLAVYCSMSARPWPAANWKFYIAFSLFRGASIYAGVYHRWTMGNASGGERARFAGKAGNVMVDCAWDYINRENVLRAHPATGMHVSKAPQQGFHVEQEDSTLTSGQGKFVPSEKVMKLRHKIMKFMKDHIYPKEDELYKHAQSTSRWTIHPEEENLKALAKEEGLWNLFIPLDSAARARKLLLEDRSYVSAGSSNDLLLGAGLTNLEYGYLCEIMGRSVWAPQIFNCGAPDTGNMEVLLRYGTKEQQKQWLVPLLEGKIRSGFAMTEPQVASSDATNIECSISRQGDFYVINGRKWWTSGAMDPRRKILILMGKTDFSAPKHKQQSMILVDINTPGVQIKRPLLVFGFDDAPHGHAEIIFDNVRVPVTNILLGEGRGFEIAQGRLGPGRLHHCMRLIGAAERGMNMMVERALSRTAFGKKIAQHGSFQSDLAKCRIELEQTRLLVLEAADQLDRHGNKKARGILAMAKVAAPNMALKVLDMAIQVHGAAGVSSDTVLSHLWATARTLRLADGPDEVHLGTIAKLELQRARL

SEQ ID NO: 514 - protein, 324 aa, Hordeum vulgare
MSSRMAGATLLRHLGPRLFAAAEPASGPAASARGVMPAATRIFPARMASTAAAPHAKQEEATEKPQGATTPEQAVSYWGIEPRKLVKDDGTEWPWFCFRPWDTYRPDTSIDVAKHHEPRALPDKVAYLIVRTLRAGSDLFFQRRHASHALLLETVAAVPPTVGGVLLHLRSLRRFEHSGGWIRALMEEAENERMHLMTFMEVTQPLWWERALVLATQGVFFNAYFVGYLVSPKFAHRFVGYLEEEAVHSYTEYLKDLEAGLIENTPAPAIAIDYWRLPADARLKDVVTAVRADEAHHRDANHYASDIHYQGMTLNQTPAPLGYH

SEQ ID NO: 515 - protein, 207 aa, Hordeum vulgare
  misc_feature (183)..(183): Xaa can be any naturally occurring amino acid
  misc_feature (200)..(201): Xaa can be any naturally occurring amino acid
MSRSITHLVCWRLEGKKYDIARRLRVRIVSHRWFLHCLQQGTRLPEAPYAMESGEEAGPVPQLSDLPGRRSKRNASREDPCVKELPSDLCNTSYASDVVKIDDSDSDSEHRGWLESSLLKENLAVAGNSKNICSGDVKGGKKHLKRERKSTDKDFLRLRDNASRFREDPCLKELPSNLCSTSXARDVLKIDDSDSDFEYXXGWIHTY

SEQ ID NO: 516 - protein, 562 aa, Hordeum vulgare
MLGRLAARRPRPGSARAAAAYRSSASVLPDALDRSSDAYARNAAAVGGLLSDLRSRVSQVLGGGGAGAVKRNEGRGKLLPRDRIDRLLDPGASFLELSQLAGSDVYEEALPSAGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKISGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKTVPEDTKYGVFRM

SEQ ID NO: 517 - protein, 531 aa, Hordeum vulgare
MAPAAAAPAPAATACSSSASSARPPSTASSSQSPPRRTVPALLLFISLAALLILSSGEAHDPDADSGRPLKDVSLEYPEVTFAPSSMGGIFCERIRISKIPRWQFQSYANQIHIRMNVSHSLPEKFHWKIQICFHGNVSTGLCQCEMGEWQALHGGTWNAVKSPYNSRYVDVKLTDKKSAVFSLSIQEELQKWRLACLGIGFVLLFLSPIVSKWAPFYYSSSMALGILLVVLIVLFQGMKLLPMGKKGLFYLTIYGSVLGVGSYAAHYFSSVVASILENFGLSEEMHNPVSIFLLVAVVLTGAGFGYWMVRRYIISKDGCVDAGIAQFVKWAMRVVGMFFVMQSTLDPILAFAALAATSWVCSVLTTKKVHKPTAPKRKQSNVSSHPRFTQVSPNTRQVQFLSPSSRAGTGRATTTQYGWNYLANGGLASSALVKRLAPNQDEDYYSTFHNIEPRKYSKREWEEFTEESTRNALMEHTATPEFAQWAADNAHRLRVERDDSSEDESIETSSGSSEEAEKGGKASSLLGRFM

SEQ ID NO: 518 - protein, 307 aa, Hordeum vulgare
MEILQQGTMSMFPGMDLTKMDPPTLTLLGAACCVMLSMHFTIQLVSQHLFYWKNPKEQKAILIIVLMPPLYAMTSFAGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILIIVLQLLGLYPSWVSWTFTIILNFSVSMALYALVIFYHLFAKELAPHKPLAKFLCIKGIVFFSFWQGCALDVLAAVGFIQSHHFWLDVEHIQEAIQNVLIILEMVIFSVLQQYAYHVAPYSGADKAKFEKKNE

SEQ ID NO: 519 - protein, 551 aa, Hordeum vulgare
MDGAGMATPPEANTSPAPNGGGCGWIRVENCYVFKSRLQEYVQKAGLMTPEYQTLKEGPSHAPIFSSTVVINDVKYDSLPGFFSRKAAEQSAAEVALMEIGKSMALPTNATIPAVQETGLCKNLLQEYAQKMNYAIPSYICNKQSPYICTVEIGGIQYIGATARTKKEAEIKAARTALLAIQVAGQSEGCANGTTKYIVVPGKRQGKDTEKKPVETPKSLKTKKGGFKKQRNKNKFIKKNGQEVNEGKDETGVPGDAHHSDVPMKPAVTTEDPSANTVMMQPDEEAWSFEHEPASDTAMLQPDEDALPFEHEPSGNTAMLQPDGEATKVGQEHLSDTAMLQPDEDAWPFEHEPAGNTAMLQPDGEATKVGQEHLSDTAMLQPDDEGRRGKQEPLIGTAMPQPHMEDRRVGAEPPRDAAMVQPNDEARCVKQELLIDTAMPLPNEEAGAGANPVPPSDSTTAQPNAETTNINGESLRNAASAQHNEEARTLNQEPPSSASLLQPKEPRVENGEFVSENKDQTLGDASREANRSIEDMPEKSSNNSSAFTSAE

SEQ ID NO: 520 - protein, 248 aa, Hordeum vulgare
MELVSSSRSVLSSCNRLVAPSTSRTASAAARRHGKSLVCVLGGDTNGEFKIGKRAALALFFATPTLSLAFSAHSKTKTINPYEERRLLQQNKKIQEANRAPDDFPNFIREGFQVKVVTPDNYITRDSGLIYEDVKVGTGDCPKDGQQVIFHYVGYNESGRRIDSTYIQGSPAKIRLGNKSLVPGFEEGIRDMKPGGKRRLIIPPELGPPVGPSTFFSAKQFEVFDVELLSVQDCQRRTIAFYSDVVCT

SEQ ID NO: 521 - protein, 107 aa, Unknown
  Sequence found in Organisms: Gossypium hirsutum, Hordeum vulgare
MACAFFFDAEPLGEPGVRMHGPELELHACALCTKPLQSNSDIFMYKGDTPFCSEDCRYEQMHFDAAMARQQASARRKQQQQQQAQAPLGVPGAPAPVSAKADVSVAS

SEQ ID NO: 522 - protein, 283 aa, Hordeum vulgare
MEAEYPQINPLRLCSRRRKREEDEGGIELLLSMDLDEEETRPEQQAPPRVPEKLKAVGQELGHEIRIFSSTTFELMTSKLPRADQEEDDDFYELQPGDYYKLISNRLAEQSKVLKTRKIREAELAAQRARLTKAVMRVRFPDGYILEVEFHPSETVHSLLDLLMKVIARPDLPFYLYTVPPKKRIMDTSQDFYTIGFVPGANVFFSYDLPEGSELNTDGVKSGPYLREEIRTLDGLSLHSEPSDQPDVSKTNSDSAHQSEAFRPDSAPPPANKKSAKPKWFKR

SEQ ID NO: 523 - protein, 491 aa, Hordeum vulgare
MTSKVPNSSGSSDSAEPKLSPSGLSVREVPGGYGVPFFSPLRDRLDYYYFQGAEEYFRSRIARNGGATVLRVNMPPGPFITANSRVVAFLDARSFSVLLDDAKVDKTDTLDGTFMPSLVLFGGYRPLAFMDAADPRHAALKRVMISLAAARMHHVAPAFRTAFGAVFDAADAGLSDGPVEFNKLNEHHIFDFTCSALFGGTPPSKAMGDGAVTKAIKWLGVQLHPLASKIIKPWLLEDLLLHTFRLPPLLVRGDYAALTAYFADAAAGVLNDAEKAQSGISRDELLHNLVFTAIFNAYGGFKIFLPHVIKWLARAGPALHARLASEVRAAVPNDSDITVSDVDKMPLVKSVVWEALRMNPPVEFQYGRARQDLVVESHDAAYQVRKGEMLFGYQPMATRDERVFKQAGEFVPDRFVGGEGRLLGNVVWSNGPENSEPAEGNKQCPGKDMVTAVGRLMVAELFRRYDTFTADVKEMPLEPVVTFTSLTTRAE

SEQ ID NO: 524 - protein, 306 aa, Hordeum vulgare
MAPPRPRPQPALLLLLLVSLLAASAPRRADAWGKEGHIMVCKVAERYLSEDAAAAVQELLPESAGGELSTVCPWADTMRFRYHWASPLHYANTPNVCNFDFSRDCHNSRGEQGMCVVGAINNYTDQLYTYGDSSSKSSYNLTESLMFLAHFVGDVHQPLHVGYEEDEGGNTITVHWYRRKANLHHVWDVSIIDTVMKDFYNKSLDTMVDALQTNLTEGWSDDVGRWESCANKKATCANDYAIESINLACNYAYKDVVQNITLGDDYYLTRYPVVEKRLAQAGVRLALILNRIFDKKKADAMPLYIQ

SEQ ID NO: 525 - protein, 1015 aa, Hordeum vulgare
MASKFGLAGGIPERRVRPIWDAVDSRQYKAALKLCTSLLAKHPTSPYALALKALTLERMGKPDEALTVCLNAKELLYSNNIFHFDDLTLSTLQIVFQRLERLDLATSCYEYACTKYPNNLELMMGLFNCYVREYSYVKQQQTALRMYKTVGEERFLFWAVCSIQLQAYFSSGGEKLLAFAEALLKKHISSHSLHEPEALSLYVSILEQQAKYDAALEVLSGDLGSLMGREEDKLRLQGHLLTQACNYVAASEIYQKVLESCPDDWESFLHYLGCLLERDVKLPKPTTGEHTCSSCSVDSTMLSKTSLSEELVESRLASALLFVQKLQKNDSSDSVRGPHLANIEIERQHRLSGNSTKFMEALVNYFHRFGHLSCSSSDVEIYLHMLSGDEITELLDTISRSFDASSVSVKALGLTITTFKVQELLGTLFSKSTTDLQRIAKGMVETFYKNLSLSRDLDPQESIHGEELLSMASSILVQLFWRTRKLGYLLEAVLVLEFGLTVRKHVWQYKISLVHLYSYLGALPLAHRWYVSLEVKNILLESVSHHILPQMLSSPFLEQTASLVKDYLRFMDDHLKESADLTCLAYRHRTYSKVIEFVQFKNRLQCSMQYLAVKSDSVILSLKQKSESLEEVESVLENVNHGGGLVDLSNEDNMKHLTFNEDLEARPWWTPTTSVNFLSEPIDESSTPACFRAKVCKHKSTEKDGPKMGDAERKCLVPRLVYLSMRGCVSSLRETEHNGSVSDITVGEMKTLLEKYARTIGYSMDDALSMILGISSGKKSMKDFAPDIVSWMSFAVFINAMNLWSNESVIPRTEPSSPSSWEIVDSLVKLCIEEHLTDANRILTCPGNKIPLLVQMVTEPISWHLIIIQSCTRVVAPQGKKKKKSGPSLRTNMPQLQGIQRSVQCLIETLQSVQKWLSDQMSPEEQGLDILLSYFQGTGDEGPGQTFRVLEEKPAAHASELGDRIAQSLEAWSSTSVVRRIVGAEHEVLAEFKKMVDSKLKLLMSESASLSSVLH

SEQ ID NO: 526 - protein, 451 aa, Hordeum vulgare
MAFSARRSLATGLSSHLTRRLHPSLSHLLPSSHHDNNHENPTSSAPPFPTQQTPHFPSGDLRRRARSQGLALPLPFGAHLAAHRGFSTSGSSPGPQIDGILTDPVAGQMDVAAGVLSDAAASVAPAFPLPFPGEVAAAAADSFPPVAALQYLIDAVHSFTGLNWWASIAVTTILIRTVTIPLLVNQPKSTMKLNAIRPEIEAINMEMQNSMDPQSMLEGKKKLGELFTKRGVNPLTPLKGLFIQGPIFMSFFFAIQNMVEKVPSLKGGGAYWFTDLTTPDELYILPVLTSATFLATVELNIQEGMEGNPMLQTMKKFSRILALMTIPFTMHFPKAIFCYWVTANLFSLGYGFALRKTAVRYFLNLPEIVPQPAPAEVSTFNLFKAPKPVSAVNTPTGDNGDSSTVVNSDSTTAVNGSEQSNAELSDRVVFLEKKIAELERRAKARGESQEE

SEQ ID NO: 527 - protein, 366 aa, Hordeum vulgare
MWAASPAFRRQLFLLRSLAPTCVDGGRVSSSSLRLHAMSAAPAAAGPVYEADAEAVVRRITPPLDRARHKGQAGKIAIIGGCREYTGAPYFAAISALKVGADLSHVFCTKDAATVIKSYSPELIVHPILEESYSVRDDERESVSSSILTEVIKWMERFDCIVVGPGLGRDSFLMDCVSNIMRHARQANIPTVVDGDGLFLITNNIGLVEDNSLAILTPNVYEYKRLVQKVLNCEVNEENASEQLTALCEKIGGVTIMRKGKADLISDGKKVTQVSTFGSPRRCGGQGDILSGSVAVFSSWAWHFLSSNEQPKENSVNPMVLGCIAGSLLLRKAAALAFEKNKRSTVTTDIIEFLGQSLEDICPAGR

SEQ ID NO: 528 - protein, 113 aa, Hordeum vulgare
MQTAKVKVKDAVSSAKEKAKEGTAKAQGKTGKATATTHGEKEMAKEETRANKAQAKAEMHQEKAEHRADAAAGRHGTAHTGPHGHHRPAAAAPADPAYTGTGAGAYPTTDKYV

SEQ ID NO: 529 - protein, 593 aa, Hordeum vulgare
MEAAEDAGGARSTARKLVPWSSWAEWRLVRDAIFSPYPDPGAALRRIAAWRSRGCLPIPVEVTAALFEIRLRDPFFRNGVASDDKLESDEMLALLYSMAIIRLVNGFMESPHKETGRSISDLAETVGVPRILVDIRHESSHRGIPSLRLLHLAAIKAFDWLKCNYWDSQTSAIPDVRLELSSVLHDIAQFLKGKDSENAKSGSKRKRSQKHILNAIKYVRRLYYTCPSEAISVLLEFFQLDAPEISDSDVHQADSLDGNPSSDVQSQNQISNGDMKTIITKPSEKEPRVLLGLLKSIIEMIEARNDLEHKGGSYASLPAESPTMKSLCSLVLWIVASIKELKDSGRIGLVHEIGVLSPDKNAVPRFCLAKLLQKFLTLPVIGERCIADAALLLIEMASNNNVKEKLRKLPLLSLRRSPKDCTLIESRILSNGQESVESATQKLEAFKLQLRKPDNASIAENGTEGTFNTSVPEKRNRWSVAKSWTPCPLGMIPCSYSSTAVLPVLDIIDDELEHDTAEHGNFEDDGQIEIADPEKQLDDEGFLEISRSPPEHGISVMPELIHGLKGTLLVGGVWKKVTEEELLSIKSSMKILL

SEQ ID NO: 530 - protein, 540 aa, Hordeum vulgare
MTAADAAAESDAEARSILERAAAASFPPLHAVHHLLSVGVCVRCIFRMFGAFSHACSCASLTVSVLHSFLEEHDDSAKGGSCSCLSMDEACCSICFGILLPTCHQDEGVAPFEDISRIDIITSMVSQAIQREGYQIGEFSTEISVPAVVAANERAIRLYMKGKYGSENWFKDEIFTQQTMSVKEALRLLIVPSLEKQLGVKHSNNSFRIRLTYTHDDASLKLKSLLPNDSNRKRKAESREGNDTRRNSTYDDKQILTETDTFIHKSLEGIQDQEFCTLFKLPPEKVLKPCQLVISFLRSPIYIGGRYLKLSRNVSQSCWIIDDERMGEASVEEIIKENVCAISSGDGYKFHAAGREDIDVRMLGSGRPFLIEVLNVRSIPTAIEIQQISDKINSSEKKYVRVRNLKLVDNEIWAMMREGESERQKQYAALIWTSNPLTDDDLQKISVVKDMEIAQNTPVRVLHRRSPLERKRIIHWMEIEKVEGSSNYYLLHLCTQAGTYIKEFVHGDLGRTNPSIGSMLRCRAEILQLDVTDVKMDLLQ

SEQ ID NO: 531 - protein, 458 aa, Hordeum vulgare
MPPSREQPAAADGGIEENAMAILDTFGIKDSRDLHDDRAAFLEAVRSAGLAGDKPSSPTRRMYDAVFQILQSSTSLELTIASFHLLMELGKQYPRVYLTNSGSRQALVTVNESWSPFLLGNNVASGEIGRNTSRSDHLFDSLRFSLLTEAMVEASNATGAHNGLKHIENMVLFQYLVCTLEADFVPRHIAYKESLDWVIIRESVLNVLLGSRKLVFKMFVKNCISLLNQHQREVEDDVSYKSASDLDSSLTFSSLEFEREALTSVKKLFIMVINLDLIRKEADKLGLTSRADGLRNPILEVILEELTYNQIYLSPFLLAFTEWKWKLQIILQYFSRYQVKPAVRTRRSDNSQQDLTVESALSMFSTEASAKAMVKMMCPEVAQLLLAHAYQVCLSLDGDSSKANDAAKMMGASLLEISCKFVSAFQNLRKINTSIQISQFEKEALFTAATLTSKLQNE

SEQ ID NO: 532 - protein, 1075 aa, Hordeum vulgare
MEVDPSPSPPPMSTPGYFDPDSSRLREEYRRYRKRLSSSNDSPMLGTSVSRFSEARSLHDGSSIPRRPNAGLLLEDVKQEAADYSDIDGLNGPKLFGSAKRTSLNGGSGRRAARSALNLVKLEDDMPREGETTSTTFASLLDSAIQGLMPFPDVILQFERTCRNASESLRYAATGNIRMAEDKLMQQKAKLLLDEAASWSLLWYLYGKANEELPEGLFMSPTTSHQEACRYVATDLTAQLCLRIVLWLEGLASESLDLEKKVRGSHVGSYLPSSGVWHRTQRHLKRRNNDSNIVKHGDFDAPTREVAQLLPDDQKQDELLLEDIWTLLRAGRLEEACELCRSAGQSWRAATLCPFGGVDLFPSLEAMLKNGNARTLQAIELESGIGRQWRLWKWASYCASEKIAEHDGGQYEMAVYALQCSNLKRTLPICTEWESACWAMAKSWLDVKVDIELSRYQTSRPEEKEFDDDMNGTQLGPENWPYHVLDQQPRDIAALLQKLHSSDLVHETVSRACREQHRQIEMNLMSGNLAHLLDLLWSWLSSIEEGQNVSRSRDDSDMIRFGAHIVLVLRYLLSNEMEDEFEEKLVTVGDLIINMYVRYLFSEGQEELVGVYASQLDRDVCIDLFVDMMELRLNSSLHTMYKLFLSAVEYLPFSSGDASKACFEEILERVLSRSREIKLHQYNEDFSDVAEQHHLQALQKAMIIQWLCFTPPSSIPGFEMITGKLLIRALMHSNTLFREFSLISMRRVPDLPVGPHKLLAILAEPLKQKENLFSLEDQEVSDNLEEFEDWHEYYSLDATYRGWLRCEMENYSVPPEMLSAEEKDQAVAAATQTLELAFLLLEREERPWLNAIETSPFESSELVFLELHATAILCLPSGECMTPDATSCTALTSALYSTVSEGDVLHRQLKVEVKVSSKDPCCIEVALRCLATEGDGFGLHEANDGALLAAIMAAGFKGELNRFQPGVSMEISRLDAWYSDCHGSVESTAAYIIRGLCRRCCLPETILRSMQASISLSEAGDSLVHCDKLIELVASSDFGMMHLFSQQQLQEFLIFERECFICKMELEEEQMPADG

SEQ ID NO: 533 - protein, 434 aa, Hordeum vulgare
MGSLRGGEGRNEDGGKVGLPALEVALAFPQATPASLFPPAVSDYYQLDDLLTDEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSATKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQINQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 534 - protein, 874 aa, Hordeum vulgare
MGGGRKRGRSQRRHFKQERENVWKDNPRRPPASAGEGGEGNGWQPFATENLAFEAYYKGQQIVPEEEWDAFMSMLRKPLPAAFRINASCQFFKDICSQLENDFRKSLETEVSDDHEKEAIRPLPWYPGNLAWHLNFSRMQLRRNQALESFHEFLKQENEVGNITRQEAVSMVPPLFLNVQPDHHILDMCAAPGSKTFQLLEMIHQSTKPGVLPTAMVVANDVDVQRCNLLIHQTKRMCTANLVVTNHEAQNFPGCSVAKFCPEACVDESKLQRLEFDRILCDVPCSGDGTVRKAPDMWRTWNIGMGNGLHRLQVEIAMRGIALLKVGGRMVYSTCSMNPVENEAVVGEILRRCGDSVELLDVSNELPELIRRPGLRTWKVRDRASWLGSHKDVLHYRKNVILPSMFPSGKGSMDSCTAGGSVEVSIDAVDADMNESGDMVEGKQETKIAIDDSKNGDNANTEEIKQGESESVKLSRGSDEKTDSASIVTEHSNLPLHRCMRIIPHDQNSGAFFIAVLQKLSPLNESQVVEAMKGERSTSKDKTLKCSNGQGSDKVPAEEISVQQPGVDDSHDLVEQQNRDMDTEISKDKSSEEAKVIASEVQNDQATRRDKRKTQNQGRWRGVDPVIFFKDEATIRSIISYYGIKDSFTLEGHLVTRNPDTNHVKRIYYVSKSVKEVLDLNVKVGERLKITSLGLKIFERQSSKEGSPCTFRLSSEGLPLLLPYITKQILYASAIDFQHLLQYRIIKFPDFVDAKFGEQAAALLQGCCVVILREGHEDLESIGMDPSAIAIVCWKGKTNLCVMVTPMDGRELLERISFRFGLKIPKIDDGKPDLKSDDGSDEQPDGGAETVDPECVPESKAPEDMDITDVKDAE

SEQ ID NO: 535 - protein, 126 aa, Hordeum vulgare
MSTVEEEELSECEVLWPETRHGAPGSPYGPSTAAPGGASRDHRRQRSAPVDIPRPAHLPRGRADLDDEEEEEEHDGAMVPPHLMVSRRWSEGKAAAFSLRSGPGRAHRDLSHLRNSVLRMTGFIEG

SEQ ID NO: 536 - protein, 358 aa, Hordeum vulgare
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVTPEVIAEYTVRTLQRTVPAAVPAIVFLSGGQSEEEATLNLNAMNKLQTKKPWNLSFSFGRALQQSTLKAWSGKAENEEKARKAFLVRCKANSEATLGTYKGDATLGEGASESLHVKDYKY

SEQ ID NO: 537 - protein, 593 aa, Hordeum vulgare
MDIGSVPSPADAAAAPSAAAMPREATQGHHLARRLAEVGARDVFTVPGDFNLTLLDELEAEQPSGGGVRLVGCSNELNAAYAADGYARARAGGVSACAVTFTVGGLSAINAVAGAFSENLPVICIVGGPNSNDYGSNRILHHTIGIPDFTQELRCFQNVTCYQAVVNNLEDAHEQIDTAISTALKESKPVYISISCNLPSIPHPTFSRHPVPFFPSPKLSNQMNLEAAVETAAAFLNKSVKPVLVGGPKMRVAKARKAFLELADACGYPVAAMPSAKGLVPEHHPRFIGTYWGAVSTPFCAEIVESADAYLFAGPVFNDHSSVGYSLLLNKEKAIIVQPDRVVIGNGPAFGCVLMKDFLHALATRLKKNTAAYDKHSRIFVPQGEPRPSQHEEPLRVNVLFNHIQKMLSGNTAVIAETGDSWFNCQKLKLPQGCGYECQMQYGSIGWSVGATLGYAQADKDKRVISLIGDGSFQVTAQEVSTMLRWGQNNIIFLINNGGYTIEVKIHDGPYNIIKNWNYTGLVEAFHNGEGKCYTAKVRTEEELKEAIEASLGPNKDSLCFIEVIVHMDDTSKELLVWGARLFAANNRPPNPQ

SEQ ID NO: 538 - protein, 181 aa, Hordeum vulgare
MGSSPASSPSPSPSPPMPMIGRAGNLTVFITPPSPASNPRSSRPSGSPTPDFSTPTSRTGTAPPPLQESASPPAPPVKFSPPAPPVKVSPPPVQVPPPQYGKASAGGKHDGSAFGFLWDAVARVQEAHASLDEYVANWFGLDQSKYQWALNDYYDTTGKEVEYGKAGKPKELTTTTKVQKV

SEQ ID NO: 539 - protein, 872 aa, Hordeum vulgare
MSPAAAAPAPRDDRIRSFEDFARVHQFLLIAAGVPPSLHRRLYRKLADEVFDGGESFSVEPCEEGRQRRLVLASGAPLGSEADVFLVDHAWSFRLSDALKQLREVPGLAERMAALMCVDLDRRIEVEEADEQDSEKGGGLEHVLQVVEKERIRIQESGGDFAAWLELEELGIDDDMLVALDLSANFPNLVALNLWGDRLQDPEKVMREIGKCGRLKALWLNENPILNQCTEKDVLDGLPELEIYNSHFTMKAREWALGFCGDMIGAENPCLSVGNIPLDNIVTLDLSDRSIHKLPEVFSSSKLSSLSKLNIRGNPLDQMSGDDLLKLFSLFTQLQELEVDIPGPLGNSAISILESLPNITLLNGVNASSIVESAKHVVDSALKPRVPEWSPEESLAERVIGAMWLYLMTYRLADEEKFDETPIWYVMDELGSAMRHSDDANFRIAPFLFMPEGKLSSAISYTILWPICDVHTGEECTRDFLFGIGEDKQRSARLTAWFHTPENYFIQEFRKYREQLQSTSICPTKETPSTRSVRPSDGRPLRVFTDIPQVEEFLTRPEFVLTTDPKDADIIWAGMQIDSELKSSLGLTDQQYMNQFPFEACLVMKHHLADTIHRVWGSPEWLQPTYNLETHLSQLIGEYSVKKRDGMDNLWIMKPWNMARTIDTTVSGDLSAIIRLMETGPKICQKYIECPALFQGRKFDLRYIVLVRSICPLDILLCDVFWVRLANNQYTLEKTSLFEYETHFTVMNYNGRMNHMNTPEFVKEFEKEHQVKWLEIHESIRDMIRRVFESTSAVHPEMQNSFCRAIYGVDVMLDNRFKPKILEVTYCPDCTRACQYDTQALVGSQGPIKGSDFFNTVFGCLFLDDLTNVSPL

SEQ ID NO: 540 - protein, 251 aa, Hordeum vulgare
MAACSFALRLGPRFAAPTVASATRGGGGGGGRPTGSRALVSKKPNKDHRLWIRKDSAGSGKKALCLVNTVSKLPNEKEAVYGALDRWTAFEPEFPIIAAAKALEMLKKRRKWLQIIQVTKWLMSKGQVLTWTTYDTLLLALSMDGRVDEAESIWNTILQTYTRSVPKKLFSRMIQIYNTCHLPDKVLEIYADMEELGVRPDEDTTRRIGRAFATSGQEDKQKPVLEKYLKKWKYIHFNGERVRVRRAGPLA

SEQ ID NO: 541 - protein, 314 aa, Hordeum vulgare
MSRPLFGVMAAAAIVVVGCCFAACPVGAGASAGGFYENFEVKWGTDPDPDRRVEIVDGGRLVTLTLNNVSGSGFQSRDAFLFGEFTMEMKLVPGDSAGTVTTFYLTSKDPTAVGDGHDEIDSEFLGNVSGEPYLMQTNVFAQGVGGREQRSYLWFDPTEDFHNYTILWNPLNIIFSVDGVPVRVFRNQEANGVPYLTRRAMKVHATIWDGDTWATRGGRVKIDWAHAPFVASYGTYASSACVSAAGDGDGDEDVPSAFCCPGDAASWMARRLGPDGERALAWARDKYMVMDYCDDPRNLGRPAECDMDRLASAV

SEQ ID NO: 542 - protein, 734 aa, Hordeum vulgare
GLPPLHTGREGKPTISPASNKRLGSLVRPTTPKSSVPAVSAFESIEDSDEDVDLEPDSKNDDAVYAGTNGAIGSDPVPVKADQNGDISSTSMIRSHSATGSLHGIQLNPVAADILRKEPEHETFSRINITAVETPSHDEIEAYKVLQKCLELREKYIFREEVAPWEKEIITDPSTPKPNPNPFNYEHQIKTDHHFEMVDGVVHLYPSKDSKERLYPVADATTFFTDMHYILRVLAAGDIRTVCHHRLNLLEQKFNLHLMVNADRELLAQKAAPHRDFYNVRKVDTHVHHSACMNQKHLLRFIKSKLRKEPDEVVIFRDGTYLTLKEVFESLDLTGYDLNVDLLDVHADKSIFHRFDKFNLRYNPCGQSRLREIFLKQDNLIQGRFLAELTKEVFADLEASKYQMAEYRISIYGGKKSEWDQMASWIVNNELYSENVVWLIQIPRIYNVYREMGTINSFQNLLDNIFLPLFEVTVDPASHPQLHVFLEQVVGLDLVDDESKPERRPTKHMPTPEQWTNVFNPAYAYYVYYCYANLYTLNKLRDSKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYKRGPDGNDIHQTNVPHIRIEFRHNIWKEEMELIHFGNVNLPEETDR

SEQ ID NO: 543 - protein, 487 aa, Hordeum vulgare
MATNDKPHAVFVPFPAQGHVTPMMKLAKVLHRKGFHVTFVNTEYNQRRLVRSRGPDAVAGLPDFRFATIPDGLPTSKADADADATQDPPSLCYYTMTTCLPHLKNLLRDLIAAVGAPPVSCIVGDGVMSFCVDAAAELGVPCALFWTASACGFMGYRNFRFLLDEGLTPLKDEEQVKNGYLDTPVTQARGMSKHMRLRDFSSFVRTTDRSDIFNFLLHEVEQSDRATAIVINTIDELEQTALDAMRAILPVPVYTIGPLNFLTQQLVSEGDGGGSELAAMRSSLWREDQSCLEWLQGREPRSVVYVNYGSVTTMSKQELVEFAWGLANCGYDFLWIVRNDLVKGDAAVLPPEFIEATKGRCLLASWCEQEAVMRHEAVGAFLTHCGWNSMMEGLGAGVPMLCWPFFAEQQTNSRYACVEWGVGMEVGDDVRRVVVEARIREVMGGGEVGREMRRRVAEWKEVASRSTAQLGGRSLANLESLLKDVLK

SEQ ID NO: 544 - protein, 867 aa, Hordeum vulgare
MRVAVVGGGVSGLAAAHELLAASGGGDVRVTLYEQEESLGGHARTVAVDDGAGGCVNLDLGFMSFNQVTYPHMTEWLEGLGVEMERSDMSFSVSKQPEGNGRGCEWGNGNGISSLFAQKSNILKTSFWRMLGEILKFKNDALAYLEYHQDNPDLYCNETLGQFIQSHGYSLLSQEAYLIPVCAGMWSSPSQGVLSLSAFFVLSFFRNHDLLQLFRFPQLPTVKARSHSFVEKVKGELESLGCRMKTSCRVKSVSSLDGTSGYRVLENDGSEETYDSVIFGVHAPNALKVLGAEATHDELRILGACRHVQRDIYLHCDQNLMPQNSFAWSAWNFMGITSSVFSVTYWLNHIQKIESVRPFLVTLNPPCVPDRVLLKWSTSLLVPSVAATKAYLQLDQIQGKRGIWFCGAYQGHSFHEDGLKDGKAAAQGLLGKKCELLLNRKQIIPSWTEAGARLMVTRFFNLYVSIGNLIFVEEGGSVFSFGKACDKCRIKSVIRVHEPLFYWKVAIEGNLGLAEAYINGCFSFLDKREGLLNLFLILIANRDERRSNRIARKGGRWTPLHVIARLAHARYILREVSRKNTVTQTRRNISLHYDLSNDFFSLFLDKSMTYSCAVFKMENESLEVAQHRKLSLLINKAKIKRGDHVLDIGSGWGSLAIQAVKQTGCKYTGVTLSAEQHKYAERKVREAGLEDHITFLLCDYRQIPPCKYDAIISCGMIEHVGHEYMDEFFACCESYLAEDGILVLQFISAPEERYEQYRRRTDFIKEYIFPGGCLPSLARVMSAMTTSSRFSMEHVENIGPNYYTTLMHWRDNFIANKDKILALGFDDKFMRIWEYYLIFSAACFKLRALGDYQVVFSRPGNRRLGLP

SEQ ID NO: 545 - protein, 342 aa, Hordeum vulgare
MRHHHRVLLRCRAMPLLPSPPRTLRVEGGLVRHRLVRCRGLPIPPKTPGVSGGRLFSSLPLPPPLQSPREVHVWYLCPDELKNQSQLNMYEELLSPSEREYADSMKATMLRKDAVLSRALLRTTLSRYTGYKIDPRSFEFKKNKFGKPEVLWPQDDNSAEQPLHFNISHTTSLIACGIAINARIGIDIEEKKRNTTKNILSLARRYFTPSEVNYLAEISDSDAQRKEFLKLWTLKEAYVKALGMGFSGAPFSTFSIMLDTSMGIRISKASNASRSDCHLSENWLFTLAELNSSHYISVCIEDSSRSQGPEDSPAPVGLKVWKTVPFVEDTLVSGTEAVKLIA

SEQ ID NO: 546 - protein, 398 aa, Hordeum vulgare
MSSETSKRDHARELLAADSKLMTVARTVRRRRLEVRRLGRTASAAAEDEGAKRVRPAPDSSSDSSDSAKVAPEPPLAASRCSACVSHGAVSVIGRRREMVDAVAVAAPFLADTAAVEGSGDVERGAGEEGFFAVYDGHGGSRVAEACRSRMHLVLAEEVRLRRPRPEGGGQGRAVDNEADGARWKEAMTACFARVDGEVGVDDGTDTGEQTVGSTAVVAVVGPRRIVVANCGDSRAVLSRGGVPVPLSSDHKPDRPDEMERVEAAGGKVIDWNGYCILGVLATSRSIGDYYLKPYVIAEPEVTVMDRTDKDEFLILASDGLWDVVSNDVACKIARNCLSGRAASKYPESVSGSTAADAAALLVELAMARGSKDNISVVVVELRRLKSRAAAVIKDNRS

SEQ ID NO: 547 - protein, 952 aa, Hordeum vulgare
MSSKKVPFNRHKENEEARKKREEDEAARVYAEFVESFKGESTSGSKFVRGGVIDPNAKLRADSEGGKSKDGGSVPKKGSRYVPSFLPPSFGKEPHKKKEDERPKEKEKGKPRVIDKFMEELKFEQELRERRNQEPARGDGRHGDTSASSSHFDELPDEFDPSGRIPGSFDDGDPQTTNLYVGNLSPQVDENFLLRTFGRFGPIASVKIIWPRTEEERRRQRNCGFVAFMNRAEGQAAKDEMQGVIVYDYELKIGWGKSVALPSQALPAPPPGHMAIRNKEGGTVIISGPGGPPAASVTRQTSELVLTPNVPDIVVAPPDDSHLRHVIDTMALHVLDGGCAFEQAIMERGRGNSLFSFLFDLKSKEHTYYVWRLYSFAQGDTLQRWRTEPFIMITGSARWVPPALPSSRSPNREKESTFAAGRSRRAEVERTLTDSQRDEFEDMLRALTLERSQIKEAMGFALDNADAAGEIVEVLAESLTLKETSIPTKVARLMLVSDILHNSSAPVKNASAFRTKFEAAIPDVMESFNDLYCSITGRITAEALKERVLKVLQVWANWFLFSDAYLNGLKATFLRPGNSGVTPFHSLCDDAPEIETITSSEGSNNGFRLDEDGTLATGKAAATKELLGLPLAELERCCRHNGLSLYGGKEMMVARLLSLEEAEKERAYQKDVDMKCGQGEPHRTSREDIGLNAHNGLRPGEGTVDDESVMLGLSRHTGQKHYGKSSSAELKQVPSKKQRAGPILPASKWNQEDDGSGDEDRKDGQGLGLSYSSGSDIAGDPGKADAKEISTDQAIHHPDTIVDEEHRQKLRQIEIGVMQYRESSEEKGLWNMEELERKVASHRRCLQSEYGLSSSVDGANNRHSSERIPSDRKERYDDARDSSKKRPHSPSRSRSPSKKSSLDRDREHNRSRDRLHGNDVGRDRAREKRSGREKDDHHDRSREREKDRRKGR

SEQ ID NO: 548 - protein, 1242 aa, Hordeum vulgare
MAAPPETTGAPSPPEGEDKGNAGVEVCCFEQSAEDFSRAVRAISELAAGEPEPGFPDAEAERLASSITFLREWRHFNYEPKGVSFTHGTGSTSSRDNTHEITLPQFSSASVPQVTHLEDGRDNNTYSSDFILFAGRNVWSLDWCPRLCDKPSSPVSCEYLAVAAHPPGSSYHKIGMPLIGRGIIQVWCIVAPFEEARTNQSTLAYSNSNRRGRPRKIPNEHNSIESSSVPRKPIGGPRKIKLTTRDDHAEPSLKKPRDHTEPSLKKPRGRPRKYPLSATKAVDSTKNSGSQGSSFVDPLVTSGVIPGDLALSCAIPSVKSVDSAPKRGRGRPRKIPIDKIKCSPDTEWTEDVSRALICCTIPKKKRGRPRKYPPPSSSKHVSGTDNEFERETGYTESNSNLSLVTVDAALPVPSSSLTICGKRSRGRNGRGRPKKETNPCILSSSVVSGLQLQSRETISNDPACSVENHLPYGHSNLTSELCSIDGNVHTSPTLEDSLLPMHIAAKSNGEESSGSRRRGRPRRKTRSITNGCLFASGTESSKVATTITDSDNPMALTKSDGETIASDPASVGSLMRCHIGMCNVNMSAASPPHGLCNANYKEKSSAQHRKKPVAVEWFSSTAFSGKEQNNQTTPQTSDNVASVQNCKKELLVYTRRRVRGPTKKPASNETCSLALSGDAQKMERSSTSIMPNNHLFSVENPKLLGPSISEDMANEAGLVGCKSALGSHEVMEKNDSEVANKVVPVPSENSAQIIIVEDAEVVPSKESSKNSNIITCAENSNFSAIPEGIHLPRVVLCLAHNGKVAWDIKWKPPLPNQSEQKSHLGFLAVLLGNGSLEVWEVPSPSMIQKIYSSSSVKGTDPRFLKLQPVFRCAKVKCGNIQSMKFHFENHCLFIMGNSIPLTVDWSPSSHDMILAGCHDGTVALWKFSTDLPSQDSKPFMCVTAESVPIRALSWAPYVSEENTNIFVTAGEDGLKFWDLRDPYRPLWELTTAPRAVLSLHWLKESRGIIISLEDGTLKFISLPRIANDVSVTRRPFAGTKTQGVSTYQLSEYLIWNVHVSEITGYAAYCVADGTAVRFQLTSRFWEKEPGRNRVPYFLCGSVAEEGATIKIGGTLQSSPLSNVPLVAKKGPKPCQKVPKAHDTQTEKVLALTNSEHVDPEPREGRLDGPGEGQETNTLVLADSLMPENGGTCNVPVDEDTKDFELFPPKAVALHRLRWNMNKGSEKWLCYGGAAGIIRCQRI

SEQ ID NO: 549 - protein, 117 aa, Hordeum vulgare
MEHKGQLQPEKKSAQEEEEEAMAMAASSPSFFFAHPLSLLHHVTRGFAGYMGLSRLCHALKDLKPRAATSSRLHEQGPGAGGAGHAADDGCAAVQVRSRGVPQRPRGPREGRGGTHH

SEQ ID NO: 550 - protein, 748 aa, Hordeum vulgare
MLHELLLALLGFTGDFVLDNSSAPRRPEPAEAGGAADGDAGPAFRLAPDLTFLQPSERSAIERLISLGFYYRELNRFATESRDLSWIQSSVDVSSPNADITLKGKGRKGSAYRRAIGNGIAEILSVYRSAVLQVEQNLLSDPLPILATVTHGLNKFEVLLPPLYELVMEIEQKDIKGGQLLNLLHKRCHCGVPELQSCIQRLLWHGHQVMFNQLTSWMVYGILQDQYHEFFIRRQVDRDEENESAQSDVADKFAQKLARDTSLTSWHSGFHVLLDMLPEYIHMRVAESILLAGKAIRVLRNPSPGATLLEPTNQSQTLKGSHRMQSFVGCSGALKELPNFSNISAEELLPQAEADKVDAMLKQLKHASEFHKRLFESAVSSIRTIAANHLWQLVVVRADLNGHLKALKDYFLLAKGDFFQCFLEESRQLMRLPPRQSTAEADLIVPFQLAALKTIGDEDKYFTRVSLRMPLFGMKSSTSQKDLQKSNTSDLSLQGKASSELALDGWHSIALEYSVDWPLQLFFTPDVLSKYRKVFQYLIRLKRTQMELEKSWTAVMHQDHVDFSDYCKDQKNSSATQLRRLRTKPFWRVREHMAFLIRNLQFYIQVDVIESQWNVLQTHVQDSHDFTELVTFHQDYLSALISQSFLDIGSVSRILDSIMKLCLQFCWSIEQYETGANMFEIDHITEEFNKKSNSLYTILRSSRLAGSQRAPFLRQFLMRLNFNSFFETTARGVMNSGRLRPGTASTQL

SEQ ID NO: 551 - protein, 1051 aa, Hordeum vulgare
MGSASKLLSSLLLTSSPLRLRPSAAAFALILSSRTAASRRQHLLSSPSPLRTLSTSAAAAAASPLPCSSSSASSTPPPHVPSPDWSRLVDRLAAAGYAARAPSPADELAVPSGSGLSAETESAVSSCLAFARDRPDLLRSLPTKDVEVVVSNVAPALFKRGEESAQRLQQYLAGEDDNAIQSVRAETVDIVRYLLSYTYGSSNNYLEDKELTDSVVRNILAELVNFSGLPHTSSFVESTVDNQPERFSRHPGQNVEMKRGDWICTRCSFMNFARNARCLECNEHRPKKMLTGGEWECPQCEFYNYGRNMSCLRCACKRPATTASAGAGLGGVADLLSVTNAGRSDIERKLAENDEKAERWLSKVSQLDDSADLSSLAADEDFPEIMPMRKGVNKFVVSTRKTPLERRLSSAQYSSNNSPQATASDSKISQTLDRILGRSASTSAPSNQSDNGGVDAGPPRKLTGHLGDIDPVPFVPLSADLFTKPQNANSNEQADTDCQINKETGSSTPDTTQASTGRRDVDKSLDTAEKWSKKVAELDSVNDLSSAISDEDFPDIMPMRKGENRFVISKKKDRSLASPQYKRRSVLEQADNSDFVPFVPFPPDYFAKKDAPAESTPDTGTVSESPPSADKLPETNASPGNSGNSQNTSQVIGPQRSSNMTNENWNRNYSQQSSSTGGYTQGGSSSQQYQQQPYDVGDRSSRTSNTSAWTPTTPRGRLMIGRGGSSNYQHQQQPQELGDQSIRTSNTGALNTNYSQGRFNDGRGGSSNYQHQQQPREMGDRSSGISNTGAWNTNHSQDSFNDGRGGSSNYQQQQQLHGIGDQSSGTSNTGAWNTNYPQGRFNDGRGRSSNYQYQQQPHQTGGRPSGTLDTHAPNSNYSQGSFNEGRDTSTYNHGSYSTQPSYAPGYSNNSNSNAWSSNNNQNWSGSHPDTRATTTGIGSTNPNQATGYSSYGSGGYTGKSLEGSAVKDPDPLDMSEEAKAERWFRRAAQIKDISELANIPDEDFPEIMPMRKGVNRFVVSKRKTPLERRLTSPQYRRNLPIVSSEPDKDGS

SEQ ID NO: 552 - protein, 460 aa, Hordeum vulgare
MEDANAVVDWNVDIIGPDGGSACRKLAKTEDPDATECSSSFGDTLSGSQDDAKPSEISDIEVDSPFCRYPHNGDAAALLDAAASDNLDRLLKKKKVTDHWRNYISPLMWRCQWLELRMKDLQSQVSRYDRELAVLKHEKELQTKMIELDCSSSRSVPFSSHCCRKTMKRRKRKRNEEKINAPSYIATHTILSYYEKEKTEGDGPSIDDNGNLDDSTKGNNDADWLLGNGDDATVEQILLNIQSIQDRVCSLRSDLKKAMAKKSKGLVLKVNTRVNGAQSSNCSHGKGKVAEMPEISPQDASDCDMDDMDMPDSAVSSYGEANNMDIFESTMNLLSVEDPDKIGELHQTSEDVLIDNQPAEGGYQNFEVINHPCQRLRVSVKREQVPVKRETIAHSEDESVAAPMAVVKEEDTTRLGLQGILKPCYTGKRKGRKPKILRRGGSSSVLSSWKSARTRKKRKS

SEQ ID NO: 553 - protein, 741 aa, Hordeum vulgare
MGYHHLLVVSPPAQPPPRRLSLLSRLPRGAVTAAASPDAARSLSVVAASAATRRRAVLLVGISVLPLLRLRDAAAAAQPLAADLVTDKMGIQTSEEMRLEETRAKPPQPEVKRPSPGNPLANLLNAIAVIASGLLAGLLGTTQREKKALQSTISSMEIKLAEDEAAMSVLRENYEKRLLDEQAAQKKQARMFQDEEASLLDQLASTTRTVKKLNGEVVKEEELVGQLKHGIHDLEMSIAQAEEDKHAFEENLRDKLETVDILHGKVNLLSQDVNDKEEHITELSSSLSTKEGDYQNLHLMFNQTKGSLEHANSRMEQLEKYVYAAKNDIKSKISSIDSLNEDVQTLYSAKSDAEEKINELMKQYAELDAASEMRASRDLELLSNKDDQLNQLEEQLSTALSDSIEDRIIIAELNSELEANRTMLVNEVEARKKMSDLIQSTEDALKESRNELFKLSEELNEVNISNHYLRTQISEFTNESNEVKEALTNKVEEAESVSKALSDEVASLKEILQKTQEDLEVTSNQLVSITEVHDELNKELLDAYKKLESATDELVRERQINSILNRELEALVEQSQVESEARRALHVDLDEATVSLNEVNESTLFLSNKLDSTVSRICAIKEEKEVLSAALLEQKKRTAEAQKNMVDAQHLIKRLGMERENSEIRNKKLEEELATAKGEMLYLRRQITASGSQNTDVMEANPTPNFSQPLEDRVPNTSSTDAVPPRSAKKIYRRRKDRPST

SEQ ID NO: 554 - protein, 257 aa, Hordeum vulgare
MAASLPYLPPPPPTPSPAATTLPSNLVSFPAPRPRPAATHRRAVLAAASSRPPPPPPPSPEGGDEEVYRAMGMDGGIPGTSGELLRRVSSRAYGMRRHLMESLDSLAYDVLETNPWREQQPKPVYVLARRDNQLWTMKTRRNRSEVERELGMLFSKGGGSGVGTKSKYSGSKFSMVVEDLTEGVLVFEDEDDAVKYCDALQGGGQGCEGIAELEASSVFNMCRQMKALAILFQRGRTPPTPQSLERDLRAKNRSLED

SEQ ID NO: 555 - protein, 430 aa, Hordeum vulgare
MYGVSGGGGGFNAPSTASGRRRNQEDDEEEEEEEEQTGDGRVLEAWERAYADDRSWEALEEDDSGLLRPIDTKNLVHSQYRRRILLRSAAAAARIQKGLIRYLYIVIDLSRAASEMDYRPSRMAVVAKCAEAFIREFFDQNPLSHVGLVTIKDGISHRLTEIGGSPESQINALMGKLECSGDSSLQNALELVHGYLNQIPSYGHKEVLFLYSALNTCDPGDIMETIEKCKKSKVRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVSPFDEVTFKLGQKGGQNCFGCQQSLINTGGQSNIHVRCPKCNHHFCFDCDIYIHESLHNCPGCESQRSSSR

SEQ ID NO: 556 - protein, 403 aa, Hordeum vulgare
MAPSTSSASALIHLPGLPPRRPHSGGCRNQTRRPRHAAVQCSFAFAPVETARIKVVGVGGGGNNAVNRMIGSGPQGIEFYAINTDSQALVNSQAQHPLQIGEQLTRGLGTGGNPNLGEQAAEESKEVIANALRDSDLVFITAGMGGGTGSGAAPVVAQIAKEAGYLTVGVVTYPFSFEGRKRSLQALEALEKLERSVDTLIVIPNDRLLDIADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYNGEIHVTIIATGFPQSFQKSLLADPKGARILEAKEKAASLVSAAVQQPTPAAVPTWSRRLFS

SEQ ID NO: 557 - protein, 686 aa, Gossypium hirsutum
MDGVTVASTPSPSYSTTAYVSWDEVNVSSDKGRRVVHYYLKRRDGVSDLAVIGKEKSLRHMSYHFAIKNRSLFFSSTSFYKLKSRREVVNWLNSVVSDSSSRESHCSVDGIWNGKDVKSMDFGAVKDLQSQKLVQKEFLWLGSSWTCKRKKKHYESFRRNGVIISVHDFVYVLAEENKRLVAYLEDLYEDSRGNKMVVVRWFHKIDEVDIDLHHNYNCREIFFSHCLQDLSIECIDGLATVLSPLHFKKFLNEATHTRLEPFVCCKQFENDVKPFDVTQVKGYWKQDILRYMYGLSPSNDCVTRQQRADDLKTVWDVDDDVGIRPRKRYCRSKDDDMHMHFSGSRESMDTSFADVQDFHKSKNGNVSFNFSGRNFAFLSTGEAKQYSSHHLMVGSEVEVLTQDSGMRGCWFRARIIKKHKNKVKLQYQDIQDAADEANKLEEWILVTKVATSDEVGIRVSGRTAIRPSSQFTKGSTSCIGVGSVVDVWWHDGWWEGLVVQELEDKFRVHFPGEKRESVFGIGDIRQSQEWLGNRWINMKERHDLVSTILWAGKQDASKSYNFNTDKNTICESGQCGKEATECKGSAVEPGNERAQDASVVPDLSKDGRLSQLKWKSSRKRKRVTSTCVRKLNCSRNLIKSTAQSVACERFLIPASLKVDNENCKNIGDPLFSSSVVPPLTSLVMTR

SEQ ID NO: 558 - protein, 326 aa, Gossypium hirsutum
MAATFFRRLSKATPATFNNAFRGQPKSGFAGFRFCTIAAVAGGISTYYCFSDSNLVHLDQVNEETGPKVALKSDKWLEFKLQDTARVSHNTHLFRFSFDPSAKLGLDVASCILTRAPLGQDAEGKTKYVIRPYTPISDPDAKGYFDLLIKVYPEGKMSQHFASLKPGDVVEVKGPIEKLRYSPNMKKHIGMIAGGTGITPMLQVIEAILKNPDDKTQVSLLYANVSPDDILLKQKLDILAASHPNLKVFYTVDNPTKTWKGGAGFISKDMVTKGLPGPAADTLILVCGPPGMMEHISGDKAKDYSQGELTGILKELGYTEQMVYKF

SEQ ID NO: 559 - protein, 770 aa, Gossypium hirsutum
MGSSILPDLGAEILIPVCAVIGIAFSLVQWLLVSKVKLSPGRDSGSPGNNGAGGKNGYSDYLIEEEEGLNDHNVVIKCAEIQTAISEGATSFLFTEYQYVGIFMVAFAILIFLFLGSVEGFSTKSQPCTYDKSKMCKPALATAIFSTVSFLLGAVTSVVSGFLGMKIATYANARTTLEARKGVGKAFITAFRSGAVMGFLLAANGLLVLYIAINLFKLYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTPMLYPLIISSVGIIVCLITTLFATDFFEIKAVKEIEPSLKRQLIISTVLMTIGIGIVSWVALPSSFTIFNFGDQKAVKNWQLFLCVAVGLWAGLIIGFVTEYYTSNAYSPVQDVADSCRTGAATNVIFGLALGYKSCIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 560 - protein, 250 aa, Gossypium hirsutum
MLLKASPAFSLLKNPQVETRVPLFSRNGSGFGSGAVVVCATKGANNKPLTGVIFEPFEEVKKELNLVPTVPQMSLARQKFADECEAAINEQINVEYNVSYVYHAMYAYFDRDNVALKGLAKFFKESSLEEREHAEKLMEYQNKRGGQVKLQSILMPLSEFDHAEKGDALYAMELALSLEKLTNEKLLNLHNVAERNHDSQLTDFIEGEFLAEQVESIKKISEYVAQLRRVGKGHGVWHFDQMLLHEGAVA

SEQ ID NO: 561 - protein, 282 aa, Gossypium hirsutum
MYAETGLFFPYMQKFSEDFQQFIDYCKSQKPNASTNNLVQISTISEYDLGGEGDLFKAPEPIIEEPNLGLDPMTAAISLISCGEDVITSQGLKAADIESIQNEQLLEVLYECEKDMMAKAAMETPLSEVLDIKIPVVKINENQNLENKVLSDIPFQKSVSSSCLRSMEWVQGAVIKPNFLDFPGMDFGSVYGMRRAFSEGDIQTLGNGNGSVICSPLERPIMISCCSTEDRREKLSRYRNKKTKRNFGRKIKYACRKALADSQPRIRGRFAKTEESDNSKRQ

SEQ ID NO: 562 - protein, 189 aa, Gossypium hirsutum
MAMWVFGYGSLIWKAGFNYDDRLVGFIKDYRRVFYQGSTDHRGTPEYPGRTVTLEPAPGEVCWGAAYKISKEEDKETAITYLEVREKQYDKKAYVDFFTDPLATTPAISGVMVYIASPDKKLNPNYLGPASIEDIAKQIVRAEGPSGPNREYLFQLEKALLQIGCKDKHLMDLANEARRILSESEHTAS

SEQ ID NO: 563 - protein, 634 aa, Gossypium hirsutum
MDPYAWTISADQGEIGLMPSIESLRAIDPHADLSITVVLIDRLRDPSLKELQNWVLKISSSWISTKDAINQLACLVCNRMGGAASSEEDVYSQWKECTEVLKNCSGSIVFPIGSLSVGLCVHRVLLFKILADLVNLPCRITKGCKYCRREDASSCLVQLGPDREYLVDLFEEPGALSQPDSSLNGTSSILVSSPLCHPRFKPVEIATNIKTLAKLYFIDDQSHKHACLDASSDNASNQNEQTGPQPRKAFDRNYFNKNNPFSTLSNNKESSLSPLHQSTLWNIGCDKDLQMLNSSKLFPKAINSTHLIRSPPLPSSVTSHMHKDVYQAFPYSDPMQCTINFKQSDDPVMSFDQEDLNIPWSELVLKERIGAGSFGTVHRAEFRGCEVAVKILMEQDFHIERFREFLREVSIMKCLRHPNIVLFMGAVTQPPKLSIVTEYLSRRSLFRLLQMPDAWKVLNEKLRLNMALDVARGMNYLHQLKPPIVHRDLKSPNLLVDSNYTVKVCDFGLSRSKANTFLSSKTAAGTPEWMAPEVLCNENSNEKSDVYSFGVVLWELMTLQQPWKHLNPPQVVAAVGFKGERLEIPSHVNRVVASLIEQCWAREASERPPFSHVIQCLQQVIQNTASQELNGLSL

SEQ ID NO: 564 - protein, 296 aa, Gossypium hirsutum
MSATSASSLILPSLKPKVLSLSDSTPNSLSLFSLSPTPHAKPLFCSALPSFQLLTKKSSFSSRFLTNVAVSSEYDQEEDLFGSDDEERSPTFSPDLKLFVGNLPFTVDSAQLAGLFENAGNVEMVEVIYDKVTRRSRGFGFVTMSTIEEVEAATQQFNGYELEGRALRVNSGPPPPRREEFSPRGARGGPSMGARGGPSMGARGGPPMGASNRVYVGNLSWGVDDIALETLFSEQGRVVEAKVVYDRESGRSRGFGFVTYSSADEVNSAIKSLNGCDLDGRPIRVTVAESRPRRQF

SEQ ID NO: 565 - protein, 444 aa, Gossypium hirsutum
MISSWRKRRAGKRAGKEQARNENGEMELTIPRDFRCPISLDLMKDPVTLSSGITYDRPNIEKWIEAGNFTCPLTNRVLRSLEPIPNHIIRKKIQDWCVENRSHGIERIPTPRVPVSSMEVSEILSKIDIACKKQDGAGCRDLVAKVKSLAKESERNKRCIVSNGTGNVLSEAFAAFSMAAFDENVSVLEEILSALVIMFPLDGEAKGFLGSASAMHCLIRFLSSGDLSRRRNAVLALKELVSSMEDQRKILNQLSEMEGAIEALLKLIKSPICSTSTKASLTIIYHMITSYGNEKQVGNKLVNLGIVPLLLEMLVDAERGMCEKALGVLDGIFDTEQGREMACKNALTMPVLVKKILRVSTMATEFSVSILWKLCKNEKKEDGGVLIEALQVGAFQKLLLLLQLGCVEKTKDRVSDLLKMLNPYRSKIECVDPIDHFKGLKRPF

SEQ ID NO: 566 - protein, 675 aa, Gossypium hirsutum
MAVTVSLSVSHLPGCKVHDFSHLPKPTNKDNPSSKASSDIKLSKRNLLLSSMASGLIGRGVFVGEPVKAEPETPMESSSSRLSYSRFLQYLDEGGVKKVDLFENGTVAIAEIYNPALEKIQRVKVQLPGLPQELLRKMKEKNVDFAAHPMEMNWSAALFDLLGNLAFPLVFLGTLLLSSSSVNNPGGGPNLPFGLGRSKAKFQMEPNTGVTFNDVAGIDEAKQDFQEVVEFLKTPEKFAAIGATIPKGVLLIGPPGTGKTLLAKAIAGEAGVPFFSLSGSEFIEMFVGVGASRVRDLFNKAKAKSPCLVFIDEIDAVGRQRGTGIGGGNDEREQTLNQLLTEMDGFTGNTGVIVIAATNRPEILDSALLRPGRFDRQVTVGLPDIRGREEILKVHSDNKRLDKDVSLSVIAMRTPGFSGADLANLMNEAAILAGRRSKDKITMKEIDDSIDRIVAGMEGTKMTDGKNKILVAYHEVGHAVCATLTPGHDPVQKVTLIPRGQARGLTWFIPIEDSDLISKQQLFARVVGGLGGRAAEEVIFGEPEITTGAAGDLQQVTQIARQMVTKFGMSEIGPWALTDPAVQSSDVVLRMLARNSMSEKLAEDIDSSVKKITETAYEIAKNHIRNNREAIDKLVEVLLEKETLTGYEFRAILSEFVDEPVIKVDRTPVREMINA

SEQ ID NO: 567 - protein, 350 aa, Gossypium hirsutum
MGEEQQRIQIPRIKLGTQGLEVSKLGFGCMGLTGGYSCPVSEEVGISIIKHAFHRGITFFDTSDIYGPKTNEILVGKALKQLPREKVQLATKFGFEKLDSTGIKVNGTPEYVRASIEASLKRLDVDYIDLYYQHRVDTNTPIEDTMSELKKLVEEGKIKYIGLSEASPETIKRAHAVHPISAFQTEWSLYTRDIEDEIVPLCRELGIGIVPYSPLGRGFFGGKGVVETVPANSHLLYFPRFQGENLDRNKMLYLKVEKLAEKHGCSPAQLALAWVLHQGDDVAPIPGTTKIKNLDSNIDSVKVKLTAEDLKEISDAVPINEVAGDVLPDRFSQLHWKFGNTPPKGSKVST

SEQ ID NO: 568 - protein, 313 aa, Gossypium hirsutum
MVLLVQRLSKLYHKLENHYHHHHHHQAEVDALSASLQAFRSDVSNCVNQLLHPEPGSEILSFSWIQRCFELLPVINKAFLKLVGDIDYPMSCWDVASLDEYLNYGLHLLELLNCVTSSLSHLAQARLSFAHALNLVESSPSTAIEHLKAIQSQSSSKDLKGLVRNKEGGEGKLSSCKERVVHEALMEVKSVGLWVFGVVLATLSGETKPYLEIKQVIVRFNSALLIDVDSCVFKVMVEKGETLKEVKELNSAANSLVSAILSGKTSVAAMDFGGKLGVFEKEMDALEKQVDALFSSVLAARNELLNGVRQRKQ

SEQ ID NO: 569 - protein, 645 aa, Gossypium hirsutum
MPALVNYSGDDDFYNGGSFYTNSTDLGRLCSISFQVDVYCPPRKRTRISAPFHFGEAEVEQNKQPSIDVLPDECLVEIFKRISGGKERSSCACVSKHWLMLLTSIRKGEYESSKVVKENVGSNSGDVEMILSEEDDGYLTRCLEGKKATDMRLAAVAVGTSGHGGLGKLSIRGSSSSRGVTNFGLSAVARGCPSLKVLSLWNVPRVGDEGLCEIAKECHLLEKLDLCQCPHLSNKGLIAIAANCPNLTALSIQSCPKIGNEGLQAIGKLCPKLQSISIKDCPLVGDHGVSSLLSSASSVLSKVKLQGLSITDFSLAVIGHYGKSVTNLMLSGLQNVSEKGFWVMGNAQGLQKLVSFTIASCWGVTDVSLEAIGKGCANLKQMCLRRCCFVSGDGLVAFAKSAGSLECLQLEECNRVTQSGVIGVLSNCGLKSLTLVKCMGIKDISLEAPLSSSCNSLKSLSIRNCPGFGTASLAMVGRLCPQLQHVDLSGLCGITDAGLLPLLENCEAGLVKVNLSGCLNLTDEVVLHLTKLHGATLELLNLNGCRRITDASLAAAAENCVFLSDLDVSSCAITDVGIAALSHAEQLNLQVLSFSGCSGVSNKSMTFLKKLGKTLVGLNLQHCNSISTQTIELLVESLWRCDILV

SEQ ID NO: 570 - protein, 487 aa, Gossypium hirsutum
MAAEYREPLLKKKHYKNCPGCKVDEMKELEQGLPIRPLLSIWIIVLCTALPISSLFPFLYFMIRDFHIAEREEDIGSYAGYVGSAFMLGRALTSVSWGIFADRYGRKPVIIMGTTSVVIFNTLFGLSVNFWMAVITRFLLGSLNGLLGPIKAYAVEIFRDEYQALGLSTVSTAWGIGLIIGPALGGFLAQPAEKYPNLFSRDSLFGRFPYFLPCLAISIFALAVTIATCWLPETLHKHNDNDQSSDDSYDALEAASNESNTKDITEKDEGRESTSKQSLLKNWPLMSSIIVYCVFSLHDMAYTEIFSLWAVSPRKYGGLSYSTEQVGEVLAVSGFSLLVFQMSLYPFVERLLGPVMVSRIGSILAIPLLQSYPWIAMLSGFTLTLVINCASVLKNVLSVSVITGLFILQNRAVDQHQRGAANGIAMTGMSLFKAVGPAGGGALFSWSEKRLDASFLPGTQMVFFVLNIVEAVGFLLTFEPFLAQHRQ

SEQ ID NO: 571 - protein, 1191 aa, Gossypium hirsutum
MKSTAEAAVAENGRFLGSISTSSLRNLLPKSKLKKSIKKSNSENTPPPDPNIIQINNSAQFSPKSPLSKSLTSDSFVNPSDAHPQIPLSMDSSVKKDMVESEEQNGDLTNLDPSAKVVVRIRPINGQEKEVDRTVTKVSSDSLSVGGRKFTFDSVLDANSSQENAFQLIGVPLVKNALAGYNTSVLSYGQTGSGKTYTMWGPPSAMVEDPSPASHQGIVPRIFQMLFSEIQREQENSGGRQTNYQCRCSFLEIYNEQIGDLLDPTQRNLEIKDDPKNGLYVENLTEEYVSSYEDVTQVLIKGLSSRKVGATTVNSKSSRSHIVFTFFIESWCKQGASSKCFSSSKTSRISLIDLAGLDRNKLEDVGRQHLQEGKNVKKSLSQLGYLVNTLAKETQPEKPEDVPYGGSCLTRILRESLGGNAKLTVMCNISADNRNTSEILSTLRFGQRVKAVRNEPVINEISEDDVNGLSDQIRQLKEELIRAKSDAYSSVGSKSGYFKGWNARESLNQLRISLNRSLILPRIDNEYEEEINIGEEDVKELRQQLDYLDSSCETNLRDPLDKRGSIQSSVKESCETDLLSEDDIHCPKETEIEEIDEVEVPPMSSPEPADDLSVTSKTLKAVDPSIRNSISISPHRRSSILEEPTLSESPKIANNLRKSMAVPSALLASQKNVSESSESEVLRELLKYSDHIRSSLRTSKTFLGPTESLAASLQRGRQIIDQHQHSSVPNRSSVAFSFEHLMLKPSPEADKANASVQTLPNDKPSPDGSSTPLFCSSCQRKFDNNHPDEVQDSLKTWIVTVDNQQRDGRNTVEEASKKEKTLESVCKEQAAKIEQLTQLVEKYKLERENSAIEHAPEPLKNEIILFDEQSNNGENGKEYFDMTEKEALLQEIQTLKSKLQSYTASPSPNKSTEILRSSLLSRSIQLRKSVDCRNNSEEELERERQRWMEMESDWISLTDELRMDLESNRCRAEKVEMELKLEKKCTEELDDALSRAVLGHARMVEHYADLQEKYNDLVTKHQAIMEGIAEIKKAAAKAGSKGHGARFAKSLAAELSALRVEREREKEQLKKENKSLRIQLRDTAEAVHAAGELLVRLREAEQAASIAEENFSNVQQENEKLKKQVDKLKRKHKMEMVTMKQYLAESRLPESALQPLYREDSDVAASHNSSAIPYDDQAWRAEFGAIYQEHY

SEQ ID NO: 572 - protein, 296 aa, Gossypium hirsutum
MNTSSKESQPNYPTISPDEYTNPFHQQPHMEPAAATAAAPASTSSSPPPPPPPEQSEKWGTHIMGTPAVPTCHPDNKKAALWGAGDQAQYYHHPYLQYSPVERSSNNPMDSMLQVFNTWSHKAETMANNIWHNLKTGPSVSGAAWGKMNVTAKAISGGGFESLYKQTFATYSNEKLKKSFACYLSTSTGPVAGTLYLSNIHVAFCSDRPLSFTAPSGQETWSYYKIMIPLSKVGIINPVIMRENPSEKYIQIVTVDGHDFWYMGFVNYEKASKHLSESVSSFVATGIAVQPSPVAS

SEQ ID NO: 573 - protein, 202 aa, Gossypium hirsutum
MGIIKLRPQLSSSMESQNLKHRSRDDPRFATTTSNEKNRANRREKRMAMAKRGLRSLVIAVSFPLSLTLLNIYLFGSGRGYASLAKPFWFPPLWLLHTGCLASSFVMGLSAWFVWVEGGFHVKPTALSLYLGYLGLSMAWHPTVLWMGASWAGLLVSLAMVGTLVGCSRDFGKVNPIAGNSVMPCLAWAAFLATVNLKLVFL

SEQ ID NO: 574 - protein, 152 aa, Gossypium hirsutum
MSAVADTLTHWINFPENIEKLMFPSRTHESRDNENKGFSSIPADILDTPKEFIFYLDVPGLSKSDIQVTVEDENTLVIKSGGKRKREEFEEEGCKYIRLERKAPQKLMRKFRLPENANVAAITAKCENGVLTVVVEKLPPPPKPKTVEVAIA

SEQ ID NO: 575 - protein, 63 aa, Gossypium hirsutum
MADKCGNCDCADKSQCVKKGNSLVIETEESYISTVVVEPLAENDGKCKCGTSCSCTNCTCGSH

SEQ ID NO: 576 - protein, 616 aa, Gossypium hirsutum
MDSDYGIPRELSDLQKLRSQYQPQLPPCLEGTTVRVEFGDTTTSLDPADAHTIARAFPHTYGKPLAHFLRATAKVPDAQIITEHPTIRVGLVFCGRQSPGGHNVVWGLHKALKIHNPNSTLLGFLGGTQGLFAQKTLEITDDILSTYKNQGGYDLLGRTQDQIRTTEQVKAALAACNDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDITKQICDAVQARAEQDKNHGVILLPEGLIESIPEVYALLKEIHSLLRQNVSADKISSQLSPWASALFEFLPHFIRKQLLLQPESDDSAQLSQIETEKLLAHLVENEINKRLKAGTYKGKKFNAICHFFGYQARGSLPSKFDCDYAYVLGHICYHILAAGLNGYMATITNLKNPVNKWRCGAAPLPAMMTVKRWSQNPNAASIGKPAIHPATVDLKGKAYEMLRQNAARFLLDDIYRNPGPLQFDGPGADAKAVTLCVEDQDYMGRIKKLQEYLDKVRTIVKPGCSQEVLKAALSVMASVTEVLSVMSSSSSGGQAL

SEQ ID NO: 577 - protein, 416 aa, Gossypium hirsutum
MAEICYGVVSEGEASIPCEPSSRAARRRRMEIRRIKIVDVAPSEADNGRKRKNLQAYGASFSLDCENAVENCASDEDGKKRTVKPKNGRLKTKGTIMKSNSSPSLLIPEIDSELHPKFGVASVCGRRRDMEDAVAIHPSFHRQGQDSAAIGFHYFGVYDGHGCSHVAMRCRERLHELVKEELASEEEWKGAMERSFTRMDKEVIKWNESVDGANCRCELQSPECDTVGSTAVVAIVTPDKVVVANCGDSRAVLCRNGRPVPLSSDHKPDRPDELNRIQEAGGRVIFWDGPRVLGVLAMSRAIGDNYLKPYVSCEPEVTVTDRTAEDECLILASDGLWDVVSNDTACGVARMCLRGKCDVQAPLLSPEGEAVVGSMMGGEIPDKACADASMLLTKLALARHSTDNVSVVVVDLRRAT

SEQ ID NO: 578 - protein, 290 aa, Gossypium hirsutum
MGANISGGGSIDGDATGPPLRPRLDDIPESCAALILARLNPPEICNLARLNRSFRSASLADFIWESKLPSNYKLIVEKLFVEEDRDLMNLKKKDVYARLTKPIPFDGGTKEIWLDKNTGGVCLSMSSKALTITGIDDRRYWNHISTEESSYRTVAYLQQTWWFEVDGELEFQFPAGTYSLFFRLHLGKSSKRLGRRVCNTEHVHGWDIKPVQFQLTTSDGQHVVSRCYLDNPGSWVLYHVGDFIVENSNALTNIKFSSTQIDCTHTKGGLCVDAAFIYPSSARKQVKLCS

SEQ ID NO: 579 - protein, 597 aa, Gossypium hirsutum
MVSDASKKKAAQKKAAAAAKRGGKAAASSKAAAAATAENGVDNASDKVSMLQISDRTCTGVLCSHPLSRDIRIESLSVTFHGHDLIVDSTLELNYGRRYGLLGLNGCGKSTLLTAIGLRELPIPEHMDIYHLTREIEASDMSALQAVISCDEERLKLEKEAEILAAQDDGGGETLERIYERLDALDASTAEKRAAEILFGLGFNKMMQAKKTQDFSGGWRMRIALARALFMNPTILLLDEPTNHLDLEACVWLEENLKRFDRILVVVSHSQDFLNGVCTNIIHMQNKKLKLYTGNYDQYVQTRSELEENQMKQYKWEQEQIASMKEYIARFGHGSAKLARQAQSKEKTLAKMERGGLTEKVVRDKVLVFRFVDVGKLPPPVLQFVEVTFGYTPENLIYKNLDFGVDLDSRIALVGPNGAGKSTLLKLMTGELTPIDGMVRRHNHLRIAQFHQHLAEKLDMEMSALQYMIREYPGNEEEKMRGAIGKFGLSGKAQVMPMKNLSDGQRSRVIFAWLAFRQPHLLLLDEPTNHLDIETIDSLAEALNEWDGGLVLVSHDFRLINQVAEEIWVCENQAATRWEGDIMDFKQHLKSKAGLSD

SEQ ID NO: 580 - protein, 373 aa, Zea mays
MLGVARRRLGSGCVLAQLAQALRPAAAPARTYSAAAKEITVREALNTALDEEMSADPSVFLMGEEVGEYQGAYKISKGLLGKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 581 - protein, 539 aa, Zea mays
MGFRGGLRPPVTRVCFVLLCLCASLSEAKRTPQPAPTTGKKQQPPAASSSQQSPAVSYPALPVRAVCLGGWLVTEGWILPSLFDGIPNKDLLDGTQLQFKSALRKTYLTADNGGGGAVVANRTQASDWETFKLWRLNDTTFNFRTSGNQFVGIGASDGIIVATATTPGLPETFQIVRCPFDKNRVRIKAANGYFVQAIATGEVIADYGEPTRWSDFDASVFLMTTVGQQLQGEYQLCNGYGADKAAPLLREHWSTYIVEDDFKFFASSGLTAVRIPVGWWIASDPSPPAPYVGGSLQALDNAFRWAEKHELGVIVDLHAAPGSQNPWEHSSSRDGTQEWGTTDASIAQTVQVIDFLASRYATSPRLLAVELLNEPLAPGATLDSLTRYYRDGYAAVRKHAPAAYVVMSNRLSSGNSTELLWFAGRGFPGAVVDVHYYTVFNSLFGNFTAQQNIDFVRTNFSGELAAVTTRDGPLTFVGEWVAEWKVPNATKEEYQKYAAAQMNVYGQATFGWAYWTAKNANNHWDLEWMIRNGYISLKG

SEQ ID NO: 582 - protein, 98 aa, Zea mays
MAESKARVALFLAALAAASLLALAPAGAATTCAPTQLTPCAPAIVGNAAPTAACCARLKAHPATCFCQYKRNPSMQRYVNSPNGKKVFAACKVSLPRC

SEQ ID NO: 583 - protein, 266 aa, Zea mays
MDGSAGSFVAVRRLSGSDRAAAFHHSSSAEVVTGSTAWIGRGLSCVCAQRRDSDARLSFDLTPVQEECLQRLQNRIEVQYDSANREHQEALQSLWCASFPGTELRGLISEQWKEMGWQGKDPSTDFRGGGFISLENLLYFARNYPKSFQELLRKQNGDRAIWEYPFAVAGVNITFMLIQMLDLQSVKPRSLFGAVFLKLLSENDQAFDILYCITFKLMDQQWLDMHATYMDFNTVMKSTRRQLERELLIEDIQRIEDMPSYRLLAR

SEQ ID NO: 584 - protein, 331 aa, Zea mays
MEAAAAAVLHRTVEANGISMHVAESGPDGDGAPAVVFLHGFPELWYSWRHQMAHLAARGYRCVAPDLRGYGGTAAPPDVASYSAFHVVGDVVALLDALGIHNKVFVVGHDWGAIIAWYLCLFRPDRVAALVNTSVAFMRHIFVRAAAAAVTPIDYFHRTYGPTYYICRFQEPGVAEKEFSPANAGYLMKRILCNRFTSSAAGDDKRPPADAAEEEPLPPWLTEEDVGHFASEFERTGFTGPINYYRNMDRNWELAAPWADAKVRVPTRFIVGDGDLTYHYPGIQDYIHKGGFEADVPGLESVVVIPGAGHFVQQEKADEVSQHIYDFISKF

SEQ ID NO: 585 - protein, 441 aa, Zea mays
MGGYELVRSDDAAGAAGADLESGSGASKVAGAPPPSPAPSASPAARQQRLASLDVFRGITVLLMIIVDDAGGFLPALNHSPWDGVTVADFIMPFFLFIVGVSLTLAYKRVPDRVEATRKAVLRALKLFCLGLVLQGGFFHGVHSLTFGVDLTKIRLMGILQRIAIAYLLAAVCEIWLKGDDDVDSGYGLLRRYRYQLFVGLVLSIAYSILLYGMYVPDWEYQIAGPGSSSTEKSFSVKCGVRGDTGPACNAVGMVDRTVLGIDHLYRRPVYARTKECSIDYPENGPLPPDAPSWCQAPFDPEGLLSSVMAIVTCLIGLQFGHVIIHFEKHRGRIASWLVPSFSMLALAFVMDFVGMRMNKPLYTMSYTLATAGAAGLLFAGIYALVDLYGFRRPTIAMEWMGKHALMIYVLVACNILPMFIRGFYWRDPNNSLLKVIGIGA

SEQ ID NO: 586 - protein, 194 aa, Zea mays
MSGVQAMPAAVGVAGLRGSGLVSSSSTGLFAGDCKRKARRPACSAWALRQSRIGSRSRSKRGLGIVCNLAGQYEDSFDDVQRQLMNYFTYKAVRTVLTQLYELNPPSYRWFYNFVAVNKPTDGKHFLRALGKERQELAERVMVTRLHLYGKWIKKCDHAKTYEKISDENLALMRERLMETVIWPTDDSSTEKIG

SEQ ID NO: 587 - protein, 478 aa, Zea mays
MPLALAQLQDLRDRISDRLRPWSRSAQFWVRAADIYTSYKVCQLRAGFVKDEDEREAMWEQQHELGAQKMYSLCSELGGLFLKAAQILGKPDLAPMAWVKRLVTLCDKAPATPFDVVRDVVEKQFMKNFDDIFEFFDVEPVGSASIAQVHRARLKLSNTDVAVKVQHPGAEHLMMVDIRNMQAMALFLQKYDINFDLFSATKEMEKQICYEFDFVREASAMERIREFLRITNKKPPVMVPRVIPGMVTREVLVMEFIKGTPIMNLGNEMARRGIDPSGKIAAMAKQKILSDLTLAYGQMILKDGFFHADPHPGNILICKDTEVALLDYGQVKEMPEDLRLAYANLVVAMADDDFLRAEESFRELGIRTWAISDNKLEELFQLSLRMFDTRLPPGVTVMSPFADDSSLTKIGVESFPEELFSVLRTIQLLRGLTVGMGLTFSCAKHWRSIAEDALLKAGRQSASKSRKQKRSFLRRLFW

SEQ ID NO: 588 - protein, 426 aa, Zea mays
MVNAVATIISTVASTATVVVIVALIRRCRVVRKKMKKKIVKKVLEEIEKKNREMQASNAVEDVAIEVGPVETFLNQILNEKPMRFSSEQLAACTRNYSSELGSGGYGVVYKGELPNGLLVAAKVLKVSSMNRKVQEAFMAEIGTIGRTYHVHLVRLYGFCFDASTKALVYEFLENGSLEKYLYGGDEGSTTSTRLEWGTLHGIAVGTAKGIRYLHEECQQRIVHYDIKPANILLTADYTPKVADFGLARLGERENTHMSLTGGGRGTPGYAAPELWMAMPASEKCDVYSFGMVLFEILGRRRNYDPCLEGESKEWFPRWVWEKYEQGEIEHVVSCSCDGIVGGADREKAEIMCKVALWCVQFQPSARPTMSSVVRMLEGEMPIVPPVNPFHYLMESGGGSTSSGLWSGTYQSSSRDTAGAELSPVG

SEQ ID NO: 589 - protein, 550 aa, Zea mays
MTAPRALPVPPHTARRAQGRHPRSTPAPPPPPRHHLHPQQQGATASVLGVGVPRAWLSQRTPVLGLRAWVLVAAGAAAAALALFCLAVCLCRRCSRRRAPRLAPCPHRPGASKSLKHRVHAHHQAATMPPLPPPANKDAEEAAARWRPASFEQPPIQAIKAEQKAPLILAEHFANSTSGESTASDQGGSDAEVPEAARRGWGRRYTRREMEEATGGLAAANMVGEGGYGVVFRGVLRDGTAVAIKNLHNNRGQAEKDFRMEVQTIGRVRHKNLVSLLGYCSEGACRMLVYEYMEKSNLDKWLHHDDSETSSLTWDIRMRILLGTARGLAYLHEGLEPKIVHRDIKSSNILLDRQWSAKVSDFGLAKLLCSERSYVTTRVVGTFGSVSLFLCFFFAGREGCCFSSREFVIVSRVRCRYVAPEYAETGMLNERSDVYSFGVLAMEVMTGRTPVDYTRPADEVNLVEWLKRMVADRRVEEVLDPRLPEPPPSKALKRAVLAALRCVDPDGSQRPTMAHVVHMLEDDQILRDEFKLARDLSPRESDSYEREHSR

SEQ ID NO: 590 - protein, 447 aa, Zea mays
MAETSTYQILVRLLDGRTRCLRFSTPTVSGAVLLDAVASISRVPAAALRLVTGGIDVSPSSVLASAADGQFPYASALLRLRGGKGGFGSLLRGAASKAGQKKTSNFDACRDINGRRLRHVNAERRLEEWKAEAADRQLEKLAENFIKKKAKEAGRGGGPSTAEVDKYLEKYRKDAEICVNVVEESVRASLGKRKTAPKLPSGADAKKLKFWLGKNKVEEDESDSDTDVDDEDIEDLKSADAKSVVVDEGNYSNGCRKNEEKLDLGSVSGSSHSEGESSGEKSQLTTSSGAEGGDFESGDSAELEVGMLDHPISVAAASEEVTADEDNTALATSNQNNPEVPQVEEVRKADKDNTASATSNQNNQEVPQVEQHVGISNSYSEPLDLAKYSSSAELEVLGLEKLKIELQSRGLKCGGTLQERAARLFLLKTTPLDKLPKKLLAKTNGRK

SEQ ID NO: 591 - protein, 439 aa, Oryza sativa
MPALRMKRNFDDDVFRDEFDSKPTKSMKISHFQVSELEQSAVLNLPYKDPHDELDLTTQLAGQDIMIMEAASLDDALGGASLLKDLISEVAVSPNMENDMLVNYEDIRSQLNVVNYFDKDEDANSASYNSCTVNCHEESWGSNEGCSLLDIYNPDDAFSFLLDTPSEFLGSFTALYDEVVPIDSLVNISGRCGVFPLTESTTEASIGNEPCRSEGDMLFSNSEVLEWLNPHLAEEDLPNLVDFTELNSHAVSKEQGARKVTLVLDLDETLVHSTTEQCDDYDFTFPVFFDMKEHMVYVRKRPHLHMFLQKMAEMFEVVIFTASQSVYADQLLDILDPEKKLFSRRYFRESCVFTNTSYTKDLTVVGVDLAKVVIIDNTPQVFQLQVNNGIPIESWFSDDSDEALPQLIPFLETLASADDVRPIIAKKFGDKKDIAEIFQ

SEQ ID NO: 592 - protein, 101 aa, Unknown
  Sequence found in Organisms: Oryza sativa, Triticum aestivum
MAQYYSEVDHCAEEMNWPPHAGGEHYAVRRESYEEVDEMARAGRGHHHGGGGGGHLGYSGSRHGDAHLGGHREEHLVHGDEHRHGHGGGRQYDSCTGQYYG

SEQ ID NO: 593 - protein, 319 aa, Oryza sativa
MAFMSMERSTWAFTFGILGNLISLMVFLSPLPTFYRVYRKKSTEGFQSTPYVVTLFSCMLWMYYAFVKSGAELLVTINGVGCVIETVYLAMYLAYAPKSARMLTAKMLLGLNIGLFGVIALVTLLLSRGELRVHVLGWICVAVSLSVFAAPLSIIRLVIRTKSVEFMPFSLSFFLVLSAVIWFLYGLLKKDVFVALPNVLGFVFGVAQMALYMAYRSKKPLVASSSSAVVAAGLEIKLPEHVKEVQAVAKGAVAAAPEGRISCGAEVHPIDDVMPSEVVEVKVDDEETNRTDEMAGDGDHAMVRTEQIIKPDMAIVVEV

SEQ ID NO: 594 - protein, 96 aa, Oryza sativa
MMRKLAVLVLAVAMVAACGGGVVGVAGAGCNAGQLTVCTGAIAGGARPTAACCSSLRAQQGCFCQFAKDPRYGRYVNSPNARKAVSSCGIALPTCH

SEQ ID NO: 595 - protein, 404 aa, Oryza sativa
MAEICCEVVAGSSSEGKGPECDTGSRAARRRRMEIRRLRVVAERGAEEETSGKRRRLDGGGGEASTDEEDREVERARYGFTSVCGRRRDMEDSVSACPGFLPGHHFFGVFDGHGCSHVATSCGQRMHEIVVDEAGAAAGSAGLDEEARWRGVMERSFARMDAEAVASSRGSVAPAPTCRCEMQLPKCDHVGSTAVVAVLGPRHVVVANCGDSRAVLCRGGAAIPLSCDHKPDRPDELERIHAAGGRVIFWDGARVFGMLAMSRAIGDSYLKPYVICDPEVRVMERKDGEDEFLILASDGLWDVVSNEVACNVVRACLRSSGRRERNRSSPTSNLSPRQSSSSGDEAPNDGAPSAAAGSESDEESAAEEDKACAEAAVLLTKLALARQTSDNVSVVVVNLRRRKL

SEQ ID NO: 596 - protein, 179 aa, Oryza sativa
MSGSSNSSLETRTFLDEVRGLEKNWMVDLGHPLLNRVAESFVKAAGIGAVQAVARESYFMAMEGEGGGTGAVSDSTGARKRSFPDLNGGNSSKSAEAMVKSVSKESLQWGLAAGLHSGLTYGLTEARGTHDWKNSVVAGALTGAAVALTSDRASHERVVQCAIAGAALSTAANVLSGIL

SEQ ID NO: 597 - protein, 122 aa, Oryza sativa
MQTAKVKVQDMVSGAKEKVKEGTAKAHGKAGQATAATHGEKEMAKQEEKAGKAQAKADEHQERAEHRANATTGRHGTRVPLTAGGNRHHHAPVGGPAVDPAYPAAGTGTGTGTYAASDKSYI

SEQ ID NO: 598 - protein, 255 aa, Oryza sativa
MDYHRIHPVGVGSPAPAPDSQQQVGKGRSTASYGEKEQLPITAPRPYAPAPLPPPPPRRRSRGRRCCRCVCWTLLAVLVLAVALGATAGILYAVFKPKIPDFHVDRLTVTRFDVNATAATVSDAFEVEVTSTNPNRRIGIYYDGGEVTASFNGTELCRGGFPALYQGHRSTVRPVILLAGETRLDSAVALQLARQQQAGFVPLTVWARVPIRIKFGAIKLWKMTGKATCNLVVDNLVAGRQIRIRSNSCSFKLKV

SEQ ID NO: 599 - protein, 96 aa, Oryza sativa
MAAKASAVFVLLVVVLAVAAAMRGAEAATCTPTQLTPCAPAIVGNSPPTAACCGKLKAHPASCFCQYKKDPNMKKYVNSPNGKKVFATCKVPLPKC

SEQ ID NO: 600 - protein, 152 aa, Oryza sativa
MLTNHDPISSICRRLYNISDVQTTSLFTPIRFMASEAATTCIGFILLTASSIAAIHRSHGEITETSFIVVSYLSLVLLFVFLRRFEAAPRNSPARGGAKAGVWVVTALLAAVFSWRVSALMPWPVDAIIWVMAASTVLGGFYALFLHHPGVD

SEQ ID NO: 601 - protein, 532 aa, Oryza sativa
MPPEDKALFVSRLPAPSVCNADMRKFIAALRLALAAAAHLLLTLPPAQCYWLNPEIYDAGGLSRRAFPEGFVFGTAASAYQVEGMAKQGGRGPSIWDAFIEKPGTIPNNATADVTVDEYHRYKEDVNIMKNMGFDAYRFSISWSRIFPNGTGMVNQEGVDYYNRLIDYMVKKGIKPYANLYHYDLPLALHEQYLGWLSPNIVEAFADYADFCFQTFGDRVKDWFTFNEPRCVAALGYDNGFHAPGRCSGCDAGGNSTTEPYLAAHHLILSHAAAVKRYREKYQLYQKGRIGILLDFVWYEPFSDSNADRAAAQRARDFHLGWFLDPIIHGRYPYSMLEIVKDRMPTFSDEESRMVKDSIDYVGINHYTSFYMKDPGPWNLTPTSYQDDWHVGFAYERNGVPIGAQANSYWLYIVPWGINKAVTYVKETYGNPTMILSENGMDQPGNVSITQGVHDTVRIRYYRNYITELKKAIDDGAKVIGYFAWSLLDNFEWRLGYTSRFGIVYVDYKTLKRYPKDSAFWFKNMLSSKKRN

SEQ ID NO: 602 - protein, 815 aa, Oryza sativa
MDSTYALHLAVATLLGASFAAASAYYMHRKTLDQLLRFARSLDRDHRRRNRHLLDADDDDDDDPPRDHDRRTTLPIPPGLPPLHTGREGKPIISPASTKRVGPLVRPTTPRSPVPTVSAFETIEDSDDDDENIAPDAKNNAVSLLTNGTIGSDPLPGKASQNGDTKPVPSTNMIRSQSATGSLHGAQHNPVAADILRKEPEHETFSRINITAVETPSPDEIEAYKVLQKCLELREKYMFREEVAPWEKEIITDPSTPKPNPNPFYYEQQTKTEHHFEMVDGVIHVYPNKDAKERIYPVADATTFFTDMHYILRVLAAGDIRTVCYKRLNLLEQKFNLHLMVNADRELLAQKAAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLFEVTVDPASHPQLHVFLQQVVGLDLVDDESKPERRPTKHMPTPEQWTNVFNPAYAYYVYYCYANLYTLNKLRESKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSIAASLWKLSSCDLCEIARNSVYQSGFSHRLKSHWIGRNYYKRGHDGNDIHQTNVPHIRIEFRHTIWKEEMELIHLRNVDIPEEIDR

SEQ ID NO: 603 - protein, 150 aa, Oryza sativa
MQAGKNAMQSTKEAAANVGASARAGMDKSRAAVQGQVEKATARNAADKDAAEVRRQERLQAAEEEKQHAMAANAAAKERATGGAGAYHPSQGAPGVDPRAAQPTGGHVQDGVAESRPVGTATGTARPSAAHNPHVGSDFSQAHGTGGQYQ

SEQ ID NO: 604 - protein, 88 aa, Unknown
  Sequence found in Organisms: Oryza sativa, Brachypodium distachyon
MASTKMAVVAILAALLLMAAAEPALATAPSLVPARKLQMPRIMDVISAESKLACLPAGGFCMFRPMDCCGNCGCLYPVGVCYGSRCEE

SEQ ID NO: 605 - protein, 172 aa, Oryza sativa
MEHQGQHGHVTSRVDEYGNPVGTGAGHGQMGTAGMGTHGTTGGMGTHGTTGGMGTHGTTGTGGGQFQPMREEHKTGGVLQRSGSSSSSSSEDDGMGGRRKKGIKEKIKEKLPGGNKGEQQHAMGGTGGAYGQQGHGTGMTTGTTGAHGTTTTDTGEKKGIMDKIKEKLPGQH

SEQ ID NO: 606 - protein, 147 aa, Oryza sativa
MMYMRATHRDEEGKKVTEKVAVPETRHPDTARHFERKLDQQGLHRMERHPANGSRGIGAPPPKSGRGGKFTWEGPDSIVDSQLDPLPAAIDRNDPNYEEEEGDHEREADVVGEVEVAKVAGDARDGVARVDVVAPPQLHEKLQLQPQ

SEQ ID NO: 607 - protein, 208 aa, Oryza sativa
MRLLRRKSSMGGGGGGGRGLRRVVSLPRSPMALSLAPRASLAKTESIKKRDKNNNKGSKRARLRAGLSAALHLGGGHRRAGRRGGGGDEGAGAVSSAAAPGVAVLLRAAADDADERPAAAAANVGHGGRDHASGGRGRSWAVAVAMVLVLACVVALGRGPAICCCTCAAWWCGGRAVDPACRRRWSSIGGGGGGRHSSVPPQAGCLKH

SEQ ID NO: 608 - protein, 379 aa, Sorghum bicolor
MLLAAEPDDAHEEGENQQLLITTKGGPGLEGLVVGSYCHDVLIRGGRVVGETLGGAAAFVSNVLDAASPQDAALNGTAPFVVVAKVGHDFVYASAPAPARHPPLLCASPTTSFHAQFSETAASAHAPDRELRRVRACDPIYPADLPDRRFAYGLAVGVAGEVLPETLERMIRLCRAVLVDAQALIRAFDGDGAVGHVALDDTPYARLLPRVAFVKASSEEAPYVGVETTRQRCCVIVTEGRDGCRLYWDGGEARVAPFPAVQVDPTGAGDSFLAGFATGLLWGLSATDAALLGNFFGAAAVSQVGVPTFHPKMLQAVKEILEEKTTKRYSPCINGTSFTFEKSNLHNELHAALQEAAMLMSEQQQADKANGNGGDICSP

SEQ ID NO: 609 - protein, 765 aa, Sorghum bicolor
MAGGAEVAVVEDTAVVGAPTATATPPPPDAAGGAEEGMRMEGWLYLIRSNRFGLQYSRKRYFVLEDAALRCFKSAPSSKREDPVRSAIIDSCIRVTDNGRESLHRSDFYIFTLYNASNHYDQLKLGARSSEEAARWIRCLMESALKSPRKDEHIVACSHRRWQAFRLSRRNRQMHSIDWTLFSSAHNDPMASDVIAPSPWTIFGCRNGLRLFTEANDGGSRGKYWDDHPAIMAVGVVDANSEAVFQTLMSLGQSRSEWDFCLREGKVVEHLDGHTDIIHKKLRGDWLPWGMRKRDLLLRRYWRREDDGTYVILYHSVFHYKCRPERGYIRACLKSGGYVISPVNQGRQSVVKHMLAIDWKFWKSYLFTSSAKYITIRMLGRVAALREFFRAKNGNCACMEFSSGELTRDMGLPQGENQRINLEIQQENENRRLEGPTEGSVGGSNRHLNSTSSFVQLNDATDEFFDVPDESEYDQREVMFPSDESTHASDQRHAKLSTAAVFVKRLHDLAVQKRGYVDLQGAADADNGPCCYGYTLPKDSSYAVPSTWAMTDPTTFLIRGETYLHDRLKIKANSTLMQMVGADWIKSDKREDDLAGRPGGLVQKCAAQGGTKFFFVVNIQVPGSTTYSLALYYMMDTPLEKVPLLERFVNGDDAFRNSRFKLIPYISKGSWIVKQSVGKKACLVGQALEINYFRGNNYLELGVDIGSSTVARGVVSLVLGYLNNLVIEMAFLVQGNTYEELPEFLLGTCRLNYLDASKAVSIDEC

SEQ ID NO: 610 - protein, 664 aa, Sorghum bicolor
MGKSNKKSSVGAAPAAVAVPEGKSVKKGKRNAEDEIEKAVSAKKQKTAPEKAVPVKKQPPPKKVESSDSEEDSSDSEVKVPVKKQPPPKKVESSSSEDSSDSEVEVPVKKQPPPKKVESSSSDSEEDSSDSEVEVKVQPKKVIQPKKGTQLAKQESSDDSSSESSDDEPSKKPVAGSKKPAASSSDSDDSSDSDDSSSDEEPAKKPTVLSKKPVTAVSNGSKQVKHDSSSSDSSSDEDEKPAANLKKPPVASLQKKTQESDSSDSDSDDDESEDDIPAKAPVVAKKKEASSDSSDSESEDEDNNAKTVQPVKAAAPKKKEESSGSSESDSESDSDSDEPEKPTVPGKRPLATNKKNEESSDESDGSSDESSDESDEEPPQKKSKETPVDTTQKSAHNEPKTPAKSQSQATGSKTIFVGNLAYSIEREQVKEFFEEAGEVVDIRLSTFDDGSFKGYGHVEFATAEAAQKALEFGGRDLMGRSLRIDLAVERGAYTPNSGKDNGSFRKSAQRSGNTVFIKGFDTSVGEDQIRSALEEHFRSCGDITRISIPKDYDTGASKGMAYMDFKDPDSLNKAYEMNGTYLGDYSLYVDEAKPRPDNNRDGGFSGGRGSRGRSDRGRGDRGRGRGFGGRGGRGDRGRGGRGTPFRQTAGTPSAGKKTTFGDDD

SEQ ID NO: 611 - protein, 580 aa, Sorghum bicolor
MASGGEGAGSGESPPAASVEAAAGEATLHIRCANGSKFTVQTDLGATVGAFKEVVAGSCDVPAPQQRLIYKGRILKDEQTLESYGVETDHTIHLVRGVAPPAASSAPAAASPLASSTPSSGPAGGLGGLFPGLGAPASGRPSGIFGPGFPELEQVEQHLSQNPNLMREIMNMPAMQNLMNNPDLIRNMIMSNPQMREIMDRNPDLAHVLNDPSVLRQTLEAARNPEIMREMMRNTDRAMSNIESSPEGFNMLRRMYETVQEPLLNATTMGGEGNTASNPFSALLGNQGSNQPGQGQPATNAPATGSESTTGTPAPNTNPLPNPWSTNAGSAQGATRSSPSGNARTGASGGVAGTGATGGLGGLGSPDLSSLLGGLAGNPRTGAAGGLGGLGSPDLGNMLGGSPDVSLFNQMLQNPAMMQMMQSIMSDPQTMNQLLNFNPNTRNLMESNTQMREMLQNPEFLRQLTSPDTLQQLLSFQQSLLGQLGQLQPSQGGNNAGSATGTQGNPSLDTLMSMLSGLGSGGGLGVPNTSNVPPEELYATQLTQLQEMGFIDTAENIQALVATAGNVHAAVERLLGNLGQ

SEQ ID NO: 612 - protein, 396 aa, Sorghum bicolor
MSWWWTGAIGAVKKRQDEQAAAAEPSYQSVALVVGSTGIVGTSLLDILPLADTPAGPWKVYAVSRRPLPPWSPAPSPAVTHLHLDLADAAAVHDALTPLTDVTHVFFVAWTSRATEAENREANAAMLRNVLSVVVPNCPALVHVCLQTGRKHYVGPFEAIGKVATPEPPFTEDMPRLDCPNFYYDMEDVLFDHVSRRGGAVSWSVHRPTTVFGYSPRSAMNLVGSLCVYAAICRKEGATLRWPGSRVTWEGFSDASDADLIAEHEIWAAVDPFAKNEAFNCSNGDIFKWKQLWPILADHFGVEWAGYEGEENRFRLEDAMAGKEAVWAEIVRENELIATELDEITNWWFVDAMFAVETQLLDSMNKSKEHGFLGFRNTVTSFNTWIEKMKVFKIVP

SEQ ID NO: 613 - protein, 316 aa, Sorghum bicolor
MASRDFLRVFGEGSGSGSPKAANAGAGGPSDDVELSLGLSLGGRFGTDAAAKRPRLARSSSIASVCSVSSLHGDGDGEGDADADPSPAAPLPLLRTTSLPTETEEERWRRREMQSRRRLEARRKRVERRNSSMASLVPAGPKPAAAAADANANAAVGSGRRSNASQGSNSVSTTEQGIGGSAINQSTDARSPSTSDNTNQNSMLPPTKAAEKPLNGTPTEQPRLRTLGSLTTRTSSTSDIRKLMMEDMPMVSSKVEGPNTRRIDGFLYRYKKGEDVRIVCVCHGSFLTPAEFVKHAGGGDVSNPLRHIVVNPAPFS

SEQ ID NO: 614 - protein, 177 aa, Sorghum bicolor
MEAAVATSTRVPPLPLPPTAVRPLLPSGLARSRRGFASISDAGGGGGRVSGGGGGGGGGGGDDSGAGAAAGAAAVAALGEAEQQADGGDSDAIVLHVGGMSCGGCAAKVKRILESQPEVAAATVDVEKATAIVWTTPEAKATKDWQKQLAEKLANHLTSCGFQSHVQDEGEAEQTDS

SEQ ID NO: 615 - protein, 228 aa, Sorghum bicolor
MAWEEEAVEEEEYGDEMAASESEEDVVVGQMPTVMVPKHINKRALKNKALSVTLDKKALRDFVTGFHKRKKKRRKEAQKILQEKERKKKIQDRKRRKEEKEIALYGRVLSSDNNDDAGLENEDIGDDGEDMENDEPLSETKTYEDDGTRIIVTTSEITPEDDDMGPKTVGPVSTSYTNKNPSSFAKKNNSLGVKKKPQKRTFKSKSKAKKGDKKRGAAKGKRKGKGRK

SEQ ID NO: 616 - protein, 321 aa, Sorghum bicolor
MEEESGAASRYYCHMCSLIIRPELGIEELKCPHCHTGFVEEMAGDRRGSDGAAIRGRAPADEASFNTSDAALEREVSLWAPVLMDFIAASSGRHGLDGGGGGDLAALARRQYRNIALLQLLNALQEGDADGGRERVVLMSPADARAMLMGQERRDGDARAALGPGGLTLGDLFLGPGLDLLLEYLAETDPSRQGTPPARKEDVAALPMVRVREAFTCPVCLDEVAGGGEAREMPCSHRFHDQCILPWLEMHSSCPVCRHQLPTEEPAAEAIGSGRGAGDESSGNARGGDGGNGGGRRHWFSWPFGGLFSQRSNGNSSSSSS

SEQ ID NO: 617 - protein, 479 aa, Sorghum bicolor
MPVRTWLADLRSKLVVGVGPRDHGGLGILAFEAAATMSRLVSLHRTVSDVEVRRLRGDVLRAEGVARLTSADQALLLRLACGELLADLDRAADSVARLGARCCAGAGDTPAPLLRDFDRIYAEAKRSRLAQLDATVGFSRGATKRFREMERHVVVAAKLYAEMDALSELEASQRRMEQWKQHSGPIPAQSLGTGKRSSAGEPGEKLMSKLRAQRHKVRRLTEGSLWNVAAGKAARLMAKSVLAVLARISLAFSASVPGLPPWTVGRAWALGHSSGPLHRSATPAALRHSAPIFGQKDAASPLLESIKPSVSMVGGSSMELRYANVILTAETLLAALRPPAAGDSEEVQEGMIDLSTRDALYKMLPVSIREAMNTKLRERWGKGQPVDEVAAAESRDAVERLLRWLSPMAHDTLRWNDERSMERAQRFGMQPRALMVQTLHFADRQKTDAAIVDVLIDLSCICWYDDERRRLESHDWDAE

SEQ ID NO: 618 - protein, 401 aa, Sorghum bicolor
MAEICCEVAATGSDRKGECVGGDAGSRAARKRRMEIRRLRVVAEEASAKRRRLEADEEDAVRRPAPRYGVTSVCGRRRDMEDAVTTRLGFIDGHHFFGVFDGHGCSHVATSCGQRMHQIVAEEATAAAGSSASDDAARWRDVMEKSYSRMDAEAVGSRDTAGPAPTCRCEMQLPKCDHVGSTAVVAVVGPRHLVVANCGDSRAVLCSGGAAIPLSDDHKPDRPDELERIHAAGGRVIFWDGARVFGMLAMSRAIGDSYLKPFVISDPEVRVVERKDGEDEFLILASDGLWDVVSNEVACKVVRTCLRNRAPPHPHGGDGERSSPTSNLSPRQSSGSGSSSGDEEGAGPSDGAGSESDGDGESSEDRACSEAAILLTKLALARQTADNVSVVVVNLRRRRRS

SEQ ID NO: 619 - protein, 331 aa, Sorghum bicolor
MSWAAVENDPGVFTEMLQQMQLKGLQVDELYSLDLDALNDLQPIYGLIVLYKWRPSEKDERPVIKDAIQNLFFANQIINNACATQAILSVLLNSPGITLSDELKKLKEFAKDLPPELKGLAIVNCASIRMLNNSFARSEVSEEQKPPSKDDDVYHFISYVPVDGVLYELDGLKEGPISLGKCPGGVGDTGWLELAQPVIKEHIDLFSQNEIRFSVMAILKNRKEMYTVELKDLQRKRESLLQQMGDPSAIRHVPSVELSLAEVAAQIESVTEKIIMEEEKMKKWKMENLRRKHNYAPFLFNFLKILEEKQQLKPLIEKAKAKQKSHGPSPR

SEQ ID NO: 620 - protein, 577 aa, Sorghum bicolor
MDQLPKRPANYVPLSPVGFLPRANAAYGDRASVIYGRVRFTWRQTYHRCRRLASALLSLGVRRGDVVSVLAPNVPAMYEMHFAVPMAGAVLNTINTRLDAGAVATILRHSGAKLFFVDYDYVRLAGDALRLLAADGTPAVPLVAVIDDIDSPTGARLGELEYEALVAHADPDADLPPLEDEWDAVTLNYTSGTTSAPKGVVYSHRGAYLSATSLLLQWGVTTEPVYLWTLPMFHCNGWTFTWGMAARGGVNVCIRDARPADIHRAIARHRVTHMCCAPVVFSILLEGQGAGDGAARQLEAPVHVLTGGAPPPAALLERVERIGFKVTHAYGLTEATGPVLACEWRGQWDHLPLPERARLKARQGVSVLSLADADVKNAETMVSVPRDGKTVGEIVLRGSSVMKRYLNNPEANDNAFTGDVSVVHQDGYIEIKDRSKDVIISGGENICSKEVEEVLFRHPAVADAAVVAMPHPRWGETPCAFVVPRNNAAELSEDDMLAFCRKRMARFMVPKKVQVVGALPRNALGKVEKVKLREAARKLAPSVPAQKPKGKTTTSSTTVGGRREDQPVAHVMAVSRL

SEQ ID NO: 621 - protein, 92 aa, Sorghum bicolor
MAKQQQQAMALLMMLVLAAETASAASCNAGQLTVCASAMLSGAAPSAACCSNLKAQQGCLCQFAKNPAYARYVNSPNARKTVASCGVALPRC

SEQ ID NO: 622 - protein, 394 aa, Sorghum bicolor
MAILDVDLATPPCHAHARQQQAHADEQQDAGEEEDEQLLLLKGVRHLCERGTITKLPARYVLPPSDRPSPGDDEQPPRSSCVSFPVIDLARLRVPAERAAALAELDAACRDYGIFQVVGHGVDGGGGGAMLDVARRFFDLPFEERARYMSADIRAPVRYGTSFNQLNDGVLCWRDFLKLVCSDDLAGVVPSWPDAPTDLRKVVSAYARSSRRLFKELMEASLEALGIRSGAAAEMLADCDAGSQMLMVNCFPACPEPDLTLGMPPHSDYGFLTVLLQDQVNGLEVRHADRWVLVDPLPGSVVVNIGDHFEMYSNGRYKSVLHRVRVNSSRPRISVASLHGLPPERVIGPAPELVDDDKNPRMYMDTDFATFLEYLTSAEGKHKSFLHTRRLITS

SEQ ID NO: 623 - protein, 104 aa, Sorghum bicolor
MARSAFVPMAEEKEQGGAGAGRGAGAGAAVNNKEQQEVLLVHSQVRRIKKEDEEARERLLKLRLLETRPAAAAGGVAWRAPRSLSPLRRAGSAIPVPVPVPVGE

SEQ ID NO: 624 - protein, 466 aa, Sorghum bicolor
MAGHAQSWRTYLCCGAGGSAAVEDDSGSTTRRRRITRRRGKDSPRSSSSRMSFTSLSSSEMLSPEDLSLTLSGSNLHAFTYAELRSATAGFSRANYLGCGGFGPVYRGAVGEALRPGLRAQDVAVKYLDLEGGTQGHKEWLAEVFFLGQLRHKNLVKLIGYCYEAKHRMLVYEFMSFGSLENHLFKSVNGALPWMTRMKIAVGAAKGLAFLHNADPPVIYRDFKASNILLDSDYNTKLSDFGLAKDGPQGDETHVTTRVMGTHGYAAPEYILTGHLTAKSDVYSFGVVLLELLAGRQSVDRSRRPREQNLVDWARPYLKHPDRLYRVMDPALECQYSCRGAEVAAVVAYKCLSQNPKSRPTMREVVRALEPVLGMDDFFPAGPFVFTISVEEDKVVGVKVEVEEKLPQQHQSHQDRHRQKYPNSSIHAGGIVLHGREGMVGGDDYTATLRRQRRAAAASYHKERGA

SEQ ID NO: 625 - protein, 874 aa, Sorghum bicolor
MGGGRKRGRTQRRHFKQGRENVWKHNPQRPPAGEGGEGREGNPSWQPFATENPSFEEYYKEQQIVPEEEWDSFMSMLRKPLPATFRINASCQFYQDICSQLENDFRKSLETEVTDEHEEDAIRPLPWYPGNLAWHLNFSRMQLRRNQALESFHEFLKRENEVGNITRQEAVSMVPPLFLNVQPDHHILDMCAAPGSKTFQLLEMIHQSTKPGVLPNALVVANDVDVQRCNLLIHQTKRMCTANLIVTNHEAQNFPGCNLAKFCSEVCMDEAKLQRLEFDRVLCDVPCSGDGTVRKAPDMWRKWNAGMGNGLHRLQVEIAMRGMGLLKVGGRMVYSTCSMNPVENEAVVAEILRRCGDSVELLDVSNELPELARRPGLSTWKVRDRGSWFGVHEDVPRYRKHVISPSMFPSGKGSKDSLTVSSSVEVNTDVADADMKDSTDIGEGEQETNITIDDSDNADNLKTKEGTKVDCEFGEVTASSYKKSNSTPIRTEHSDYPLHRCMRIVAHDQNSGAFFIAVLHKLSPLNENQVIDGVKGEQNISKDKTEKLEKDLGSDKASSEENIVHHEVIDNTNVLDGEQNEDRDNKSSKDKSSEDSKVNVNEAEKGQAGTRDRRRQQNQGRWRGVDPVIFFKDEATVKSIVSFYGIMDSFPLEGHLVTRNPDASHVKRIYYVSKSVQDALQLNIKVGERLKITSLGLKIFERQSSKEGSPCTFRLSSEGLPLLLPYITKQILYASAIDFQHLLQYRTIKFPDFVDAKFGEEASALLPGCCVVVLREGHQDIGSIATDPSAIAIVCWKGKTNLCVMVSPLDGKELLERISLRFGLKIPKGDKEKPSEEIAGSDELLDCATEVDDQECFPESKASDIEISDAKDAD

SEQ ID NO: 626 - protein, 273 aa, Sorghum bicolor
MQAPSPPAPSSSVDLPLAAAPPPVKAPTPRPPPPASLQPESPGVFFSAAAAAAPLGTSHRRIAIAVDLSDESAYAVRWAVANYLRPGDAVILLHVRPTSVLYGADWGAVDVSLPNPSNAAAASEDDDDDSEAAAAASRMDDDYDAFTASKADDFARPLKDAGIPYKIHIVRDHDMKERLCLEVERLSLSAVIMGSKGFGAARRTSKGRLGSVSDYCVHHCVCPVVVVRFPDDGSAEAGEAGGFSAAVGAEDVLHPVLEEEAEYHDAAEEHKDT

SEQ ID NO: 627 - protein, 203 aa, Sorghum bicolor
MEDCGGVTAGSGKKPFQLTRSLTYHHHQGHRPAASAARWRRQQLADEPRAQRPQAVVLYTTSLRGVRRTFADCTAVRAILRGFRVAVDERDVSMDAALRRELQALLAARARAFALPQLFIGGRLVGGADEVRQLNETGQLRRLLDGAAGQDPAFVCDACGGVRFVPCTGCGGGRKVFVEEEDRVVRCGECNENGLVRCANCCS

SEQ ID NO: 628 - protein, 89 aa, Unknown
  Sequence found in Organisms: Sorghum bicolor, Triticum aestivum
MEGKSRLPEVTIVPAARPLAGDGTIDAAKAAAAPGKEPISPGTPSSADAGRRGKERRAVEAVPLPGWKLDALCQESCPSPTMRARFPYF

SEQ ID NO: 629 - protein, 171 aa, Sorghum bicolor
MGSQAIEAHRAGAEVYTGAALCAEKSTELLSEVHLPLGLLPLADMEEVGYNRATGFVWLRQKKALTHTFRQIGRQVSYAAEVTAFVEDRRMKRMTGVKTKELLIWVTLSDMFLDKDDQSKITFKTPTGLGRTFPVSAFAKEGDAAAKPKDASSAANGNKEAVAAGKAAASK

SEQ ID NO: 630 - protein, 911 aa, Sorghum bicolor
MSLFAGVGGGAADAASGGGTGRALLELTPHKMAVCHLVQVFAPPAQAGGDVVPPFPFESLAHHNRLGLFLFTLTRSCEDFLEPPLEEFLRQLKAVDDLANGWFCEQLTSSLSALISPDDLFNFFDKLQGVLTASEGASAEDVFLDPNSQLGVFLRCCILAFNSMTFEGVCHLLADLVMYCNSTDASYDLAEDEDFNSEMGNLMDADIGSQVGIFDKFHQGYASERHMGESSSALIRAPMSTNDFDDANIFKADGNPTCLRSRWQLEAYLNQQADILEKDPGSVPLNSFNATMTQLQTLAPELHRVQFLQYLNALCHDDYVASLDNLHRYFDYSAGMQGLFGRSVAQVQDIVVGKYESALLCLGNLHCYFGHPKKALEAFAEAVRVSQMNNDDSCLAYVLGAISNLLSKIGISNTVGIITSPYSLGTNIGLGTPLSIQQQLLVLLKRSLKRADALKLPSLLSFDHLLLAKFDLKHVQRPLVSFGPNASTKLRTCPADVIKNLRLGSRVLTDFGADVLSTSNDNGSFSTSWLRNLSATSDSWRRSSMNTKKLHINDFDNFHYHAQPSPVPAPILQLAGSACLLRATAWEHYGSAPMVRMNALVYATCFADAASSSELSLAYVKLIQQLAVFKGYSAAFCALKLAEKKFPSSTSLHIQLLGMQILHERALHRGHLKVAQQICDEFGVLSSSVSGVDIELKTEFSVRRARTLLAAKQFSQAAAVANSLFSTCYKYNMQVENASILLLLAEIHKKSDNAILGLPYALASQSFCKSFNLDLLEASATLTLAELWLALGSSHAKKALSLVYQSLPMILGHGGLELRARAHIVLAKCHLADPKFSVLEDPEAVLDPLNQATEDLQALEYHEMAAEAYYLKAMAYNHLGKLDEREEAAARFKDHVTALENPQNEEDSLAY

SEQ ID NO: 631 - protein, 102 aa, Sorghum bicolor
MERVASSCVSLLAQRRAYSVAAAMAKGVARRGADEKKAAAAAVTKRVMGKKEVNTAAAAAAEEKKAWVPDPVTGYYRPAGSAAKEVDAAELRAKLLTEAAAN

SEQ ID NO: 632 - protein, 276 aa, Sorghum bicolor
MASAPAPAPAVVVVFDFDRTIIDWDSDDWVITKLGAADAFRRLRPTMRWNPLMDRMMAELHARGKTPEDIRDCLRSAPLDAHVVSAVKTAAAALGCDLKVVSDANTFFIETVLAHHGVLGCFSEIVTNPATVDADGRLRISPFHDSAAAPHGCSLCPDNMCKGKIIERIQATASDKKQHFIYIGDGKGDYCPSLKLGEGDYVMPKENYPLWNLICNNKQLLKAEVHPWNSGEELEKTLLKLVSKMIAAPAQASQFDYSKCEMSNPAIQHPALRVPH

SEQ ID NO: 633 - protein, 329 aa, Sorghum bicolor
MAASHPPTLLLLLLVLAAIAPRPSSARHIITFAPSRAVNPSSLAWDPTAQHFVVAGGGDAVLSVSDAGVTESIVSTGASSVAIDDRRRRLLVASPGSVSAFDLRSPRPHSLIFSTPVPDPAPPGGIAVDPHTGNAFLTVGARIYKLSVEGDLAALASAPALGSDPLASLTAHVSRGFLLVGQPSTGRILRVDMEDGATRTVSCPLTPPTPTAVAVRTDGAVAVGGAAGLRLVVSNDGWVSCGVRDEAAPAPDGPVAAVAVRERRRVYALVEAGATDGGNKWRIEETSWKSESEGEMVVVLLFVGVALAIFMFWRFQMRQLAGNMNKKIR

SEQ ID NO: 634 - protein, 536 aa, Sorghum bicolor
MATPAPAPSLRLLLLLPLLTVAGAAVSHPAHEFCAVGGDAAGCGGGGDGTRILIKGGTVVNAHRAEEADVYIEDGVVVAVRSNIPVGADNVRVIDATGKYVMPGGIDPHTHLEMEFMGTVTIDDFFSGHAAALAGGTTMHIDFVIPVNGNLTAGLESYKHKAAKAAMDYGFHMAITKWNDEVAREMEVMVKEHGINSFKFFMAYKGSLMVTDDLLLQGLQKCKSLGALAMVHAENGDAVAEGQQRMIDLGITGPEGHALSRPPILEGEATARAIRLAKFINTPLYVVHVMSIDAMDEIAKAKREGQRVIGEPVVSGLVLDDSWLWDPDFTIASKYVMSPPIREAGHGKALQAALSSGILQLVGTDHCTFNSTQKAFGSDDFRKIPNGVNGLEERMHIIWDSMVETGKISVTDYVRVTSTECAKIFNIFPRKGAILEGSDADIIILNPERSFVMGAHTHHSRSNTNVYEGRKGKGMVEITISRGRVVWEDGVLNITPGSGRYVMMPPFGYVFDGIQRSDAAYRASLRAPVQRGKASA

SEQ ID NO: 635 - protein, 412 aa, Sorghum bicolor
MAEICCEEAKSTPATAVAAASVSAAAAAVAVASSALERRRRRLEMRRFRVATDPEAPVAEDVRATKRQRLLARTVSGSCPDAGSDSDRPALPERLPRYGVTSVCGRRREMEDMVSIRPDFLPGTSTQHFFGVFDGHGCSHVATLCQDMMHEVVADEHRKAGCGEETAWKGVMERSFARLDEQAASWATSRSRDEPACRCEQQMPLRCDHVGSTAVVAVVSPTHVVVANAGDSRAVLSRAGVAVPLSVDHKPDRPDELARIEAAGGRVIYWDGARVLGVLAMSRAIGDGYLKPFVSSEPEVTVTERTDDDECLILASDGLWDVVTNEMACEVVRACFRSNGPPQAPAARPNGVAALPAADADDENGPAVVKGVSKEDSDRACSDAAMLLAKLALARRSADNVSVVVVDLRRGI

SEQ ID NO: 636 - protein, 568 aa, Sorghum bicolor
MLVLFETPAGFALFKVLDEGKLDKVEDLWKEFTTSDSARKVVELKAFNKFENTSDALSAATLIIDSKPSKGLRKFLQKHCEGETLAVADSKLGNSIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGDRANAVNLDFSEILSDEELETQLKEAAVISMGTEVSDLDLLNIKELCDQVLALSEYRAQLYEYLRSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKKGAGALTTPAKTYNPAADLVLGHSTEETPKKSELASKKRKHHEAETAPSAEPEEEAIQEDGDQEGRKKKKKKNKETEETPAVEADGEKKKKKKSKEDGEPVAALEGEKKKKKKISDADGENVAMQTEASAKKDKKKKKKRHADDE

SEQ ID NO: 637 - protein, 355 aa, Sorghum bicolor
MCVEELDDAAGRLGFGDQEIDRRAGAAMERVCENTVSVEFKQTKLNNFVPFIRSGDWSDIGSRDYMEDAHVCISDLAKNFGYNSVDDEVISFYGVFDGHNGKDAAHYVRDNLPRVIVEDADFPLELEKVVKRSFVQTDSKFAEKFSHQKGLSSGTTALTAMIFGRSLLVANAGDCRAVLSRRGTAMEMSKDHRPCCINERKRVESLGGYVDDGYLNGQLAVTRALGDWHLEGMKEMGEPGGPLSAEPELKMVTLTKDDEFLIIGSDGIWDFFSSQNAVDFARRKLQDHNDLRLCCREIVEEAIRRGARDNLTAVMVSFHQDAPPQSRWNRTREGSVARSISAEGLHNLRVLLEGQ

SEQ ID NO: 638 - protein, 199 aa, Sorghum bicolor
MTMRPLPQTVVHLLPPVAAVLAFALIGCLVGGASATVVTTCRAAADSDARVDYGFCVAELGMHRESPDADVWGLAKVAALTGVNNADNAVYDIKALLLLAADDGAKSRSPPPDGPTRAALEKCGRLYDSVGFAFAEADDEINNRRYAAGKGKVAEAVSLARQCDDALAKAAAVPSPLAQHSSYNVRIANICTAITNLIK

SEQ ID NO: 639 - protein, 238 aa, Sorghum bicolor
MASSCHHVDVPGKPTETGTALLETATGTIQGFAPLSQIHQHLCAFHFYADDMGRQVEAHHFCAHLNEDVRQCLIFDGPGAGARLIGVEYIVSEAVFLTLPDGEKPLWHTHEFEVKGGFLFMPGVPGVVERRDLEKVCKTYGKTIHFWQVDRGDALPLGIPQIMMALTREGQLQQDLADCVEKKFGVSFQKERENRAYMSGPEHGIHPLANAAGKGLRTEIREVDIPASTTAGAGRVFT

SEQ ID NO: 640 - protein, 283 aa, Sorghum bicolor
MEDERSTQQHQGGEVQENAAEVKDRGLLDSLLGRKKHEDQDKKQEEELATGMEKVTVAEPEKKEEEHEAAGEKKESLLAKLHRSSSSSSSSSDEEEEVIDENGEIVKRKKKKGLKEKIKEKLPGHHKDHDGDHHTAAVPAPAPVVDAHAHHHQEEEHKPQHFPAPAPPPHVETHVHQHDHGVVVQKVEDDVKTETPPPAPEEEKKGLLDKIKEKLPGGHKKPEDAAAAAPAVHAPAPAPHAEEVSSPDGKEKKGLLGKIMDKIPGYHKGEDHKDAAGEHKTSS

SEQ ID NO: 641 - protein, 250 aa, Sorghum bicolor
MERGDDCQFMVVHQYDEAAQLMHQLMVAAAGDQQDPNAGAAGRGAGGGGGERKRRFTEEQVRSLETTFHARRAKLEPREKAELARELGLQPRQVAIWFQNKRARWRSKQLEHDYAALRARYDALHARVDSLREEKLALAKQVDELRGRLQSVSERQDQSGSCEVNDAADDGKRNLNSTTTTCLVLVQEDDGATPPAAVDASGSEDSAATEYGYGYDYDHVVAYGEGLHDPLCATPDLWDTWPLLEWNAVA

SEQ ID NO: 642 - protein, 174 aa, Sorghum bicolor
MTELFDTAVTSLLHLPEVLDRLAAADGDRRSGGHHAAHHHGHARVHGLGGGGGGGAPVDIVETPGEYTFVLDVPGLSKSDIQVTLEEDRVLVMKGGSGKRKREEEEEEGEGEGCRYIRLERGATPRSFVRKFRLPEDADTGGVAARCENGVLTVTVKKLPPPEKKTKSVQVTIA

SEQ ID NO: 643 - protein, 674 aa, Sorghum bicolor
MASSLPVHDRLAAAMHGRRLFTVVVLIFALVTPPADAVTAACNSTGGTYTSGSAYDINLSRVVGGLPTNASASPELFATATVGTGGGDNQTVYAIGLCRGDMAADSCLLCLQSSFSDAQGFCPSDMDVSMDYDSCHMRYSGADFLAASTNNSVQQAVFSSFPAVTPSSAAAAFNGLVARLLNATAEYAAANSSRRFATGVMEVDSGYSQGKFSNIFATAQCTPDLTPAQCRGCLAAAMADMPSQVYARNSTGASLVGERCGFRFAPYQFYNGDIMVQLRVGEPPAGKKTATTLVLAIVLAVLGGLCSLTLIIFCHWRKIRSPRKSSLFINVEDIESFESIFISLSVLRSATSNFDEKNKLGEGGFGVVYKGALPDGQEVAVKRLSETTTQGLGQMTNELALLAKLQHRNLVRIVGVCLEEGEHLLVYDYMPNKSLDTLIFDPDKSRQLDWGARFKIINGIARGMQYLHEHSQLKIVHRDLKASNVLLDADMRPKISDFGLAKIFEDDQTRHVTSRIIGTRGYMSPEYAMRGQYSAKLDIFSFGVLVLEIVTGRRNNYAVNSEHSPNLFCLVWKHWVEGTIAQIADPSLGRHYPMAEVLKCINIGLLCVQQSPTDRPSMSAIVVMLSSDTVAVEAPYRPAYVDRSRSYTEMTVELIKEKEELCSPQSSITELMPR

SEQ ID NO: 644 - protein, 370 aa, Sorghum bicolor
MWNPKPFLVLISLCISASSSPCTAASAAAAGGKPLVTAVTKDASTSLYTAPLKDGHPLLLDLTSPVISLTTCTSKNGTVTTLSANATDGQNPLFPVSFSAVASCTPQAKVPAGAVGVAGLAPSTSQSFPAQVARTQKVANKIALCLPSDGKSTTGDSVGVAIFGGGPLVFPDRGDFTTMLAGTASLQGFNGSPGYFVSATGIAVEQSRVGTSSAGGSSLVVALSSTTPYTSLRPDVYVPFVNAFDAAATGPNFPWMSRVAAVAPFERCYDSTKLPPTRLGYAVPQIDVMLQGGQNYSVLGGNSMVQVNGNTACLGFVKAAAGQAPAAVIGGFQLENHLLVLDVEKKQLGFTTFLNAVGLSCSNFNFTLAG

SEQ ID NO: 645 - protein, 239 aa, Sorghum bicolor
MHLKSSTTPHAKKLKSNRPTSHSIEMTLPRRRHLVLLAGLLVLVVVAATATASTDSSSTTAVAVDFVRRSCRSTEYPRVCETTLVPCAASVGRSPRRLARAALVVGADRARNCSAYIHGSRSGSGGAMKDCAELARDAEDRLRQSAAEMERMGRAGTPRFAWSLSNVQTWASAALTDTSTCLDSLAQHKDRGRGGKGSDGDDDAVRVKRRVVAVAQATSNALALVNRLQPATHRQRLLL

SEQ ID NO: 646 - protein, 373 aa, Sorghum bicolor
MAARAHHLLLRLALLCACACAAALGSANAAGRKMVGVYELKAGDFSVSVTNWGATITSVVLPDSKGNLADVVLGYDTIGGYVSGKSYFGALVGRVANRIAYARFVLDGKAYHLFKNDGNNTLHGGHRGFSQVIWTVKEFVAGGDSPYITLYYHSFDGEQGFPGDLDVYVTYELASPYELRVHMNATAANKATPVNLAQHTYWNLGGEGSGDVLHNTVQLFASRYTPVDSALIPTGVVAPVAGTPYDFLAPTPVGARIRQVSGGKAGIYGYDTNYAVDGDDAGAGAALRKVAVVRDGKSGRAMELWANQPGVQFYTGNFLQDVEGKGGKVYGQYGALCLETQGFPDAVNHPSFPSQIVRPGQVYKHDMVFKFSF

SEQ ID NO: 647 - protein, 761 aa, Sorghum bicolor
MSSSSPPRRPQRRAASTRPPSYDESLLDAELEGLLGDAASRRVRRLRRLSAEERQRETETEALIALSLGFPIDELLPEERPLLPPHIANAPNDYIVVRNHILASWRADPRAPLPLGCVLETVASSYDRLVAAAYGYLARAGHINFGVSAAFPAAPPPDAATQGAAAVLVVGAGLAGLAAARQLLRFGLRVLVLEGRSRPGGRVYTARLGEDKAAVELGGSVITGIHANPLGVLARQLGLPLHKVRDRCPLYYPDGRIVETRLDRTIDLVFNTLLDHATKVRESLNEAAERISLEEAIEKLRRLYHVARTDEEQMVLNWHFANLEFSNAGCLSELSLAHWDQDDPYEMGGDHCFLAGGNSRLIHALCDGVPVLYEKKVSRIEYGVDGVSVTVEEGQIFQADMVLCTVPLGVLKSGSIVFDPELPQEKLGAIQRLGFGLLDKVAMVFPHVFWDENIDTFGCLNKDSSKRGEFFLFYSYHTVSGGAVLIALVAGEAALEFEKVDPIVSLHRVLGILKGIYGPKGVTVPDPIQSVCTRWGSDPFCSGSYSHVRVGSSGADYDILAESVNDRLFFAGEATNRAYPATMHGALLSGLREASKIHRASESLVNSDQKKNSLPKRLKPPNGALLDLFLEPDLEFGRFSFVFSSLTPDDPEATGILRFSLDKRFFLQPNNPELDGDQKDYSSASGAFHLYATVSREQADQLQKSSEDDRTRLGVLCKDFSVKLMGYDNTCDVGSDLISSILSARKARKLLQHPKNFKISR

SEQ ID NO: 648 - protein, 753 aa, Sorghum bicolor
MWRLKVAEGGGPWLKSCNNFRGRVVWEFDPELGTPEERAEVERVRREFTERRFEKRESSDLLLRMQYAKHKHLQVDPPPTKLAENVEVTEEIILAALRRALDQHSSLQAEDGCWPADYSGILFIMPLLVFALYTTGSLDTVLSKEHRREICRYIYNHQNEDGGWGKQVLGPSTMFGSCLNYVALRLIGEKPTNAALTKGRQWILSHGSAAAIPQWGKIWFSVMGLYDWSGNNPIVPELWLVPHFLPIHPGRFWVFCRMVYLPMAYLFGRKFIGTITPTILELRDELYSVPYSEVDWEKARDTCAKVDLIYPRTMAQNLVWTCLNKVIEPMLNCWPVNKLRDIALKNIMKHIHYEDETSKYICTCPINKALDMICCWAENPNSDSFKKHLPRIYDMLWIAEDGMKAQVYDGNPTWETSFIVQAYCSTGLVNEIGSTLRKAHEFIKSSQICENHPDYKTYYRHKSKGSWTLSTADNGWSVSDCTAEAVKALMLLSKISPDLVGEPIEGQSLYNAVDCLLSYVNNDGTFSTYECKRTTPLLEVLNPSESFINIVVDYPSVECTSSVLQALIMFRDLDHGYRKEEIGNCIESATKFIEKEQRKDGSWFGSWGVCFTYGSFFAIKGLAASGRTYKNSDTIRKACNFLLSKQLHTGGWGESYLSSETEEYVDASRPHAVNTAWAMLALVYGGQVERDPTPLYKAAKVLINMQLESGDFPQQEHVGCFNSSLYFNYGNYRNLYPIWALGEFRQRLLARKK

SEQ ID NO: 649 - protein, 199 aa, Sorghum bicolor
MATLTMQPIGPTPAPAAQEDQRNGENLPTVDATDLSDIDSGWVILKNSDIVSADLAAAAVSGGQRLGSSTIPSWARWVLGGVVYTVVPFYNRVRHLEDETVGFVENAVEVVEHIAEVTEKLAANVAKQLPEDGSLQKAAEDVEHIAEVVDDDAEKFEAVAEKIDKVCDEIDAAVEPVIEELEKELDQSTTSEKGVDTKN

SEQ ID NO: 650 - protein, 136 aa, Sorghum bicolor
MAALAVTTTATTSSRQVEEAPAGRMSSIEWEPKTLTLDQIKFAREAALYVVSTKTEEEAIRIFTEGLKPVQMTTATVRKSSSIDSSSDDDVELGCCCCCSSAGSNKGCCGGGSKGGRRGRRRRSMDDDRDVATAPF

SEQ ID NO: 651 - protein, 523 aa, Sorghum bicolor
MSRRAPFSNLDPATAADTRRQRYDQHEQDGYMEHLLPYIHSCVPDPPVSTTARLVARRTGPSDGVDRISSLSDTLLRDIVSRLPFKDAARTAVLATRWRGLWLAAPLVVADAHLLNHWPPTPADAAPVTAAVSHALATHPGPFRCVHLVSTRMDAYQPQLKRWLRLLAAKGVQELVLVNRPCPREVPLPDTLFRIATLTRLYIGVWKFPDAAHLQGASFANLRELGIFSVVVEDGDIDSVVARSPVLEILNIQGTIKGLRLVGNSLRCVQICASVVENIAVVHTPCLERLILWDVRGSPNPASGLCTRIKIGKAPKLRILGYLEPGKHVLEIGGTTIMAGIKPSASTMLRTVKVLSIKSCFGSNDTKMLPDFLKCFPNVEALHVISVKCNEPGDKLNTKFWQEAGPIVSVLMRIKVMTVREFRGEQHELAFLQYFYENARVLKYASVVAANARVTGISDKQMFSILQNMNDARWASKFGLAIMGSNGPEGGRPWMFERGSNFSDDDPFAPVKFLEHGPASAPR

SEQ ID NO: 652 - protein, 399 aa, Sorghum bicolor
MMMMGEGAYAPPWQQSPAASMDADEAASPYALLAALQHYLPSNEVSAAAAPYDEDDEEAALAAGVDAYACDEFRMYEFKVRRCSRGRSHDWTDCPYAHPGEKARRRDPRRYHYSGAACPDFRKGGCKRGDACEYAHGVFECWLHPSRYRTQPCKDGTGCRRRVCFFAHTPDQLRVLPQQQQSSPRGASAASPLAESYDGSPLRRQAFESYLTKSGMIMSSSPTSTLVSPPRSPPSESSPPMSPDALRRGSWPGVGSPVNEVLASLRQLRLGAGGGSPRSAPSSGSSFLAGGSGGGYPFGSPKSPAAGLYSLPSTPTCRPSPVTVTTASGATIMTVDRLNLGLIGDEEEPVMERVESGRALREKVFERLSKEATVPNDTAASANVEGAAPDVGWVSDLIN

SEQ ID NO: 653 - protein, 473 aa, Sorghum bicolor
MARFILSLMELGVSATVHMLFGLYVFSTAVAADISQAAAASGCLLLRRPWAPPEGAPLVDVAAAGESDDRRGAAPVILHASPPPIVLVHGIFGFGKGRLGGLSYFAGAEKKDDRVLVPDLGSLTSIHDRARELFYYLKGGQVDYGEEHSKACGHSRFGRIYHTGHYPAWDEHNPVHFVGHSAGAQVVRVLHQMLADKAFPGHDTSEDWVLSLTSLSGALNGTTRTYYDGMLVEDGRSMKYICLLQLCRLGVIVYDWLDIPWLKNYYNFGFDHYEMSRRKVGFSGLINLLVGHTGPFASGDWILPDLTIQGSMKLNSRLRTFPNTFYFSYATKKTRKLFGITVPSSVLGVHPMLFLRVLQMCMWRHPQSAPLPYKGYRDEDWEDNDGALNTISMTHPRIPIEHPHRLVVDDSDCHPLQPGIWYYKIIEADHILFIVNRERAGVQFDLLYDGIFQRCRKHAFRKSPPTVPNETSQ

SEQ ID NO: 654 - protein, 340 aa, Sorghum bicolor
MAPPLLSPPVLADALATPPRSFPCSLPTRRLPTVGFAGAVRSDLQQSWSARRRDLRVCATATEADHEREEDVADDYYSVLGVMPDATPEEIKKAYYGCMKECHPDLSGNDPDVTNFCMFINEVYSVLSDPAQRAVYDEIHGYTATAINPFFDDSAPKDHVFVDEFTCIGCKNCANICPGVFEIEEDFGRSRVYSQSGSTELIQDAIDSCPVDCIHWTSAAQLSLLENEMRRVERVNVGLMLAGMGASVDVFRMASARWEKRQAKVLGKVRTRMVKQENSDTRSSWSDIWGSPPQDQSNEEEVSERAKRAAAAARRWREFSRRGADRPPTHKLPESVGSKD

SEQ ID NO: 655 - protein, 104 aa, Unknown
  Sequence found in Organisms: Sorghum bicolor, Triticum aestivum
MAAASRASLVLFLVVATSAVVASMLAVAPGAGAATTACVPTQLTPCAPAIVGNAAPTAACCARLKAHPASCFCQYKKNPNMQRYVNSPNGKKVFAACKVPLPKC

SEQ ID NO: 656 - protein, 399 aa, Sorghum bicolor
MDGYMRETSAARDEGGPAVCKAVAGGNVDRKGGASARRRRRLELRRLGRATEGSPVPAKRIRSGSHRSSSSDSSLETAAAGCWPPRLSHGAVSVIGRRREMEDAFAIALSFLASDPSSPGAKDEQEQDFFAVYDGHGGARVAEACRERMHVVLAEELGLRRGVGSDDLRWEEAMAASFARVDGEVTGGFSPPPKPPPQQTAADAADTNAGAGNLPYRTVGSTAVVAVVGQRRIVVANCGDSRAVLSRGGVAVPLSTDHKPDRPDEMQRVEAAGGRVINWNGYRVLGVLATSRSIGDYYLKPYVSAEPEVTVVERTEQDEFLILASDGLWDVVSNEMACKIARNCLNGRAASKFPGSVAGRTAADAAALLTELAMSRGSRDNISVVVVELQRLKTSPGAA

SEQ ID NO: 657 - protein, 486 aa, Sorghum bicolor
MVVLPILFLLLGCPTSRAADEELELTVVDVSLLQEPRASCSGHRVMPPHPYNNSWVPLFRPLGPCSPSFKGAAAAAARTKPSLADVLRQDRLRVHHIHRRVSGSSRGARASKGSFKEPVSVEETQLHHQAAISVEVGTSQTSSEPSSGIHPAAATDGSSSPPVTVVLDTAGDVPWMRCVPCTFAQCADYDPTRSSTYSAFPCNSSACKQLGRYANGCDANGQCQYMVVTAGDSFTTSGTYSSDVLTINSGDRVEGFRFGCSQNEQGSFENQADGIMALGRGVQSLMAQTSSTYGDAFSYCLPPTETTKGFFQIGVPIGASYRFVTTPMLKERGGASAAAATLYRALLLAITVDGKELNVPAEVFAAGTVMDSRTIITRLPVTAYGALRAAFRNRMRYRVAPPQEELDTCYDLTGVRYPRLPRIALVFDGNAVVEMDRSGILLNGCLAFASNDDDSSPSILGNVQQQTIQVLHDVGGGRIGFRSAAC

SEQ ID NO: 658 - protein, 472 aa, Sorghum bicolor
MAPAASSPPPHVAVVAFPFSSHAAVMLSFARALAAAAAPFGATLSFLSTASSLAHLRKASGGAGGSAGNGLPMNLRFVEVPDGAPVAAAGETVPVPRQMQLFMAAAEAGGVKAGLEAARVAAGGARVSCVVGDAFVWPAADAAASAGAPWVPVWTAASCALLAHLRTDALREDVGDQAAKMADELLISHPGLARYRVRDLPDGVVSGDFNYVINLLLHRMGQRLPRSAAAVALNAFPGLDPPEVTAALAEILPNCLPFGPYHLLLPKDDGVDTADPHGCLAWLDRHPARGVAYVSFGTVASPRPDELRELAAGLESSGSPFLWSLREDSWPLLPPGFLDRIASAGSGLVVPWAPQVAVLRHPSVGAFVTHAGWASVLEGVSSGVPMACRPFFGDQRMNARSVAHVWGFGAAFEAGMTRDGVAAAVEELLRGEEGARMRARAQELQAAVADAFGPGGACRKNFDKFVQIVCRA

SEQ ID NO: 659 - protein, 4093 aa, Sorghum bicolor
MASSQHASSQMASSQHVEMEAAKLLHKLIQESKDEPAKLATKLYVICQHMKLSGKEQSLPYQVISRAMETVVNQHGIDMDALRSSRIPFAGGPQAGDSSGAMSKDKEVIGNQSPMVGSDASQTSGQAGLWQLPSGSTDMTRHGTSISGRLPTGPNRGDFSAAEIHQASMSQKSGRSSGIESPASLQMEDTRSMNSHDSLKSDEKTSKKTSSKRKRMDSKGAGDLHSEDNSKSDAMSTGPNTRKGKQVGKAGRQGQPSMGIEHEQPHILQGGTAQVPPIHGGAPFLRTHPEGPSGRTMDKTKPSNPFSMAQIPSFPEGLASSGATIELQKSIQGGANLFNPSFGWNQNPQVPTLKNSQGSIPNLVRSGVTIEGKINVGAQGAFNSTSAPQMEFPTIPPYNPSSFGVSSQFLDKGKELASSSTGAELHSTSKVASQPGIPHGSPMQERQGIIRVPQRADPSSLPSRSTGPSPMSHTSSNTPFKEQQLKQLRAQCLVFLAFRNNLQPRRVHLEIALGRGPPAESDSAGQRGSEGRVSDALGKENGSSRENSGVFCRQTDISRLPSTSAGSIAEVDSLLKDPENATKKIKVAEQEKSLMEVENIQQASASSGMRSQETASQNPSGPQQSYFQGDTRRIASDIHRTDAENLSRNLSWGGQGSTVLGGTRQHLNQETKESLPPSKSHHMPGDGFNSNIPGIDRTPETAGAGNDVENCSHVVDIVPEQAADDGDEDLPEHEDLLSSPPKHTMTEKWILDYQKRIYNERQKRASEQHKLHSRMSASYEKLKESVNSSEDLSAKTKSVIELKKLQLLPLQRRVRSEFLLDFFKPNTTDLERIKSLKKHRHGRRVKQLEKIEQKMKEERQKRIRERQKEFFADIEAHREKLEDNFKAKRERLKGFNRYAKEFHKRKERIHREKLDRIQREKINLLKNNDVEGYLRMVQDAKSDRVKQLLRETEKYLQKLGNKLQNAKSTDGRSSFVTDKSDAANDIEDESYQPQHYLESNEKYYQLAHSVKETVNDQPSYLQGGKLREYQMNGLRWLVSLYNNNLNGILADEMGLGKTVQVISLLCYLMETKNDRGPFLVVVPSSVLPGWESELSFWAPSINKIAYSGPPEERRKMFKEMIVHQKFNVLLTTYEYLMNKHDRPKLSKIQWHYIIIDEGHRIKNASCKLNADLKLYRSSHRLLLTGTPLQNNLEELWALLNFLLPNIFNSSEDFSQWFNKPFESNGDNSPDEALLSEEENLLIINRLHQVLRPFVLRRLKHKVENELPEKIERLVRCEPSAYQKLLMTRVEENLGGIGAVKVRSVHNSVMELRNICNHPYLSQLHVEEIEGYLPKHFLPSIVRLCGKLEMLDRLLPKLKATGHRVLLFSTMTRLLDVMEDYLVWKKYKYLRLDGHTSGQERGALIDKFNDPNSQAFIFLLSIRAGGVGVNLQAADTVIIFDTDWNPQVDLQAQARAHRIGQKKEVLVLRLETVRTVEEQVRASAEHKLGVANQSITAGFFDNNTSAEDRREYLESLLRECKKEEAAPVLDDDALNDILARSEAEIDIFESIDKQRREEEMAIWQKVVQDGSTSGLDPAVLPSRLVTDDDLKPFCHAMKLYEPSSNVKTVKVNVRKKGELGGLDTQHYGRGKRAREVRSYEDQWTEEEFEKLCQVDSPESPQPGGMSKDLDIPNKGIKTEIAVESSKEPEQMRMEASPTVGDSPPAKRRRGRPKRSDVFLSPTADLTDAVKQDTGTTQDGSLATPASTFHSDTPATPIHSAASDVNIHSISPADIKKQEFSTDTKPSSSVSVLEGSTANEIGTPLQSVHNVAAPAPPHQSARGRKSQAGETPRRRGRKPKSLSSSGVDDVSLNPTVSTGSGVADTSYVSSYSHVNMPSSQGTAVALAGIQKDLVTVKLDTLLPDSGKNISPVNEDKGATVTTPVAKDICAGTVTTSDNTITLTPNTLKENIGLVQVASAPTMPMPVASEELLKTAAHVVVADKPVEKQTASRRRRKKTSSSEDTGVSTRQRSAMKKSYYSTSVAIDEVGSAMTPNEKSGIEKERDVSSIQDTPNQLPNINSPLYEKSGYDSQPSTPIAVPINEATLPSGFDTRTTHSKITLATSANPADHDKPVDLHLNAPVSVDSQNHEQLKTGKDHLAVSSGIFSTQLQTVTANPTSDNKPGTTQFEPSASSVQNSGKDATALTSSEVDSAAPNKAPSRRRKGSTREPRTRRTSAAAASERRARLTGSKQAEDTKKLKMSATPTTTVCVLAVEQQGAASLRAEVTNASVCEEQKNPGSHVSSDISIPVGSHVLGAISTEETTATVITQTPAVAKSEERKLPVGDQQGIQFDSTVPQTKMVSNDESMQGTEVNNSEQTKIVSAAEPAPANDEHMQGTEVSNSEQTKMVSAAEPAPANDEHTQAIEVGSSEQPTSMVSAVESAPSNDEEHTTHEVYLETAADDMLTSSAATDILRDTVEHAARQANAACTDGTTRQSEASQLDSKASHDASYKDTTTTVSTKDDSKASRDASYILPSEGTAVDVTGSKQDDVNIVGTQTADASRGSSSHFQATLQSTESDWHPGQEENLESRKEQVKTEEALDNSSGGNQTHSLGDEPSHDTSLARNSPLEYSNERCSAQVIGETFKSKENIVEVHSAMNTDGPDEALDALYVQSKEASITDSGVATDVDKFEGKETSVEVRDDMNTDGPEDAQDALSTQSDKEASMVEFGVSNDGSPTVCKAHNDLEGHVSCEDRTGGDIHTNANYGSNNKSEDTIVNPVKTTREPLEESTVIVSENSDLNKQSHTLHTGNDPPASTLLIVESNKVTCDAEIVCASRLESSCIEAETVAIQESAVTDFEGTKGTGDLGHKTGSPLCDDVHDTSCSVIGLVCEKEPTEDLTDGSHSEAPNLLAAVVQTRETTVANQEEIIDAVVFIDACKAEPDGDCTVAKGAEETVEMVHSVEKQSAVLEHVERQTKQTTICGSVLNESPQAAGLEEDCSVLKHGGPTASSELLAVAPNPISETSVIQAEPEATNSDGYCTTEVGSALSETVRGLEPNKETAVPMQEDIEEANDTSNNCEAHNNSGIHAFGEVLMEMQSSEVKEVSFIQSGAANLSTQTPVLPDETGQTNVASTAELVPTNDDEHMQGTDVNSEQQTKMVSPAESAPGNDEHMQDITVLSSELQTKMVSAAEIDALCVQETAIVDLGGTRGTVDLNDISTQVPALPGSDVLGVEAHNSEPKKASSPGDEIISSEQQAEIETIAETETVSVKENAIADHEETGDQSGVSIHAPLLAESGEKGSHGVELCGIEIEANNSEQGKMVSTVEAASTPDDLGRHTHEVHVTGDGAILSSAEQDTLQDNISSGADVDLTTSQRKTDSEGIKDPSIGTNIEEIQGPYETSNKDHFTDPPATTLVIAESDKDTCDAEVVCAGKLESSGADAVGTVAVQEVPAVAGDRAGGIGVEGHCSEQVKMASVAEAASSLALVGYSSSEDSMVDAAARVADGDFADSKGAGVDCQETMPTQATSTLPENMDWQNDSLAAAAVTVEPMFASSSEHAAESKPIDETSVMQVELATSTGDECAAEGDNVVSSETVVESEPVQETVVPSQGGSIEANNTSTISEVNKDTESRASGEVCKDAQSHGGESYTELQLAPSSGEEAMILCSELPSQEVKEAPSSEPLGYNENVKTENDSSSQEPVNEESAPGAENAKIDEADTEQQLPPGQQVKEAPSNPLGNNENVKMENEASAQGPVNEESAPRAENVKIDEADTEQLPPSGEAMVDISSELLSHDEKVAPSTVPLGNDEDAHMEEASAAQRELSTEVAHGSENAKLSEAGTSGEAMVDVSSELLSQDEKVAPSTGPLGNDEDAQMEEAAAAQRELSTEVDHGSENVKLGEAGTELQLPPPSSGEALVDISREQLSQEVQEVASSGPSGTDENTEMERLNTKHSPGGETSKLVGADPGIQLPPSGEAVVDISNEPPSCQEVKEAPSSDSLGNDENSDTEKTAAALQGRLNTELAPSGENTESNEADTGKQETPVSADAMVESSSEPPSDEAKEAPTTDLSGDDEKAKSARAAVVAELFGDATEGGSDQPLPSPREQGKEAEADGDL

SEQ ID NO: 660 - protein, 445 aa, Sorghum bicolor
MGRRLSASTAAVASAEPLLPRALKRGVLLERCASRADDELQWFRSCLRWVCMDHSSGPAQAALSWLLFLVLAIIVPAAAHFLLAFRASRRPFSAVVQLSLSAASAAGFLCLSSSFRRVGLRRLLHLDKLRGKSDRVRLNYTARLAFSFRLLASLVAPCFAAEAAYKAWWYATSADRVPFFANDVLSDVLACSLEMASWMYRSAVYLLTCVLFRLICHLQGLRLEDFAGSLLEEVEEGRAGVETVLREHLDIRKQLKVISHRFRKFIVAALLIATASQFASVLLTTRRDSVDDLLNTGELALCSVVLMSGLIIILSSAAKITHQAQALTGHTTKWHACCTIEPVLEDGEPGSNQNSMIEQEPESDSDTEYSEETGDEDLLENTKIHMPHAHVISFQKRQALVTYLENNRAGITVFGFTLDRSYLHTIFMLEWTLFLWLLGKTIGFS

SEQ ID NO: 661 - protein, 170 aa, Sorghum bicolor
MAVGGGVCVASPSSSPSSSVEAPWGTRRTRTTTTTSGARRGAAAAATSVRCSIVGEAGGPGASGRLAEDPYRTLRLRPGATRGEVKKAFRRLALMYHPDVRKEKGRESDGVSDVQFQRINVAYQMVMSSMREADERLEYWRLKYGLTDEDLDRYRHHLNQEHGDDDWFDM

SEQ ID NO: 662 - protein, 449 aa, Sorghum bicolor
MASSLPPFTVRRGEPVLVRPSAPTPRETKPLSDIDDAEGMRFYSSGIHLYRANPSKASQDPARVVREALATALVPYYPLAGRLREEPGRKLVVDCAAQGVLFAEADADLTADDFGDVKCPPFPCFERFILESTTVAGVEPVVDRPLLYVQVTRLKCGGFIFGQRICHCVVDAPGAMQFEKAICEFARGATEAPSVTPAWGREMFMARQPPRPSYPHLEYREPACGAEPDRMMTTPPGDMARVPFFFGPREIAGLRQRAPPGMRCSRFELVAACIWRSRAAALEYAPEEEVRLSFIVNARGRREIPLPEGFYGNAFAYSVAAITAGELCGGDLGFALDLVKKAKSAVTYDYLVSVADLMVLTGRPLFALSRTYIVSDVSHAGFKSVDFGWGEAVYGGPAKGGEGPLPGVTNYFSRAKNGKGEECIVVPICLPKDAMEKFLLEVEGLTAEL

SEQ ID NO: 663 - protein, 338 aa, Helianthus annuus
MARVPRVKLGSQGLEVSAQGLGCMSMSAFYGPPKPEPDMINLIHHAVNSGVTFLDTSDYYGPKTNEILLGKALKGGMRDKVELATKYGIKLSGSWEVKGDPAYVRAACEASLKRLDVDCIDLYYQHRIDTRVPIEITMGELKKLVEEGKIKYVGLSEASASTIRRAHSVHPITAIQLEWSLWSRDVEEDIIPTCRELGIGIVAYSPLGRGFFASGSKMMEKLEDGDYRPNFPRFQPENLEHNKILYERVSEIASKKGCTTSQLALAWVHHQGNDVVPIPGTTKIENLEQNIGALSVKITPEEMAELESTTHLVKGARCNAGTPTYLDSETLPLSSWKS

SEQ ID NO: 664 - protein, 135 aa, Helianthus annuus
MPESKKVVIKVDIHDNECKRKALKAVSGLSGIESVAMDNDNKMTIVGGVDPVCVVKKLKKWHAVILNVGPAKEDKKKEPEKKKENEDDAAKKKKEEEEEAIKRWIEFHSYRGFTPLPPQRICLHPVEDPNGCVIM

SEQ ID NO: 665 - protein, 160 aa, Helianthus annuus
MEFSLMGLDTPFFRNLQHILESTDDNTTGNKSNNGGPSRAYVRDARAMAATPADVKEYPNSYAFIVDMPGLKSGDIKVQVEDDNVLVISGERNREEEKEGAKYVRMERRIGKFMRKFALPENANTDKISAVCQDGVLTVTVEKLPPPEPKKPKTIQVQVA

SEQ ID NO: 666 - protein, 81 aa, Helianthus annuus
MSSSCCGGNCGCGSGCKCGNGCGGCKMYQEMVSGESTNNETLILGVAPTETGIETTGGVATAAENEGCKCNPCTCNPCTCK

SEQ ID NO: 667 - protein, 153 aa, Helianthus annuus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDAGKVQRLRKECPNAECGAGTFMANHFDRHYCGKCGLTYVYQKA

SEQ ID NO: 668 - protein, 359 aa, Solanum lycopersicum
MAKSFENEHPIKAFGWATRDTSGVLSPFNFSRRVTGEKDVQFKVMYCGICHSDLHQLKNEWGNSKYPMVPGHEVVGVVTEVGSKVEKFKVGDKVGVGCMVGSCRKCENCSVDLENYCPRQIPTYNGYSLDGTLTFGGYSDVMVSDEHFVVRWPENLSMDAAPLLCAGITTYSPLKYFGLDKPGMHIGVVGLGGLGHMAVKFAKAFGTKVTVISTSANKKKEAIERLGADSFLISRDPEQMKAAMNTLDGIIDTVSVVHPILPLLMLMKSHGKLVMVGAPEKPVELPVFPLLMGRKLVAGSCIGGMKETQEMLDFAAKHNITPDIEVVPMEYVNTALERLLKSDVKYRFVLDIGNTLNKK

SEQ ID NO: 669 - protein, 566 aa, Gossypium hirsutum
MEMRDIDDLPKNAVNYMALTPLWFLERAATVHPTRKAVIHGSRTYTWLQTYQRCRRLASALSKSSIGVGSSVAIIAPNIPALYEAHFGIPMSGAVVNTINIRLNASTIAFLLGHSQSTVVIVDQEFFNLAEDALRIMKEKSQGNFTPPLVIVIADESCNPETLKYALGQGAIEYEKFLESGDPDFAWKPPQDEWQSIALGYTSGTTASPKGVVLHHRGAYLMALSNPIIWEMNEGAVYLWTLPMFHCNGWCFPWTLAAVCGTNICLRQVTAKGVYSAIAKYRVTHFCAAPVVLNSIVNAPPEETILPLPHVVRVMTAGAAPPPSVLAGMSQKGFRVTHTYGLSETYGPSTVCAWKPEWDSLPPETQARLNARQGVRYVGLECLDVISTQTGQPVPADGKTIGEIVFRGNIVMKGYLKNPKANEETFANGWFHSGDLGVKNPDGYIEIKDRSKDIIISGGENISSVEVENSLYLHPAVMEASVVARADERWGESPCAFVTLKPGVDKSDEQRLAEDIMKFCRSKMPAYWVPKSVIFGPLPKTATGKIQKHVLRAKAKELGPVRMSKL

SEQ ID NO: 670 - protein, 269 aa, Hordeum vulgare
MARCSNGLLGLLNAGVLVLALAVLGGGIWLSHRAATTDCERFLERPVIALGALLLALSLAGLAGSLCGASCLLWLYLVALFILIALLLVFTAFAFVVTNRGAGSVVSGRGYKEYRLGEYSTWLQRRVEDSENWARIRSCLRDGSVCQRFGARGESLQQFVTNNLSPIQSGCCKPPTGCNFTYQSETMWVKPSGFNATNDPDCNTWSNDQRALCYDCQSCKAGVLANLKNDWKKIATVNIVFLIFLIIVYSVGCCAFRNNRRDNSYPAWK

SEQ ID NO: 671 - protein, 195 aa, Oryza sativa
MQLMAARKLLEQPGTAAPPVLGGSIADDRDIVIILASLLCALICVLGIGLVARCACSRRGGGGPDAAAANKGVKKSVLRAIPTVEYVSPGGGGKGKEEEEAAAEEGEQSECAICLSDFEHGDAMRVLPQCGHAFHAACIDKWLRGHSSCPSCRRILVLQLPQGERCQRCGARPEPAAASAVWKPTHYSEVPPFLP

SEQ ID NO: 672 - protein, 372 aa, Sorghum bicolor
MRRRRMGALHVVGEPRVVSFQQQPAAVVAKNGHGPVVEEIHGLIRVYKDGHVERLPAIPTVPCTWGGTGADAPGGVVARDVVVDPATGVWARLYAPMTTTTSAGGGTGGSRPPVVVYFHGGGFCVGSAAWSCYHEFLAQLSARAGCAVMSVDYRLAPEHRLPAAFDDGLAAVRWLRHQASRAAACDDLSWWRARCGFDRVFLMGDSAGASIAFHVAARLGQGHLGALSPLTVRGAVLIQPFFGGEARTVSEKSMAQPPRSALTLATSDCYWRLALPAGASSRDHPWCNPLSRAAPRLETVPLPPVLVCVSETDILRDRNLELCRAMRKAGKCVEQAMYGGVGHAFQVLHNCHLSQPRTQEMLAHIKAFVSAR

SEQ ID NO: 673 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 674 - protein, 512 aa, Sorghum bicolor
MAAAAAAAVAHLSVHGRLRRSPEHRPSTSSSSAPAHRPSLLRCRAFKQETDGGGGDRDSDPSEPDARKRRKGPLYKLKAAIQGLAGSRSAAAEVYGGEHQYQRAVEKAEEIFFSVATQLGRYAITMMSSGVVLGVGFQLSGGDSQMNELIWYSWLGGVIIGTMIGANSVLEEHCKAGPRNVVITGSTRGLGKALAREFLLSGDHVVITSRSPESVLQTITELEENIQEGLSVAKKKERKILSHAKVVGTACDVCKPEDVKKLVNFAINELGSVDIWINNAGTNKGFRPLVTFSDDDITQIVSTNLVGSLLCTREAMNVMQYQEKGGHIFNMDGAGSGGSSTPLTAVYGSTKCGLRQFQGSLLKESRRSKVGVHTASPGMVLTDLLLSGSSIRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 675 - protein, 330 aa, Sorghum bicolor
MVVLANPPVVDQIPLLRSPGPRDTFSGVPVVDLSSPAAARAIVDACERFGFFKVVNHGVPAATMGRAESEAVRFFAQAQADKDRAGPAYPFGYGSKRIGLNGDMGWLEYLLLAVDSASLSDACPVPSTAAFRSALNEYVAAVRKVAVRVLEAMAEGLGIADAAALSSMVTGAGGDQVFRVNHYPPCPALQGLGCSATGFGEHTDPQLISVLRSNGTSGLQIALRDGAQWVSVPSDRDAFFVNVGDSLQVLTNGRFKSVKHRVVTNSLKSRVSFIYFAGPALEQRIVPLPELLAEGEESLYKEFTWGEYKKAAYKTRLGDNRLAQFEKRSI

SEQ ID NO: 676 - protein, 199 aa, Gossypium hirsutum
MDSFLLESPNSISSSESSFGSPEFSPFNHNSLPFNENDSEEMLLYGLLTEVKTETSSSTEKGSPTKEKCYRGVRRRPWGKFAAEIRDSTRHGTRVWLGTFESAEAAALAYDQAAFAMRGSAAILNFPVERVRESLEEMKCNQEEGCSPVVALKRTHSMRRKRTSRSKKERDARINNVMVIEDLGADYLEQLLTQTATPY

SEQ ID NO: 677 - protein, 113 aa, Hordeum vulgare
LAMLEHLLECDHHIINLNLQVRFAFELESMIGDAKAISLFKSRIENLKRASEDLLADNGDDASFTEVGSEKSFPAKEIRFLTDTLLGALEHKLEDLEQANINPSFRGKCWSRP

SEQ ID NO: 678 - protein, 141 aa, Hordeum vulgare
PESSLRPVIGRNSHILKQQKINLLDIDAALPEEAWRASKSQQIRRRSWRAFVKHAESISEMVLATSVLESMIKSEFLKNDWWYWSSFTVAMKTSTVSSLALRIYTLDDCIMYTKEPNTMPADSTKVVNKGKRRKEPEPSGS

SEQ ID NO: 679 - protein, 95 aa, Sorghum bicolor
SDPESGVDVERLQQATPRERIENAAQGALTLLVLGQFHEPDAHFSRGYAAIVRRVKLQRQAARLMEPAGRNIPSQQEAFVVAEEALALVLLVTTD

SEQ ID NO: 680 - protein, 333 aa, Hordeum vulgare
EKSCAVSFWVDSQARENAAADDGAVPLYDREFTLGSTPMGDSSNAEGKKDKDDSRCFNCGSYSHALKDCPKPRDHVAISNARKQHNLKRNLSNASNRGQNRYYQKTPGKFDDLKAGVLGSETRECLGLRENDPPPWLHRMRELGYPPGYLDEVEDEDKPSGITIFGGEGEANAEQQQQQHEEGELPEKDEPSPPRKRMTVEFPGINAPVPENGDPWLWGSAPPPPLQSSSSGRHQHPSSDSQRDRGPPPPPGVEQYSSSRYHSYDYGPATPGTGRRSSSGYDDGGAFTPHSAYSSRQHSGSGSRERERERERERERERERERHDRHYYSSNRR

SEQ ID NO: 681 - protein, 20 aa, Hordeum vulgare
RLPQNGWPVSSPRSEQVKVD

SEQ ID NO: 682 - protein, 33 aa, Hordeum vulgare
HHHKHGVGIVAAPPPATGAGGYYPPPAAGGHYY

SEQ ID NO: 683 - protein, 121 aa, Helianthus annuus
YIFQLLGTPSESDLGFIKNEDAIRFIGLLPRHPRKSLQDTFPHVHPLAIDLVEKMLTFDPAKRITVEEALAHPYLERLHDVEDEPICPNPFSFDFEQQVLGEEQIKDLIYQEALAHNPEYA

SEQ ID NO: 684 - protein, 379 aa, Hordeum vulgare
RGRLLRARSGHAAAVRCQRVDPVRLRAVNGSPPCVPLSDRSPWTPVTTPIFGDASIRKDDTRLRIFSGTANPSLAQEIASYMGLELGKINIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKNFPQLTILSVANLLGETIWRVHDDCSVGHAPYSTLDID

SEQ ID NO: 685 - protein, 483 aa, Hordeum vulgare
MLSNGQLNSPVCGTVGDEAHDMLLTAVLRKQKMDPSCINNAVQKPQESPLDVQPLQVKKFSVRQKGGETHPIQALEGNSDTFDNIQLKGKSNSSCKEIICALTASTCNAPSPLDKQARATDAVSRGADSSSNTKVFASKKSAEKKGVKGLSGPHSSVHGTRTVQKRSAKKVAGRQKECFMERQVDSRGPHTQQQLNMEEKVGVNDGTNHELFPLIPPGFKLICNGQGLLHGEKVDERPIQLHIQDAGSSQCTMENTALRSCSAVGTSLHPPFLSCQISGERFPFIKTSSIWHHIEPMEVFRKVPQEPHFLPLQQFMPELREGMAIGLMVTYDSLVESVKRSCIEDSIELFERKINALAHLEEHGFDVKLLQHSLMKLLEAKWEHTKHLGHLDELKELVPRKESAMSQKHALLVEKEGAIFQLEQKLEYLRGEAEQIARETKDEDAELLRLKVGVNMAQEACVNVEVRFHDILADMSSRLQLSE

SEQ ID NO: 686 - protein, 519 aa, Hordeum vulgare
SCLAYILGAISNLLSKIGISSTVGLIGSRYSLGNNIGLGTPLSIQQQLLVLLKRSLKRADMLKLTSLLSFDHISLAKFDLKHVQRPLVSFGPNGSTKLRTCPADVCKNLRLSSHVLSDFGTDSLSISNDNGSFSTSWLRNLSDASRSWSNSSAKTRKLIANDFDNFHFHAQPSPIPTSVLQLAGSAHLMRATAWEHYGSAQMVRMNTLVYATCFADAASSSELSLAYVKLIEQLAVFKGCSAAFCALKLAEEKFPSSMNSQIHLLKMQLLHERALHRGHLRIAQQICDEFGVLSSSVSGVDIELKTEASLRRARTLLAAKEFSQAAAVANSLFTTCHKYNMQVENASVLLLLAEIHRKSDNAVLGLPYALASQSFCKSFNLDLLEASATLTLAELWLALGSNHAKRALSLVYQSLPMILGHGGLELRARSQLVLAKCHLTDPEFSVSEDPCAVLDPLNQAAEDLHVLEYHEMATEVYYLKAMAYNHLGKLDEREEAAARFKEHVTTLENPRDEEDSLAY

SEQ ID NO: 687 - protein, 146 aa, Hordeum vulgare
MDMNANYGGFAMALSTDPVWIMNIVPNTTINTLPVIYDRGLIGSYHDWCQPFSTYPRSYDLLHAFHLFSHYQGHAGGCLLEDIMLEIDRIIRPQGFIIIRDENTTLSRISDLAPKFLWDVTTRTLENEENRPEQVLICRKKFWAIV

SEQ ID NO: 688 - protein, 509 aa, Hordeum vulgare
EEFRQLLIRGTASLAADDLHASLLRRLSLTVPTFHSASSVDLECPSFASQPDEGDEAASAAGRWSSVSDGEISPYLISPDTVSTLKDIADVMLRAGYGPELCQVYSEVRRDTLMECLAVLGVDKMSLEEVQRVEWGVLDGKMKKWIQALRVVVQGLLAEERRICGQILAADADAEEECFTEAAKGCVLQLLNFGDAIAIGKRSSEKLFRILGMYEALAELLPELEALFSGDARDFIKEEGEGILVRLGDAVRGTVAEFANAIRGETSRRSLPGGEIHPLTRYVMNYVRLLADYSRWLNHLLDGCETELENGGDNADMTPLGHCLLILITHLLDKIEDKAKLYDDEALQNIFLMNNLWYVVQKIKDSELKTLLGDNWIRKRRGQIRRYSTGYLRSSWTRVLACLRDDGLPHATGSSSALKAALKERFKSFNLAYEELYRTQTAWRVVDPQLREELKISISEKVLPAYRSFVGRFRGQLEGGRNFAKYIKYNPEDVENQVSDFFEGKKLNA

SEQ ID NO: 689 - protein, 201 aa, Hordeum vulgare
GTRLRPAFIEEESYLRSLFHSECNADGYSSEWREEYNREPRPASGTNGLIDGDKLRLDINDAGSSIDSTIYKLEMMTIELFSVYGKQFMIDPQDFQDAEPDLLSNHASDIIKRMEENSDQCTMALRSLCSRKKGLTVEEARLIGVDSLGIDVRAFSGLEARTVRFSFNAQALSERSAEKKIKRMLFPRYRKTVKASAEDEC

SEQ ID NO: 690 - protein, 544 aa, Hordeum vulgare
RHEERIGGGFGGKETRSAIFAAAASVASYCLRRPVKIVLDRDVDMMTTGQRHSFLGKYKVGFTNDGKILALDLEIYNNGGNSLDLSLAVLERAVFHSENVYAIPNIRVSGKVCFTNLPSNTAFRGFGGPQGMLIAENWIHHMATELKRSPEEIKELNFQSEGTEVYYGQLLRNCTMHSVWDELKASCNLLEARKAVNVFNNENRWRKRGIAMVPTKFGISFTAKFMNQAGALVQVYTDGTVLVTHGGVEMGQGLHTKVAQVAASSLDIPLSCVFISETSTDKVPNASPTAASASSDLYGAAVLDACQQIKARMEPIASRGNHMSFAELAQACYMERVDLSAHGFYITPDIGFDWIAGKGSPFNYFTYGAAFAEVEIDTLTGDFHTRTADIVMDLGYSINPAIDIGQIEGAFIQGLGWAAMEELKWGDDNHKWIRPGHLFTCGPGSYKIPSINDIPLNFKVSLLKGVPNPRAIHSSKAVGEPPFFLASAVLFAIKDAIAAARAEEGHLDWFPLDNPATPERIRMACVDSITKKFASVYYRPKLSV

SEQ ID NO: 691 - protein, 110 aa, Hordeum vulgare
GSDLPIIISCASLALADAGIMMYDLVTSVSVSCLGKNVIIDPTSDEEAWQDGGLMVSYMPARKEITQLTLTGEWTDGKITNAVELCMDACSKLCEILRERLKDPASLASE

SEQ ID NO: 692 - protein, 136 aa, Hordeum vulgare
FAKYVPNTIRLVHGHDIVPHLPPYFSFLSKLTYHHFPREVWIDDSDGNTTEQICDASGEDPNCCRCLSILSLSIQDHFTYLGVDMESDDWSTCRIITAQSVERLRKDLASNIIMTKHDADVSIVENSVQTDWSSSR

SEQ ID NO: 693 - protein, 569 aa, Hordeum vulgare
DVAYSCMPYIIDGALSENSSYGGFEHSGIPDGIPQLEEYLAVYCSMSARPWPAANWKFYIAFSLFRGASIYAGVYHRWTMGNASGGERARFAGKAGNVMVDCAWDYINRENVLRAHPATGMHVSKAPQQGFHVEQEDSTLTSGQGKFVPSEKVMKLQHKIMKFMKDHIYPKEDELYKHAQSTSRWTIHPEEENLKALAKEEGLWNLFIPLDSAARARKLLLEDRSYVSAGSSNDLLLGAGLTNLEYGYLCEIMGRSVWAPQIFNCGAPDTGNMEVLLRYGTKEQQKQWLVPLLEGKIRSGFAMTEPQVASSDATNIECSISRQRDFYVINGRKWWTSGAMDPRCKILILMGKTDFSAPKHKQQSMILVDINTPGVQIKRPLLVSGFDDAPHGHAEIIFDNVRVPVTNILLGEGRGFEIAQGRLGPGRLHHCMRLIGAAERGMNMMVERALSRTAFGKKIAQHGSFQSDLAKCRIELEQTRLLVLEAADQLDRHGNKKARGILAMAKVAAPNMALKVLDMAIQVHGAAGVSSDTVLSHLWATARTLRLADGPDEVHLGTIAKLELQRARL

SEQ ID NO: 694 - protein, 164 aa, Hordeum vulgare
MVGGVLLHLRSLRRFEHSGGWIRALMEEAENERMHLMTFMEVTQPLWWERALVLATQGVFFNAYFVGYLVSPKFAHRFVGYLEEEAVHSYTEYLKDLEAGLIENTPAPAIAIDYWRLPADARLKDVVTAVRADEAHHRDANHYASDIHYQGMTLNQTPAPLGYH

SEQ ID NO: 695 - protein, 121 aa, Hordeum vulgare
ADCLSSRGKVSTCPLCKASFSWISKVDEAGTSDQKIYSQTPVPCGASTDIFMFTDEGHDLPGPSSAQGACYMCHSREPEELILSCHVCRSQWVHSYCLDPPLTPWTCIHCRDLRRMYQRYR

SEQ ID NO: 696 - protein, 510 aa, Hordeum vulgare
VWQYKISLVHLYSYLGALPLAHRWYVSLEVKNILLESVSHHILPQMLSSPFLEQTASLVKDYLRFMDDHLKESADLTCLAYRHRTYSKVIEFVQFKNRLQCSMQYLAVKSDSVILSLKQKSESLEEVESVLENVNHGGGLVDLSNEDNMKHLTFNEDLEARPWWTPTTSVNFLSEPIDESSTPACFRAKVCKHKSTEKDGPKMGDAERKCLVPRLVYLSMRGCVSSLRETEHNGSVSDITVGEMKTLLEKYARTIGYSMDDALSMILGISSGKKSMKDFAPDIVSWMSFAVFINAMNLWSNESVIPRTEPSSPSSWEIVDSLVKLCIEEHLTDANRILTCPGNKIPLLVQMVTEPISWHLIIIQSCTRVVAPQGKKKKKSGPSLRTNMPQLQGIQRSVQCLIETLQSVQKWLSDQMSPEEQGLDILLSYFQGTGDEGPGQTFRVLEEKPAAHASELGDRIAQSLEAWSSTSVVRRIVGAEHEVLAEFKKMVDSKLKLLMSESASLSSVLH

SEQ ID NO: 697 - protein, 231 aa, Hordeum vulgare
KKLGELFTKRGVNPLTPLKGLFIQGPIFMSFFFAIQNMVEKVPSLKGGGAYWFTDLTTPDELYILPVLTSATFLATVELNMQEGMEGNPMLQTMKKFSRILALMTIPFTMHFPKAIFCYWVTANLFSLGYGFALRKTAVRYFLNLPEIVPQPAPAEVSTFNLFKAPKPVSAVNTPTGDNGDSSTVVNSDSTTAVNGSEQSNAELSDRVVFLEKKIAELERRAKARGESQEE

SEQ ID NO: 698 - protein, 217 aa, Hordeum vulgare
ARGVIGERCIADAALLLIEMASNNNVKEKLRKLPLLSLRRSPKDCTLIESRILSNGQESVESATQKLEAFKLQLRKPDNASIAENGTEGTFNTSVPEKRNRWSVAKSWTPCPLGMIPCSYSSTAVLPVLDIIDDELEHDTAEHGNFEDDGQIEIADPEKQLDDEGFLEISRSPPEHGISVMPELIHGLKGTLLVGGVWKKVTEEELLSIKSSMKILL

SEQ ID NO: 699 - protein, 76 aa, Hordeum vulgare
RIPLERKRIIHWMEIEKVEGSSNYYLLHLCTQAGTYIKEFVHGDLGRTNPSIGSMLRCRAEILQLDVTDVKMDLLQ

SEQ ID NO: 700 - protein, 162 aa, Hordeum vulgare
KVSSKDPCCIEVALRCLATEGDGFGLHEANDGGLLAAIMAAGFKGELNRFQPGVSMEISRLDAWYSDCHGSVESTAAYIIRGLCRRCCLPETILRSMQASISLSEAGDSLDHCDKLIELVASSDSGMMHLFSQQQLQEFLIFERECFICKMELEEEQMPADG

SEQ ID NO: 701 - protein, 187 aa, Hordeum vulgare
MVQNGDILLNKVFVPEEDRLTGINSFQDISKVLAMSRIMVAWQPIGISMGVYDMCHRYLKERKQFGAPLAAFQINQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 702 - protein, 334 aa, Hordeum vulgare
DKTLKCSNGQGSDKVPAEEISVQQPGVDDSHDLVEQQNRDMDTEISKDKSSEEAKVIASEVQNDQATRRDKRKTQNQGRWRGVDPVIFFKDEATIRSIISYYGIKDSFTLEGHLVTRNPDTNHVKRIYYVSKSVKEVLDLNVKVGERLKITSLGLKIFERQSSKEGSPCTFRLSSEGLPLLLPYITKQILYASAIDFQHLLQYRIIKFPDFVDAKFGEQAAALLQGCCIVILREGHEDLESIGMDPSAIAIVCWKGKTNLCVMVTPMDGRELLERISFRFGLKIPKIDDGKPDLKSDDGSDEQPDGGAETVDPECVPESKAPEDMDITDVKDAE

SEQ ID NO: 703 - protein, 462 aa, Hordeum vulgare
NDYGSNRILHHTIGLPDFSQELRCFQNVTCYQAVVNNLDDAHEQIDTAISTALKESKPVYISISCDLPSIPHPTFSRHPVPFFLSPRLSNQMSLEAAVEAAAAFLNKSAKPVLVAGAKMRVAKARKAFLELADACGYPFAAMPSAKGLVPEHHPRFIGTYWGAVSTPFCAEIVESADAYLFAGPLFNDHSSVGYSLLLNKEKAIFVQPDRVVIGNGPAFGCVLMKDFLRALATRLKKNTAACEIHSRIFVPQGEPRPSQPEEPLRVNVFFNHIQKMLSGNTAVIVETGDSWFNCQKLKLPQGCGYECQLQYGSIGWSVGATLGYAQAAKDKRVISLIGDGSFQVTAQEVSTMLRWGQNNIIFLINNGGYTIEVKIHDGPYNIIKNWNYTGLVEAFHNGEGKCYTAKVRTEEELKEAIEASLGPNKDSLCFIEVIVHMDDTSKELLVWGARLFAANNRPPNPQ

SEQ ID NO: 704 - protein, 152 aa, Hordeum vulgare
FWVRLANNQYTLEKTSLFEYETHFTVMNYNGRMNHMNTPEFVKEFEKEHQVKWLEIHESIRDMIRRVFESTSAVHPEMQNSFCRAIYGVDVMLDNRFKPKILEVTYCPDCTRACQYDTQALVGSQGPIKGSDFFNTVFGCLFLDDLTNVSPL

SEQ ID NO: 705 - protein, 247 aa, Hordeum vulgare
SFALRLGPRFAAPTVASATRGGGGGGGRPTGSRALVSKKPNKDHRLWIRKDSAGSGKKALCLVNTVSKLPNEKEAVYGALDRWTAFEPEFPIIAAAKALEMLKKRRKWLQIIQVTKWLMSKGQVLTWTTYDTLLLALSMDGRVDEAESIWNTILQTYTRSVPKKLFSRMIQIYNTCHLPDKVLEIYADMEELGVRPDEDTTRRIGRAFATSGQEDKQKPVLEKYLKKWKYIHFNGERVRVRRAGPLA

SEQ ID NO: 706 - protein, 68 aa, Hordeum vulgare
RVVDGPAAGSRRRARAGVGAGQVHGDGLLRRPLEPGPPRRVRHGPARLGRLIVLFRRPYRFHTRVVVY

SEQ ID NO: 707 - protein, 329 aa, Hordeum vulgare
ARGISIYGRKKSEWDQMASWIVNNELYSENVVWLIQIPRIYNVYREMGTINSFQNLLDNIFLPLFEVTVDPASHPQLHVFLEQVVGLDLVDDESKPERRPTKHMPTPEQWTNVFNPAYAYYVYYCYANLYTLNKLRDSKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYKRGPDGNDIHQTNVPHIRIEFRHNIWKEEMELIHFGNVNLPEETDR

SEQ ID NO: 708 - protein, 280 aa, Hordeum vulgare
RAAGIRHEVLHEVEQSDRATAIVINTIDELEQTALDAMRAILPVPVYTIGPLNFLTQQLVSEGDGGGSELAAMRSSLWREDQSCLEWLQGREPRSVVYVNYGSVTTMSKQELVEFAWGLANCGYDFLWIVRNDLVKGDAAVLPPEFIEATKGRCLLASWCEQEAVMRHEAVGAFLTHCGWNSMMEGLGAGVPMLCWPFFAEQQTNSRYACVEWGVGMEVGDDVRRVVVEARIREVMGGGEVGREMRRRVAEWKEVASRSTAQLGGRSLANLESLLKDVLK

SEQ ID NO: 709 - protein, 402 aa, Hordeum vulgare
ARGLIFVEEGGRVFSFGKACDKCRIKSVIRVHEPLFYWKVAIEGNLGLAEAYINGCFSFLDKREGLLNLFLILIANRDERRSNRIARKGGRWTPLHVIARLAHARYILREVSRKNTVTQTRRNISLHYDLSNDFFSLFLDKSMTYSCAVFKMENESLEVAQHRKLSLLINKAKIKRGDHVLDIGSGWGSLAIQAVKQTGCKYTGVTLSAEQHKYAERKVREAGLEDHITFLLCDYRQIPPCKYDAIISCGMIEHVGHEYMDEFFACCESYLAEDGILVLQFISAPEERYEQYRRRTDFIKEYIFPGGCLPSLARVMSAMTTSSRFSMEHVENIGPNYYTTLMHWRDNFIANKDKILALGFDDKFMRIWEYYLIFSAACFKLRALGDYQVVFSRPGNRRLGLP

SEQ ID NO: 710 - protein, 99 aa, Hordeum vulgare
MGFSGAPFSTFSIMLDTSMGIRISKASNASRSDCHLSENWLFTLAELNSSHYISVCIEDSSRSQGPEDSPAPVGLKVWKTVPFVEDTLVSGTEAVKLIA

SEQ ID NO: 711 - protein, 216 aa, Hordeum vulgare
GPREAMTACFARVDGEVGVDDGTDTGEQTVGSTAVVAVVGPRRIVVANCGDSRAVLSRGGVPVPLSSDHKPDRPDEMERVEAAGGKVIDWNGYCILGVLATSRSIGDYYLKPYVIAEPEVTVMDRTDKDEFLILASDGLWDVVSNDVACKIARNCLSGRAASKYPESVSGSTAADAAALLVELAMARGSKDNISVVVVELRRLKSRAAAVIKDNRS

SEQ ID NO: 712 - protein, 135 aa, Hordeum vulgare
MQYRESLEEKGLWNMEELERKVASHRRRLQSEYGLSSSVDGANNRHSSERIPSDRKERYDDARDSSKKRPHSPSRSRSPSKKSSLDRDREHNRSRDRLHGNDVGRDRAREKRSGREKDDHHDRSREREKDRRKGR

SEQ ID NO: 713 - protein, 25 aa, Hordeum vulgare
WNMNKGSEKWLCYGGAAGIIRCQRI

SEQ ID NO: 714 - protein, 93 aa, Hordeum vulgare
AASSPSFFFAHPLSLLHHVTRGFAGYMGLSRLCHALKDLKPRAATSSRLHEQGPGAGGAGHAADDGCAAVQVRSRGVPQKPRGPREGRGGTHH

SEQ ID NO: 715 - protein, 309 aa, Hordeum vulgare
GTRLIVPFQLAALKTIGDEDKYFTRVSLRMPLFGMKSSTSQKDLQKSNTSDLSLQGKASSELALDGWHSIALEYSVDWPLQLFFTPDVLSKYRKVFQYLIRLKRTQMELEKSWTAVMHQDHVDFSDYCKDQKNSSATQLRRLRTKPFWRVREHMAFLIRNLQFYIQVDVIESQWNVLQTHVQDSHDFTELVTFHQDYLSALISQSFLDIGSVSRILDSIMKLCLQFCWSIEQYETGANMFEIDHITEEFNKKSNSLYTILRSSRLAGSQRAPFLRQFLMRLNFNSFFETTARGVMNSGRLRPGTASTQL

SEQ ID NO: 716 - protein, 148 aa, Hordeum vulgare
PGYSNNSNSNAWSSNNNQNWSGSHPDTRATTTGIGSTNPNQATGYSSYGSGGYTGKSLEGSAVKDPDPLDMSEEAKAERWFRRAAQIKDISELANIPDGDFPEIMPMRKGVNRFVVSKRKTPLERRLTSLQYRRNLPIVSSEPDKDGS

SEQ ID NO: 717 - protein, 108 aa, Hordeum vulgare
LIDNQPAEGGYQNFEVINHPCQRLRVSVKREQVPVKRETIAHSEDESVAAPMAVVKEEDTTRLGLQGILKPCYTGKRKGRKPKILRRGGSSSVLSSWKSARTRKKRKS

SEQ ID NO: 718 - protein, 185 aa, Hordeum vulgare
ERQINSILNRELEALVEQSQVESEARRALHVDLDEATVSLNEVNESTLFLSNKLDSTVSRICAIKEEKEVLSAALLEQKKRTAEAQKNMVDAQHLIKRLGMERENSEIRNKKLEEELATAKGEMLYLRRQITASGSQNTDVMEASPTPNFSQPLEDRVPNTSSTDAVPPRSAKKIYRRRKDRPST

SEQ ID NO: 719 - protein, 116 aa, Hordeum vulgare
NRSEVERELGMLFSKGGGSGVGTKSKYSGSKFSMVVEDLTEGVLVFEDGDDAVKYCDALQGGGQGCEGIAELEASSVFNMCRQMKALAVLFRRGRTPPTPQSLERDLRARNRSLED

SEQ ID NO: 720 - protein, 112 aa, Hordeum vulgare
GYICPRCKVNVCELPTECRTCGLTLVSSPHLARSYHHLFPVSPFDEVTFKLGQKGGQNCFGCQQSLINTGGQSNIHVRCPKCNHHFCFDCDIYIHESLHNCPGCESQRSSSR

SEQ ID NO: 721 - protein, 563 aa, Gossypium hirsutum
YMSISTLSSYLCLCLFKVYCILQLDYIASFVLLYHIPLKSYQVHDFVYVLAEENKRLVAYLEDLYEDSRGNKMVVVRWFHKIDEVDIDLHHNYNCREIFFSHCLQDLSIECIDGLATVLSPLHFKKFLNEATHTRLEPFVCCKQFENDVKPFDVTQVKGYWKQDILRYMYGLSPSNDCVTRQQRADDLKTVWDVDDDVGIRPRKRYCRSKDDDMHMHFSGSRESMDTSFADVQDFHKSKNGNVSFNFSGRNFAFLSTGEAKQYSSHHLMVGSEVEVLTQDSGMRGCWFRARIIKKHKNKVKLQYQDIQDAADEANKLEEWILVTKVATSDEVGIRVSGRTAIRPSSQFTKGSTSCIGVGSVVDVWWHDGWWEGLVVQELEDKFRVHFPGEKRESVFGIGDIRQSQEWLGNRWINMKERHDLVSTILWAGKQDASKSYNFNTDKNTICESGQCGKEATECKGSAVEPGNERAQDASVVPDLSKDGRLSQLKWKSSRKRKRVTSTCVRKLNCSRNLIKSTAQSVACERFLIPASLKVDNENCKNIGDPLFSSSVVPPLTSLVMTR

SEQ ID NO: 722 - protein, 290 aa, Gossypium hirsutum
MGDPSIHPSLNLYLLQLFVFGLKSSVFLLPFSSKSFNLSTMLLKASPAFSLLKNPQVETRVPLFSRNGSGFGSGAVVVCATKGANNKPLTGVIFEPFEEVKKELNLVPTVPQMSLARQKFADECEAAINEQINVEYNVSYVYHAMYAYFDRDNVALKGLAKFFKESSLEEREHAEKLMEYQNKRGGQVKLQSILMPLSEFDHAEKGDALYAMELALSLEKLTNEKLLNLHNVAERNHDSQLTDFIEGEFLAEQVESIKKISEYVAQLRRVGKGHGVWHFDQMLLHEGAVA

SEQ ID NO: 723 - protein, 386 aa, Gossypium hirsutum
RAGELGTCLTRQRLTSPCLVFIDEIDAVGRQRGTGIGGGNDEREQTLNQLLTEMDGFTGNTGVIVIAATNRPEILDSALLRPGRFDRQVTVGLPDIRGREEILKVHSDNKRLDKDVSLSVIAMRTPGFSGADLANLMNEAAILAGRRSKDKITMKEIDDSIDRIVAGMEGTKMTDGKNKILVAYHEVGHAVCATLTPGHDPVQKVTLIPRGQARGLTWFIPIEDSDLISKQQLFARVVGGLGGRAAEEVIFGEPEITTGAAGDLQQVTQIARQMVTKFGMSEIGPWALTDPAVQSSDVVLRMLARNSMSEKLAEDIDSSVKKITETAYEIAKNHIRNNREAIDKLVEVLLEKETLTGYEFRAILSEFVDEPVIKVDRTPVREMINA

SEQ ID NO: 724 - protein, 329 aa, Gossypium hirsutum
VSKLGFGCMGLTGGYSCPVSEEVGISIIKHAFHRGITFFDTSDIYGPKTNEILVGKALKQLPREKVQLATKFGFEKLDSTGIKVNGTPEYVRASIEASLKRLDVDYIDLYYQHRVDTNTPIEDTMSELKKLVEEGKIKYIGLSEASPETIKRAHAVHPISAFQTEWSLYTRDIEDEIVPLCRELGIGIVPYSPLGRGFFGGKGVVETVPANSHLLYFPRFQGENLDRNKMLYLKVEKLAEKHGCSPAQLALAWVLHQGDDVAPIPGTTKIKNLDSNIDSVKVKLTAEDLKEISDAVPINEVAGDVLPDRFSQLHWKFGNTPPKGSKVST

SEQ ID NO: 725 - protein, 939 aa, Gossypium hirsutum
IYNEQIGDLLDPTQRNLEIKDDPKNGLYVENLTEEYVSSYEDVTQVLIKGLSSRKVGATTVNSKSSRSHIVFTFFIESWCKQGASSKCFSSSKTSRISLIDLAGLDRNKLEDVGRQHVLEGKNVKKSLSQLGYLVNTLAKETQPEKPEDVPYGGSCLTRILRESLGGNAKLTVICNISANNRNTSEILSTLRFGQRVKAVRNEPVINEISEDDVNGLSDQIRQLKEELIRAKSDAYSSVGSKSGYFKGWNARESLNQLRISLNRSLILPRIDNEYEEEINIGEEDVKELRQQLDYLDSSCETNLRDPLDKRGSIQSSVKESCETDLLSEDDIHCPKETEIEEIDEVEVPPMSSPEPADDLSVTSKTLKAVDPSIRNSISISPHRRSSILEEPTLSESPKIANNLRKSMAVPSALLASQKNVSESSESEVLRELLKYSDHIRSSLRTSKTFLGPTESLAASLQRGRQIIDQHQHSSVPNRSSVAFSFEHLMLKPSPEADKANASVQTLPNDKPSPDGSSTPLFCSSCQRKFDNNHPDEVQDSLKTWIVTVDNQQRDGRNTVEEASKKEKTLESVCKEQAAKIEQLTQLVKKYKLERENSAIEHAPEPLKNEIILFDEQSNNGENGKEYFDMTEKEALLQEIQTLKSKLQSYTASPSPNKSTEILRSSLLSRSIQLRKSVDCRNNSEEELERERQRWMEMESDWISLTDELRMDLESNRCRAEKVEMELKLEKKCTEELDDALSRAVLGHARMVEHYADLQEKYNDLVTKHQAIMEGIAEIKKAAAKAGSKGHGARFAKSLAAELSALRVEREREKEQLKKENKSLRIQLRDTAEAVHAAGELLVRLREAEQAASIAEENFSNVQQENEKLKKQVDKLKRKHKMEMVTMKQYLAESRLPESALQPLYREDSDVAASHNSSAIPYDDQAWRAEFGAIYQEHY

SEQ ID NO: 726 - protein, 130 aa, Zea mays
LVILVAFSCFVIFQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 727 - protein, 803 aa, Sorghum bicolor
MAGGAEVAVVEDTAVVGAPTATATPPPPDAAGGAEEGMRMEGWLYLIRSNRFGLQYSRKRYFVLEDAALRCFKSAPSSKREDPVRSAIIDSCIRVTDNGRESLHRSDFYIFTLYNASNHYDQLKLGARSSEEAARWIRCLMESALKSPRKDEHIVACSHRRWQAFRLAIDVNSENPHEISCNNLHPTHYPNTIQRGNLTNSEKRLSRRNRQMHSIDWTLFSSAHNDPMASDVIAPSPWTIFGCRNGLRLFTEANDGGSRGKYWDDHPAIMAVGVVDANSEAVFQTLMSLGQSRSEWDFCLREGKVVEHLDGHTDIIHKKLRGDWLPWGMRKRDLLLRRYWRREDDGTYVILYHSVFHYKCRPERGYIRACLKSGGYVISPVNQGRQSVVKHMLAIDWKFWKSYLFTSSAKYITIRMLGRVAALREFFRAKNGNCACMEFSSGELTRDMGLPQGENQRINLEIQQENENRRLEGPTEGSVGGSNRHLNSTSSFVQLNDATDEFFDVPDESEYDQREVMFPSDESTHASDQRHAKLSTAAVFVKRLHDLAVQKRGYVDLQGAADADNGPCCYGYTLPKDSSYAVPSTWAMTDPTTFLIRGETYLHDRLKIKANSTLMQMVGADWIKSDKREDDLAGRPGGLVQKCAAQGGTKFFFVVNIQVPGSTTYSLALYYMMDTPLEKVPLLERFVNGDDAFRNSRFKLIPYISKGSWIVKQSVGKKACLVGQALEINYFRGNNYLELGVDIGSSTVARGVVSLVLGYLNNLVIEMAFLVQGNTYEELPEFLLGTCRLNYLDASKAVSIDEC

SEQ ID NO: 728 - protein, 218 aa, Sorghum bicolor
TPDPSPAAPLPLLRTTSLPTETEEERWRRREMQSRRRLEARRKRPAAAAADANANAAVGSGRRSNASQGSNSVSTTEQGIGGSAINQSTDARSPSTSDNTNQNSMLPPTKAAEKPLNGTPTEQPRLRTLGSLTTRTSSTSDIRKLMMEDMPMVSSKVEGPNTRRIDGFLYRYKKGEDVRIVCVCHGSFLTPAEFVKHAGGGDVSNPLRHIVVNPAPFS

SEQ ID NO: 729 - protein, 112 aa, Sorghum bicolor
MPHPRWGETPCAFVVPRNNAAELSEDDMLAFCRKRMARFMVPKKVQVVGALPRNALGKVEKVKLREAARKLAPSVPAQKPKGKTTTSSTTVGGRREDQPVAHVMAVSRLLVA

SEQ ID NO: 730 - protein, 214 aa, Sorghum bicolor
MTLPRRRHLVLLAGLLVLVVVAATATASTDSSSTTAVAVDFVRRSCRSTEYPRVCETTLVPCAASVGRSPRRLARAALVVGADRARNCSAYIHGSRSGSGGAMKDCAELARDAEDRLRQSAAEMERMGRAGTPRFAWSLSNVQTWASAALTDTSTCLDSLAQHKDRGRGGKGSDGDDDAVRVKRRVVAVAQATSNALALVNRLQPATHRQRLLL

SEQ ID NO: 731 - protein, 621 aa, Sorghum bicolor
MSSSSPPRRPQRRAASTRPPSYDESLLDAELEGLLGDAASRRVRRLRRLSAEERHRETDTEALIALSLGEDKAAVELGGSVITGIHANPLGVLARQLGLPLHKVRDRCPLYYPDGRIVETRLDRTIDLVFNTLLDHATKVRESLNEAAERISLEEAIEKLRRLYHVARTDEEQMVLNWHFANLEFSNAGCLSELSLAHWDQDDPYEMGGDHCFLAGGNSRLIHALCDGVPVLYEKKVSRIEYGVDGVSVTVEEGQIFQADMVLCTVPLGVLKSGSIVFDPELPQEKLGAIQRLGFGLLDKVAMVFPHVFWDENIDTFGCLNKDSSKRGEFFLFYSYHTVSGGAVLIALVAGEAALEFEKVDPIVSLHRVLGILKGIYGPKGVTVPDPIQSVCTRWGSDPFCSGSYSHVRVGSSGADYDILAESVNDRLFFAGEATNRAYPATMHGALLSGLREASKIHRASESLVNSDQKKNSLPKRLKPPNGALLDLFLEPDLEFGRFSFVFSSLTPDDPEATGILRFSLDKRFFLQPNNPELDGDQKDYSSASGAFHLYATVSREQADQLQKSSEDDRTRLGVLCKDFSVKLMGYDNTCDVGSDLISSILSARKARKLLQHPKNFKISR

SEQ ID NO: 732 - protein, 3627 aa, Sorghum bicolor
MQERQGIIRVPQRADPSSLPSRSTGPSPMSHTSSNTPFKEQQLKQLRAQCLVFLAFRNNLQPRRVHLEIALGRGPPAESDSAGQRGSEGRVSDALGKENGSSRENSGVFCRQTDISRLPSTSAGSIAEVDSLLKDPENATKKIKVAEQEKSLMEVENIQQASASSGMRSQETASQNPSGPQQSYFQGDTRRIASDIHRTDAENLSRNLSWGGQGSTVLGGTRQHLNQETKESLPPSKSHHMPGDGFNSNIPGIDRTPETAGAGNDVENCSHVVDIVPEQAADDGDEDLPEHEDLLSSPPKHTMTEKWILDYQKRIYNERQKRASEQHKLHSRMSASYEKLKESVNSSEDLSAKTKSVIELKKLQLLPLQRRVRSEFLLDFFKPNTTDLERIKSLKKHRHGRRVKQLEKIEQKMKEERQKRIRERQKEFFADIEAHREKLEDNFKAKRERLKGFNRYAKEFHKRKERIHREKLDRIQREKINLLKNNDVEGYLRMVQDAKSDRVKQLLRETEKYLQKLGNKLQNAKSTDGRSSFVTDKSDAANDIEDESYQPQHYLESNEKYYQLAHSVKETVNDQPSYLQGGKLREYQMNGLRWLVSLYNNNLNGILADEMGLGKTVQVISLLCYLMETKNDRGPFLVVVPSSVLPGWESELSFWAPSINKIAYSGPPEERRKMFKEMIVHQKFNVLLTTYEYLMNKHDRPKLSKIQWHYIIIDEGHRIKNASCKLNADLKLYRSSHRLLLTGTPLQNNLEELWALLNFLLPNIFNSSEDFSQWFNKPFESNGDNSPDEALLSEEENLLIINRLHQVLRPFVLRRLKHKVENELPEKIERLVRCEPSAYQKLLMTRVEENLGGIGAVKVRSVHNSVMELRNICNHPYLSQLHVEEIEGYLPKHFLPSIVRLCGKLEMLDRLLPKLKATGHRVLLFSTMTRLLDVMEDYLVWKKYKYLRLDGHTSGQERGALIDKFNDPNSQAFIFLLSIRAGGVGVNLQAADTVIIFDTDWNPQVDLQAQARAHRIGQKKEVLVLRLETVRTVEEQVRASAEHKLGVANQSITAGFFDNNTSAEDRREYLESLLRECKKEEAAPVLDDDALNDILARSEAEIDIFESIDKQRREEEMAIWQKVVQDGSTSGLDPAVLPSRLVTDDDLKPFCHAMKLYEPSSNVKTVKVNVRKKGELGGLDTQHYGRGKRAREVRSYEDQWTEEEFEKLCQVDSPESPQPGGMSKDLDIPNKGIKTEIAVESSKEPEQMRMEASPTVGDSPPAKRRRGRPKRSDVFLSPTADLTDAVKQDTGTTQDGSLATPASTFHSDTPATPIHSAASDVNIHSISPADIKKQEFSTDTKPSSSVSVLEGSTANEIGTPLQSVHNVAAPAPPHQSARGRKSQAGETPRRRGRKPKSLSSSGVDDVSLNPTVSTGSGVADTSYVSSYSHVNMPSSQGTAVALAGIQKDLVTVKLDTLLPDSGKNISPVNEDKGATVTTPVAKDICAGTVTTSDNTITLTPNTLKENIGLVQVASAPTMPMPVASEELLKTAAHVVVADKPVEKQTASRRRRKKTSSSEDTGVSTRQRSAMKKSYYSTSVAIDEVGSAMTPNEKSGIEKERDVSSIQDTPNQLPNINSPLYEKSGYDSQPSTPIAVPINEATLPSGFDTRTTHSKITLATSANPADHDKPVDLHLNAPVSVDSQNHEQLKTGKDHLAVSSGIFSTQLQTVTANPTSDNKPGTTQFEPSASSVQNSGKDATALTSSEVDSAAPNKAPSRRRKGSTREPRTRRTSAAAASERRARLTGSKQAEDTKKLKMSATPTTTVCVLAVEQQGAASLRAEVTNASVCEEQKNPGSHVSSDISIPVGSHVLGAISTEETTATVITQTPAVAKSEERKLPVGDQQGIQFDSTVPQTKMVSNDESMQGTEVNNSEQTKIVSAAEPAPANDEHMQGTEVSNSEQTKMVSAAEPAPANDEHTQAIEVGSSEQPTSMVSAVESAPSNDEEHTTHEVYLETAADDMLTSSAATDILRDTVEHAARQANAACTDGTTRQSEASQLDSKASHDASYKDTTTTVSTKDDSKASRDASYILPSEGTAVDVTGSKQDDVNIVGTQTADASRGSSSHFQATLQSTESDWHPGQEENLESRKEQVKTEEALDNSSGGNQTHSLGDEPSHDTSLARNSPLEYSNERCSAQVIGETFKSKENIVEVHSAMNTDGPDEALDALYVQSKEASITDSGVATDVDKFEGKETSVEVRDDMNTDGPEDAQDALSTQSDKEASMVEFGVSNDGSPTVCKAHNDLEGHVSCEDRTGGDIHTNANYGSNNKSEDTIVNPVKTTREPLEESTVIVSENSDLNKQSHTLHTGNDPPASTLLIVESNKVTCDAEIVCASRLESSCIEAETVAIQESAVTDFEGTKGTGDLGHKTGSPLCDDVHDTSCSVIGLVCEKEPTEDLTDGSHSEAPNLLAAVVQTRETTVANQEEIIDAVVFIDACKAEPDGDCTVAKGAEETVEMVHSVEKQSAVLEHVERQTKQTTICGSVLNESPQAAGLEEDCSVLKHGGPTASSELLAVAPNPISETSVIQAEPEATNSDGYCTTEVGSALSETVRGLEPNKETAVPMQEDIEEANDTSNNCEAHNNSGIHAFGEVLMEMQSSEVKEVSFIQSGAANLSTQTPVLPDETGQTNVASTAELVPTNDDEHMQGTDVNSEQQTKMVSPAESAPGNDEHMQDITVLSSELQTKMVSAAEIDALCVQETAIVDLGGTRGTVDLNDISTQVPALPGSDVLGVEAHNSEPKKASSPGDEIISSEQQAEIETIAETETVSVKENAIADHEETGDQSGVSIHAPLLAESGEKGSHGVELCGIEIEANNSEQGKMVSTVEAASTPDDLGRHTHEVHVTGDGAILSSAEQDTLQDNISSGADVDLTTSQRKTDSEGIKDPSIGTNIEEIQGPYETSNKDHFTDPPATTLVIAESDKDTCDAEVVCAGKLESSGVEGHCSEQVKMASVAEAASSLALVGYSSSEDSMVDAAARVADGDFADSKGAGVDCQETMPTQATSTLPENMDWQNDSLAAAAVTVEPMFASSSEHAAESKPIDETSVMQVELATSTGDECAAEGDNVVSSETVVESEPVQETVVPSQGGSIEANNTSTISEVNKDTESRASGEVCKDAQSHGGESYTELQLAPSSGEEAMILCSELPSQEVKEAPSSEPLGYNENVKTENDSSSQEPVNEESAPGAENAKIDEADTEQQLPPGQQVKEAPSNPLGNNENVKMENEASAQGPVNEESAPRAENVKIDEADTEQLPPSGEAMVDISSELLSHDEKVAPSTVPLGNDEDAHMEEASAAQRELSTEVAHGSENAKLSEAGTSGEAMVDVSSELLSQDEKVAPSTGPLGNDEDAQMEEAAAAQRELSTEVDHGSENVKLGEAGTELQLPPPSSGEALVDISREQLSQEVQEVASSGPSGTDENTEMERLNTEHSPGGETSKLVGADPGIQLPPSGEAVVDISNEPPSCQEVKEAPSSDSLGNDENSDTEKTAAALQGRLNTELAPSGENTESNEADTGKQETPVSADAMVESSSEPPSDEAKEAPTTDLSGDDEKAKSARAAVVAELFGDATEGGSDQPLPSPREQGKEAEADGDL

SEQ ID NO: 733 - protein, 338 aa, Helianthus annuus
MARVPRVKLGSQGLEVSAQGLGCMSMSAFYGPPKPEPDMINLIHHAVNSGVTFLDTSDYYGPKTNEILLGKALKGGMRDKVELATKYGIKLSGSWEVKGDPAYVRAACEASLKRLDVDCIDLYYQHRIDTRVPIEITMGELKKLVEEGKIKYVGLSEASASTIRRAHSVHPITAIQLEWSLWSRDVEEDIIPTCRELGIGIVAYSPLGRGFFASGSKMMEKLEDGDYRPNFPRFQPENLEHNKILYERVSEIASKKGCTTSQLALAWVHHQGNDVVPIPGTTKIENLEQNIGALSVKITPEEMAELESTTHLVKGARCNAGTPTYLDSETLPLPSWKS

SEQ ID NO: 734 - protein, 595 aa, Gossypium hirsutum
MGSFKTSALNFSFIFWDKQEGDGEGVSTVMEMRDIDDLPKNAANYMALTPLWFLERAATVHPTRKAVIHGSRTYTWLQTYQRCRRLASALSKSSIGVGSSVAIIAPNIPALYEAHFGIPMSGAVVNTINIRLNASTIAFLLGHSQSTVVIVDQEFFNLAEDALRIMKEKSQGNFTPPLVIVIADESCNPETLKYALGQGAIEYEKFLESGDPDFAWKPPQDEWQSIALGYTSGTTASPKGVVLHHRGAYLMALSNPIIWEMNEGAVYLWTLPMFHCNGWCFPWTLAAVCGTNICLRQVTAKGVYSAIAKYRVTHFCAAPVVLNSIVNAPPEETILPLPHVVRVMTAGAAPPPSVLAGMSQKGFRVTHTYGLSETYGPSTVCAWKPEWDSLPPETQARLNARQGVRYVGLECLDVISTQTGQPVPADGKTIGEIVFRGNIVMKGYLKNPKANEETFANGWFHSGDLGVKNPDGYIEIKDRSKDIIISGGENISSVEVENSLYLHPAVMEASVVARADERWGESPCAFVTLKPGVDKSDEQRLAEDIMKFCRSKMPAYWVPKSVIFGPLPKTATGKIQKHVLRAKAKELGPVRMSKL

SEQ ID NO: 735 - protein, 340 aa, Hordeum vulgare
MASLVPRLLSRRRILQPAVALCSPCDPWMRFRGASSPRPCPLFRPSLGGDGRGEPAGICWFLSPVRHGSTAVTLDTGGGFARFSFGDPGTTKQNGGQDQPPAEKKKKMSKKSKVNQLKWFRLKAKKKMKSPNPEVRIRYKLEKAKRKEEWLIEKLRKYEAPRAPEPVHDPEILTEEEKFYLKRTGEKKKNYVPVGRRGVFGGVVLNMHLHWKKHETMKVVCKPCRPGQVYEYAEELARLSKGTVIDIKPNNTIIFYRGKNYVQPKVMSPPDTLSKQKALEKYRYEQSLEHTSKFIEQLEQELEDYQKHVALFKKREGANSEQISNEDSAVDDLTTSSDTD

SEQ ID NO: 736 - protein, 102 aa, Helianthus annuus
MASKTFLLLALVFAVVLLITSEVAARDLASNHDGEVDGRSGYNHGSGGHGGYNNGGGQYNVDGRGGYNKGGGHGGHGGHGKGRGGRGGHGGEEATAYKETQN

SEQ ID NO: 737 - protein, 248 aa, Solanum lycopersicum
MKPYYTLKMKRKDLEDVNDEFSDFSLSSPARKIRRLDAVLPPIIEEVEEPEIPIAFEQATTYPSFGSNAVKRGLVIEELPSVPANEERAIVLFKPMNTQPMHSPSNFSVKVDPQFLNGFKSQVFWDNTANAFRLVDANEAAQQDDSSSAKECLAVVPWVPSQFPSAAEAEVLSQPDVSDMMDAEDMEGVAMDIEDNSVDVEPRIAVDAGAVSVNDGLHHWQQQHCMTTTQPPQNTSTPIPWYSNWHKD

SEQ ID NO: 738 - protein, 80 aa, Solanum lycopersicum
MKNTSKSSKITPKSSQDARKDRRSATGMSGSPKKGGHGGKFTWAGDGSYSSKKEEADAAVVVDANDPNFDEPEENSIDES

SEQ ID NO: 739 - protein, 235 aa, Solanum lycopersicum
MATPSVQEIRPASLDSTSESPALFDGTTRLYISYVCPFAQRPWIARNFKGLQDKIELVPIDLQNRPVWYKEKVYPQNKVPSLEHNNKVIGESLDLVKYIDSNFEGPFLLPDDPEKQKFAEELIAYSDTFLKEIYANFKGDIEKHSGPQFDYLEKALDKFDDGPFFLGQFSQVDIVYAPFVERFQIFLKEGLNYDITSGRPKLAKWTEELNKLDSYIQTKADPKEVVDLYKKKYLA

SEQ ID NO: 740 - protein, 585 aa, Hordeum vulgare
MEEFISLGDDSTASEPPQPQDHGPTDKDIIDLDQAQADAADRAAVNLNFNATLPVPSQQQPQDTVTTTKASTVIEIIDLEEGQIAFQESSGAQDAAAADNLQPKDQAQALTANGPEPPPPSQQQPQQDDIIDLEEGQVEDMDLSDDVLVTKHGVSAETPKGSDPLVHASKTGSAFIDQSPTRGVKRARTESAEPSVRVVYNNLTRESKRKLMELMQQWSEWQARKQHALTETVEEVLDCGEETYYPALHVGSERSCAVSFWVDSQARENAAADDGAVPLYDREFTLGSTPMGDSSNAEGKKDKDDSRCFNCGSYSHALKDCPKPRDHVAISNARKQHNLKRNLSNASNRGQNRYYQKTPGKFDDLKAGVLGSETRECLGLRENDPPPWLHRMRELGYPPGYLDEVEDEDKPSGITIFGGEGEANAEQQQQQHEEGELPEKGEPSPPRKRMTVEFPGINAPVPENGDPWLWGSAPPPPLQSSSSGRHQHPSSDSQRDRGPPPPPGVEQYSSSRYHSYDYGPATPGTGRRSSSGYDDGGAFTPHSAYSSRQHSGSGSRERERERERERERERERERHDRHYYSSNRR

SEQ ID NO: 741 - protein, 410 aa, Hordeum vulgare
MAARPPPSPASTPRRHHHHLSPAARPGRRDRQLARCFPEPFPKPPNPPNPLLSLLTAVPDWADAVSERRIREPRPLYTHEQWREHRSSLRHLRHLLSSLSSRVILSLVPPVSAFTAFAAAVATYNTLAPDYALTASSLPYQLTAPALALLLVFRTEASYARFDEGRKAWMRVLAGATELAGMVMHSCAGAGERGDNDTGTGALVNYILAFPVALKCHITSNSDIRKDLEGLLAEDDLNVIMSSKHRPRCIIEFISQSLQILDFDEHKRSIMESKLSCFLEGICVCEQIIGIPVPLSYTRLTSRFLVLWHLTLPIILWAECKWIVVPATFVSAASLFCIEEVGVLIEEPFPMLALDAQCKQLHDSMRDMMSVQGLVRKQLVAKTKGRGRGSRLPQNGWPVSSPRSEQVKVD

SEQ ID NO: 742 - protein, 117 aa, Hordeum vulgare
MQAAKEKVKDGVSAVKAKTKITQAKASEKAEAATARSHAERELAHERGKAKVAAAKMELHQDKALHREEAMEHRIHKHGGGHGRHHHKHGVGIVAAPPPATGAGGYYPPPAAGGHYY

SEQ ID NO: 743 - protein, 243 aa, Gossypium hirsutum
MARIYNGKMQIPKSSMALRGAAMAGGACIGRQRATPFVISSSPLFFRVRSLHSHSHPLLRFTSFPNPKTGFKYQIRAIQEVTADTVKSQKGKEDDEQSSPQNWKIKMLYDGDCPLCMREVDMLRERNKQYGTIKFVDISSDDYSPEENQGLDYKTVMGRIHAILSDGTVVTDVEAFRKLYEQVGLGWVYAITKYEPIATIADSIYGVWAKYRLQITGRPPLEEVLETRRKKKADICNDNNCKI

SEQ ID NO: 744 - protein, 372 aa, Helianthus annuus
MAELNGGGQYTDFPAVPTHGGQFVRYNIFGNEFEITSKYHPPIMPVGRGAYGIVCSMLNSETNEMVAMKKIMNAFDNYMDAKRTLREIKLMRHLDHENVIAIRDVVPPPARREFSDVYIATELMDTDLHQIIRSNQNLSEEHCQYFLYQLLRGLKYIHSAKVIHRDLKPSNLLLNANCDLKICDFGLARPNADNDFMTEYVVTRWYRAPELLLNSSDYSAAIDVWSVGCIYMELMNRKPLFPGKDHVHQMRLLTELLGTPSESDLGFIKNEDAIRFIGQLPRHPRKSLQDTFPHVHPLAIDLVEKMLTFDPAKRITVEEALAHPYLERLHDVEDEPICPNPFSFDFEQQVLGEEQIKDLIYQEALAHNPEYA

SEQ ID NO: 745 - protein, 92 aa, Solanum lycopersicum
MKKGSSFIAILLVLFLSELLVTEAVTCSVTELVPCAAAILSSQPPSKECCNKLKEQKPCLCGYLKNPSLKQYVNSPNAKKVAKTCGVSTPSC

SEQ ID NO: 746 - protein, 407 aa, Hordeum vulgare
MPLPSSSSSSAAAAVAAGPAASPLAARSRGRLLRARSGHAAAVRCQRVDPVRLRAVNGSPPCVPLSDRSPWTPVTTPIFGDASIRKDDTRLRIFSGTANPSLAQEIASYMGLELGKINIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKNFPQLTILSVANLLGETIWRVHDDCSVGHAPYSTLDID

SEQ ID NO: 747 - protein, 664 aa, Hordeum vulgare
MAAAPPDGQEKVIAAAQQIVKSLANSKNAADDMIRILSGFDNRFSLMSDLFPAAGAPDAAAGSELPEGDEEEVEYGRERGPGYGGDDDDLEDERDAAVEDALRLIEQWDSPAAGDRLVFESPEDAEEYLAAAACLMGEAGPRVEAALQVAMARLEEEFRQLLIRGTASLAADDLHASLLRRLSLTVPTFHSASSVDLECPSFASQPDEGDEAASAAGRWSSVSDGEISPYLISPDTVSTLKDIADVMLRAGYGPELCQVYSEVRRDTLMECLAVLGVDKMSLEEVQRVEWGVLDGKMKKWIQALRVVVQGLLAEERRICGQILAADADAEEECFTEAAKGCVLQLLNFGDAIAIGKRSSEKLFRILGMYEALAELLPELEALFSGDARDFIKEEGEGILVRLGDAVRGTVAEFANAIRGETSRRSLPGGEIHPLTRYVMNYVRLLADYSRWLNHLLDGCETELENGGDNADMTPLGHCLLILITHLLDKIEDKAKLYDDEALQNIFLMNNLWYVVQKIKDSELKTLLGDNWIRKRRGQIRRYSTGYLRSSWTRVLACLRDDGLPHATGSSSALKAALKERFKSFNLAYEELYRTQTAWRVVDPQLREELKISISEKVLPAYRSFVGRFRGQLEGGRNFAKYIKYNPEDVENQVSDFFEGKKLNA

SEQ ID NO: 748 - protein, 448 aa, Hordeum vulgare
MSAGATINWIRTPFHTQRFHDFSSLSFRCRNTFGSIQPCWLATDQDSSLSKVRVAADYSDSLPDSKYMRDRGYHPLEEIKERPKKKDISLTDVETARTVVEANSKGLLIFPARVHNEPHGHVSWSEFQYVVDDYGDIFFQVPDDGNILEDDDANNPVTVLIGTDGAIIGETSVVTSDFNDHVVIEDSMDMHDDDSKVDTEITNILIEWGMPVTMRSIHPIYFAKCLTKAVHDNHGEKIDNPSNGVSIVGYLRPAFIEEESYLRSLFHSECNADGYSSEWREEYNREPRPASGTNGLIDGDKLRLDINDAGSSIDSTIYKLEMMTIELFSVYGKQFMIDPQDFQDAEPDLLSNHASDIIKRMEENSDQCTMALRSLCSRKKGLTVEEARLIGVDSLGIDVRAFSGLEARTVRFSFNAQALSERSAEKKIKRMLFPRYRKTVKASAEDEC

SEQ ID NO: 749 - protein, 1369 aa, Hordeum vulgare
MGSLTKAAEEGAFAAVDWSDEAVIYVNGVRRVLPDGLAHLTLLQYLRDIGLRGTKLGCGEGGCGACTVMVSCYDQTTKKSEHYAINACLAPLYSLEGMHIITVEGIGDRQRGLHPVQERLAEAHGSQCGFCTPGFVMSMYALLRSSKHPPTEEQIEDSLAGNLCRCTGYRPIIDAFRVFAKTDDSLYTASPSENANGQAICPSTGKPCSCRNETDVNANESSTSSSVKIYLPCSYNEIDGNSYSEKELIFPPELQLRKIMPLKLNGFNGIRWYRPLKLEQLLHLRSCYPDAKLIIGNSEVGVETKFKNAQYKVMISVTHVPELHTLKVEEHGLHIGSAVRLAQLQKFLKNVIAERSSHETSSCHAILRQLKWFAGTQIRNVASVGGNICTASPISDLNPLWMATGANFQIIDVNNNVRTIAAKEFFLGYRKVDLKADEILLSVILPWTRPYEYIKEFKQAHRREDDIALVNAGMRMHITEAEGNWIVSDVSIVYGGVAAVPLTAAKTEKFLVGKKLDDGLLDETFNFLKEDIPLAENAPGGMVEFRSSLTLSFFFKFFLHVMHEMNIKGLWKVGLDAANMSAIQSYTRPVSIGTQGYESVGQGTAVGQSMVHMSAMLQVTGEAEYVDDTPTPPNNLHAALVLSKKAHARILSIDDSVAKCSPGFAGLFLSKDVPGSNHIGPIIHDEEVFASDIVTCVGQIIGIVVADTHDNAKAAANKVNIEYSELPAILSIAEAVKAGSFHPNTTRCISNGDVEQCFSSNTCDKIIEGEIRVGGQEHFYMEPQCTFVWPVDSGNEIHMISSTQAPQKHQKYVANALGLPLSKVVCKTKRIGGGFGGKETRSAIFAAAASVASYCLRRPVKIVLDRDVDMMTTGQRHSFLGKYKVGFTNDGKILALDLEIYNNGGNSLDLSLAVLERAVFHSENVYAIPNIRVSGKVCFTNLPSNTAFRGFGGPQGMLIAENWIHHMATELKRSPEEIKELNFQSEGTEVYYGQLLRNCTMHSVWDELKASCNLLEARKAVNVFNNENRWRKRGIAMVPTKFGISFTAKFMNQAGALVQVYTDGTVLVTHGGVEMGQGLHTKVAQVAASSLDIPLSCVFISETSTDKVPNASPTAASASSDLYGAAVLDACQQIKARMEPIASRGNHMSFAELAQACYMERVDLSAHGFYITPDIGFDWIAGKGSPFNYFTYGAAFAEVEIDTLTGDFHTRTADIVMDLGYSINPAIDIGQIEGAFIQGLGWAAMEELKWGDDNHKWIRPGHLFTCGPGSYKIPSINDIPLNFKVSLLKGVPNPRAIHSSKAVGEPPFFLASAVLFAIKDAIAAARAEEGHLDWFPLDNPATPERIRMACVDSITKKFASVYYRPKLSV

SEQ ID NO: 750 - protein, 351 aa, Hordeum vulgare
MERWRRVSVLAMALLLLSACHGAEFSVKNHDQSLIYDHTLAKTIVEYASAVYMTDLTALYTWTCSRCNDLTQDFEMRSLIVDVENCLQAFVGVAHNLNSIIVAIRGTQENSVQNWIKDLIWKQLDLSYPNMPNAKVHSGFFSSYNNTILRLAITSAVHKARKTYGDIGVIVTGHSMGGAMAAFCALDLAIKLGSDNVQLMTFGQPRVGNAVFASYFAKYVPNTIRLVHGHDIVPHLPPYFSFLSKLTYHHFPREVWIDDSDGNTTEQICDASGEDPNCCRCLSILSLSIQDHFTYLGVDMESDDWSTCRIITAQSVERLRKDLASNIIMTKHDADVSIVENSVQTDWSSSR

SEQ ID NO: 751 - protein, 320 aa, Hordeum vulgare
MSRLMAAMLLGGARVASATALTGNTAVKAIPRPCFLAPRPHAASWSPICMQTAPRSSQAYNNAPDDRRDIKDKYRGAAEQAKDATGDAKESAKGQASRMADETKDKAGDAAQRASQMTDKAKHETKETASQAADKAGEMKDRAKETAEEAAEKASRMTEKAKHETKETASQAADKAGEMKERAKETTGQAMDKAKETAGAAKEKTAEVAEGAMDRAGEAKDRAAEGTRSAGEKVAELTKEGASKMAETAQAIGEKAKQAAQGAWDATKGAAQGVKEKVVSESTTEEHSTWDDVEAATKERDRIAQEERKRQAREKGAGLP

SEQ ID NO: 752 - protein, 526 aa, Hordeum vulgare
MELATAAVVSTASIHHGRSHSSAPRTASWSSSSSPSSSWSLSIPASTSRSQRRRLLVTSAAVELREAAAGGGDSVRVIETPQPNSCVKFSVEVPPSICQECYQTTLLEYSKRFKVPGFRPGKIVPENVLLNYVGPQHVRAATVEAILRHTLPQALSSVEERALEDSVRILTKFDDMNEAFSLDHVFRYDVAVDVVPEVRWLSEDKYKNLKVVIEIDEIVDAEKAAELELKRRRKSLGLLRIVTDRGLQVGDLVVLDILAETITTDGSKGEKIPSAESTGFHLDTEENTNLVPGFLGSLIGIRPGETRTFPIQFPESFEQETLQGVRAQFTVVCKELFYRELPELDDSLAAKLLPGCNTIDEVKERILERCKEVEKTAIEQATDNAILDQLGKLVDVDVPRSLFQEQGQQLYGAKLLQLQAERKLDKDQLASLSSEKSVQEYLKSERENITRIIKQMLVVGEIFKAENLQYSTDQLVKEVENSIEEFKRYNQDYDEGNIKQQVQDVLEAAKVLEWLKENCTIEYIKK

SEQ ID NO: 753 - protein, 301 aa, Hordeum vulgare
MSMAATAPAAATATAWPSTSSSIHHHATPNPRALRSGFLGRALTLCPHPVDARAAAAAAVSVRAAWDGPLSSARLIMQGRNVKLTEKLKEHIEDKVGRAVSNHAHLVREVDVRLSARGGDLSKGPKLSRCEVTLFTRRHGVVRAEEEEESSYASIDAAAAVVKRKLRKIKEKETDVRHLKGTKEWQAADADATGFSDVEEESELELEEDDLVEVIGAEDEETVLTKVVRTKVFEMAPLTVDEALEQLENVDHDFYAFRNEQTGEVNILYKRKEGGFGLIIPKQDGHVDKATVNAKEHPVAG

SEQ ID NO: 754 - protein, 210 aa, Hordeum vulgare
MASGVFGTPISEKTVIATGEYKEPITQKDVADYTMKMINAGGKDINAQTFVDNLKERYGNGIAVKCLIYNATGATLSLAKYNDWHGHIYDTPYPSDIQNGQWGAFLHVHPSGAAVGSAGAVVYRSKIPSSTRSCDWLFSWTVPYIGANGVYTEIREEGHYPNVGSWGYIYGVKLANSDLNSTDKNYGYVSKTNIGEGSTMNARGVFQYPY

SEQ ID NO: 755 - protein, 833 aa, Hordeum vulgare
MATLTSELLRPVHEAQALDEAALLRYAAAHVPGFPAPAPALALTQFGHGQSNPTYCLEASAPGGEPRRYVLRKKPAGAILQSAHAVEREFQVLKALGAYTDVPVPKVFCLCTDASVIGTPFYIMEYLEGALYLDNKLTGITPDKRRNIYLAAAKTLAAVHKIDATAVGLHKYGRRDNYCKRQVERWGKQYLHSTGEGKPARYQKMLDLIGWLKENIPEEDSSTGLGTGLVHGDYRIDNLVFHPTEDRVIGVLDWELSTLGNQMCDVAYSCMPYIIDGALSENSSYGGFEHSGIPDGIPQLEEYLAVYCSMSARPWPAENWKFYIAFSLFRGASIYAGVYHRWTMGNASGGERARFAGKAGNVMVDCAWDYINRENVLRAHPATGMHVSKAPQQGFHVEQEDSTLTSGQGKFVPSEKVMKLRHKIMKFMKDHIYPKEDELYKHAQSTSRWTIHPEEENLKALAKEEGLWNLFIPLDSAARARKLLLEDRSYVSAGSSNDLLLGAGLTNLEYGYLCEIMGRSVWAPQIFNCGAPDTGNMEVLLRYGTKEQQKQWLVPLLEGKIRSGFAMTEPQVASSDATNIECSISRQGDFYVINGRKWWTSGAMDPRCKILILMGKTDFSAPKHKQQSMILVDINTPGVQIKRPLLVFGFDDAPHGHAEIIFDNVRVPVTNILLGEGRGFEIAQGRLGPGRLHHCMRLIGAAERGMNMMVERALSRTAFGKKIAQHGSFQSDLAKCRIELEQTRLLVLEAADQLDRHGNKKARGILAMAKVAAPNMALKVLDMAIQVHGAAGVSSDTVLSHLWATARTLRLADGPDEVHLGTIAKLELQRARL

SEQ ID NO: 756 - protein, 562 aa, Hordeum vulgare
MLGRLAARRPRPGSARAAAAYRSSASVLPDALDRSSDAYARNAAAVGGLLSDLRSRVSQVLGGGGAGAVKRNEGRGKLLPRDRIDRLLDPGASFLELSQLAGSDVYEEALPSAGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKISGVSDHFAQDERHGLALGRNIVKNLHLAAKETNIHNSACDYQEPLYDVQELRSIAPADTKQSFDIRSIIARIVDGSEFDEFKQLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGMEWTKDDEEAFKAKVVEAYDKEGSPYYSTARLWDDGIIDPADTRRVLSLCLSASAKPVPEDTKYGVFRM

SEQ ID NO: 757 - protein, 531 aa, Hordeum vulgare
MAPAAAAPAPAATACSSSASSARPPSTASSSQSPPRRTVPALLLFISLAALLILSSGEAHDPDADSGRPLKDVSLEYPEVTFAPSSMGGIFCERIRISKIPRWQFQSYANQIHIRMNVSHSLPEKFHWKIQICFHGNVSTGLCQCEMGEWQALQGGTWNAVKSPYNSRYVDVKLTDKKSAVFSLSIQEELQKWRLACLGIGFVLLFLSPIVSKWAPFYYSSSMALGILLVVLIVLFQGMKLLPMGKKGLFYLTIYGSVLGVGSYAAHYFSSVVASILENFGLSEEMHNPVSIFLLVAVVLTGAGFGYWMVRRYIISKDGCVDAGISQFVKWAMRVVGMFFVMQSTLDPILAFAALAATSWVCSVLTTKKVHKPTAPKRKQSNVSSHPRFTQVSPNTRQVQFLSPSSRAGTGRATTTQYGWNYLANGGLASSALVKRLAPNQDEDYYSTFHNIEPRKYSKREWEEFTEESTRNALMEHTATPEFAQWAADNAHRLRVERDDSSEDESIETSSGSSEEAEKGGKASSLLGRFM

SEQ ID NO: 758 - protein, 549 aa, Hordeum vulgare
MDGAGMATPPEANTSPAPNGGGCGWIRVENCYVFKSRLQEYVQKAGLMTPEYQTLKEGPSHAPIFSSTVVINDVKYDSLPGFFSRKAAEQSAAEVALMEIGKSMALPTNATIPAVQETGLCKNLLQEYAQKMNYAIPSYICNKQSPYICTVEIGGIQYIGATARTKKEAEIKAARTALLAIQGQSEGCANGTTKYIVVPGKRQGKDTEKKPVETPKSLKTKKGGFKKQRNKNKFIKKNGQEVNEGKDETGVPGDAHHSDVPMKPAVTTEDPSANTVMMQPDEEAWSFEHEPASDTAMLQPDEDALPFEHEPSGNTAMLQPDGEATKVGQEHLSDTAMLQPDEDAWPFEHEPAGNTAMLQPDGEATKVGQEHLSDTAMLQPDDEGRRGKQEPLIGTAMPQPHMEDRRVGAEPPRDAAMVQPNDEARCVKQELLIDTAMPLPNEEAGAGANPVPPSDSTTAQPNAETTNINGESLRNAASAQHNEEARTLNQEPPSSASLLQPKEPRVENGEFVSENKDQTPGDASREANRSIEDMPEKSSNNSSAFTSAE

SEQ ID NO: 759 - protein, 248 aa, Hordeum vulgare
MELVSSSRSVLSSCNRLVAPSTSRTASAAARRHGKSLVCVLGGDTNGEFKIGKRAALALFFATPTLLLAFSAHSKTKTINPYEERRLLQQNKKIQEANRAPDDFPNFIREGFQVKVVTPDNYITRDSGLIYEDVKVGTGDCPKDGQQVIFHYVGYNESGRRIDSTYIQGSPAKIRLGNKSLVPGFEEGIRDMKPGGKRRLIIPPELGPPVGPSTFFSAKQFEVFDVELLSVQDCQRRTIAFYSDVVCT

SEQ ID NO: 760 - protein, 283 aa, Hordeum vulgare
MEAEYPQINPLLLCSRRRKREEDEGGLELLLSMDLDEEETRPEQQAPPRVPEKLKAVGQELGHEIRIFSSTTFELMTSKLPRADQEEDDDFYELQPGDYYKLISNRLAEQSKVLKTRKIREAELAAQRARLTKAVMRVRFPDGYILEVEFHPSETVHSLLDLLMKVIARPDLPFYLYTVPPKKRIMDTSQDFYTIGFVPGANVFFSYDLPEGSELNTDGVKSGPYLREEIRTLDGLSLHSEPSDQPDVSKTNSDSAHQSEAFRPDSAPPPANKKSAKPKWFKR

SEQ ID NO: 761 - protein, 1015 aa, Hordeum vulgare
MASKFGLAGGIPERRVRPIWDAVDSRQYKAALKLCTSLLAKHPTSPYALALKALTLERMGKPDEALTVCLNAKELLYSNNIFHFDDLTLSTLQIVFQRLERLDLATSCYEYACTKYPNNLELMMGLFNCYVREYSYVKQQQTALRMYKTVGEERFLLWAVCSIQLQAYFSSGGEKLLAFAEALLKKHISSHSLHEPEALSLYVSILEQQAKYDAALEVLSGDLGSLMGREEDKLRLQGHLLTQACNYVAASEIYQKVLESCPDDWESFLHYLGCLLERDVKLPKPTTGEHTCSSCSVDSTMLSKTSLSEELVESRLASALLFVQKLQKNDSSDSVRGPHLANIEIERQHRLSGNSTKFMEALVNYFHRFGHLSCSSSDVEIYLHMLSGDEITELLDTISRSFDASSVSVKALGLTITTFKVQELLGTLFSKSTTDLQRIAKGMVETFYKNLSLSRDLDPQESIHGEELLSMASSILVQLFWRTRKLGYLLEAVLVLEFGLTVRKHVWQYKISLVHLYSYLGALPLAHRWYVSLEVKNILLESVSHHILPQMLSSPFLEQTASLVKDYLRFMDDHLKESADLTCLAYRHRTYSKVIEFVQFKNRLQCSMQYLAVKSDSVILSLKQKSESLEEVESVLENVNHGGGLVDLSNEDNMKHLTFNEDLEARPWWTPTTSVNFLSEPIDESSTPACFRAKVCKHKSTEKDGPKMGDAERKCLVPRLVYLSMRGCVSSLRETEHNGSVSDITVGEMKTLLEKYARTIGYSMDDALSMILGISSGKKSMKDFAPDIVSWMSFAVFINAMNLWSNESVIPRTEPSSPSSWEIVDSLVKLCIEEHLTDANRILTCPGNKIPLLVQMVTEPISWHLIIIQSCTRVVAPQGKKKKKSGPSLRTNMPQLQGIQRSVQCLIETLQSVQKWLSDQMSPEEQGLDILLSYFQGTGDEGPGQTFRVLEEKPAAHASELGDRIAQSLEAWSSTSVVRRIVGAEHEVLAEFKKMVDSKLKLLMSESASLSSVLH

SEQ ID NO: 762 - protein, 448 aa, Hordeum vulgare
MAFSARRSLATGLSSHLTRRLHPSLSHLLPSSHHDNNHENPSSSAPPFPTQQTPHFPSGDLRRRARSQGLALPLPFGAHLAAHRGFSTSGSSPGPQIDGILTDPAAGQMDVAAGVLSDAAASVAPAFPLPFPGEVAAAAADSFPPVAALQYLIDAVHSFTGLNWWASIAVTTILIRTVTIPLLVNQLKSTMKLNAIRPEIEAINMEMQNSMDPQSMLEGKKKLGELFTKRGVNPLTPLKGLFIQGPIFMSFFFAIQNMVEKVPSLKGGGAYWFTDLTTPDELYILPVLTSATFLATVELNMQEGMEGNPMLQTMKKFSRILALMTIPFTMHFPKAIFCYWVTANLFSLGYGFALRKTAVRYFLNLPEIVPQPAPAEVSTFNLFKAPKAVNTPTGDNGDSSTVVNSDSTTAVNGSEQSNAELSDRVVFLEKKIAELERRAKARGESQEE

SEQ ID NO: 763 - protein, 116 aa, Hordeum vulgare
MQTAKVKVKDAVSSAKEKAKEGTAKAQGKTGKATATTHGEKEMAKEETRANKAQAKAEMHQEKAEHRADAAAGRHGTAHVPLTGPHGHHRPAAAAPADPAYTGTGAGAYPTTDKYV

SEQ ID NO: 764 - protein, 593 aa, Hordeum vulgare
MEAAEDAGGARSTARKLVPWSSWAEWRLVRDAIFSPYPDPGAALRRIAAWRSRGCLPIPVEVTAALFEIRLRDPFFRNGVASDDKLESDEMLALLYSMAIIRLVNGFMESPHKETGRSISDLAETVGVPRILVDIRHESSHRGIPSLRLLHLAAIKAFDWLKCNYWDSQTSAIPDVRLELSSVLHDIAQFLKGKDSENAKSGSKRKRSQKHILNAIKYVRRLYYTCPSEAISVLLEFFQLDAPEISDSDVHQADSLDGNPSSDVQSQNQISNGDMKTIITKLSEKEPRVLLGLLKSIIEMIEARNDLEHKGGSYACLPAESPTMKSLCSLVLWIVASIKELKDSGRIGLVHEIGVLSSDKNAVPRFCLAKLLQKFLTLPVIGERCIADAALLLIEMASNNNVKEKLRKLPLLSLRRSPKDCTLIESRILSNGQESVESATQKLEAFKLQLRKPDNASIAENGTEGTFNTSVPEKRNRWSVAKSWTPCPLGMIPCSYSSTAVLPVLDIIDDELEHDTAEHGNFEDDGQIEIADPEKQLDDEGFLEISRSPPEHGISVMPELIHGLKGTLLVGGVWKKVTEEELLSIKSSMKILL

SEQ ID NO: 765 - protein, 540 aa, Hordeum vulgare
MTAADAAAESDAEARSILERAAAASFPPLHAVHHLLSVGVCVRCIFRMFGAFSHACSCASLTVSVLHSFLEEHDDSAKDGSCSCLSMDEACCSICFGILLPTCHQDEGVAPFEDISRIDIITSMVSQAIQREGYQIGEFSTEISVPAVVAANERAIRLYMKGKYGSENWFKDEIFTQQTMSVKEALRLLIVPSLEKQLGVKHSNNSFRIRLTYTHDDASLKLKSLLPNDSNRKRKAESREGNDTRRNSTYDDKQILTETDTFIHKSLEGIQDQEFCTLFKLPPEKVLKPCQLVISFLRSPIYIGGRYLKLSRNVSQSCWIIDDERMGEASVEEIIKENVCAISRGDGYKFHAAGREDIDVRMLGSGRPFLIEVLNVRSIPTAIEIQQISDKINSSEKKYVRVRNLKLVDNEIWAMMREGESEKQKQYAALIWTSNPLTDDDLQKISVVKDMEIVQNTPVRVLHRRSPLERKRIIHWMEIEKVEGSSNYYLLHLCTQAGTYIKEFVHGDLGRTNPSIGSMLRCRAEILQLDVTDVKMDLLQ

SEQ ID NO: 766 - protein, 458 aa, Hordeum vulgare
MPPSREQPAAADGGIEENAMAILDTFGIKDSRDLHDDRAAFLEAVRSAGLAGDKPSSPTRRMYDAVFQILQSSTSLELTIASFHLLMELGKQYPRVYLTNSGSRQALVTVNESWSPFLLGNNVASGEIGRNTSRSDHLFDSLRFSLLTEAMVEASNATGAHNGLKHIENMVLFQYLVCTLEADFVPRHIAYKESLDWVIIRESVLNVLLGSRKLVFKMFVKNCISLLNQHQREVEDDISYKSASDLDSSLTFSSLEFEREALTSVKKLFIMVINLDLIRKEADKLGLTSRADGLRNPILEVILEELTYNQIYLSPFLLAFTEWKWKLQIILQYFSRYQVKPAVRTRRSDNSQQDLTVESALSMFSTEASAKAMVKMMCPEVAQLLLAHAYQVCLSLDGDSSKANDAAKMMGASLLEISCKFVSAFQNLRKINTSIQISQFEKEALFTAATLTRKLQNE

SEQ ID NO: 767 - protein, 1075 aa, Hordeum vulgare
MEVDPSPSPPTMSTPGYFDPDSSRLREEYRRYRKRLSSSNDSPILGTSVSRFSEARSLHDGSSIPRRPNAGLLLEDVKQEAADYSDIDGLNGPKLFGSAKRTSLNGGSGRRAARSALNLVKLEDDMPREGETTSTTFASLLDSAIQGLMPFPDVILQFERTCRNASESLRYAATGNIRMAEDKLMQQKAKLLLDEAASWSLLWYLYGKANEELPEGLFMSPTTSHQEACRYVATDLTAQLCLRIVLWLEGLASESLDLEKKVRGSHVGSYLPSSGVWHRTQRHLKRRNNDSNIVKHVDFDAPTREVAQLLPDDKKQDELLLEDIWTLLRAGRLEEACELCRSAGQSWRAATLCPFGGVDLFPSLEAMLKNGNARTLQAIELESGIGRQWRLWKWASYCASEKIAEHDGGQYEMAVYALQCSNLKRTLPICTEWESACWAMAKSWLDVKVDIELSRYQTSRPEEKEFDDDMNGTQLGPENWPYHVLDQQPRDIAALLQKLHSSDLVHETVSRACREQHRQIEMNLMSGNLAHLLDLLWSWLSSIEEGQNVSRSRDDSDMIRFGAHIVLVLRYLLSNEMEDEFEEKLVTVGDLIINMYVRYLFSEGQEELVGVYASQLDRDVCIDLFVDMMELRLNSSLHTMYKLFLSAVEYLPFSSGDASKACFEEILERVLSRSREIKLHQYNEDFSDVAEQHHLQALQKAMIIQWLCFTPPSSIPGFEMITGKLLIRALMHSNTLFREFSLISMRRVPDLPVGPHKLLAILAEPLKQKENLFSLEDQEVSDNLEEFEDWHEYYSLDATYRGWLRCEMENYSVPPEMLSAEEKDQAVAAATQTLELAFLLLEREERPWLNAIETSPFESSELVFLELHATAILCLPSGECMTPDATSCTALTSALYSTVSEGDVLHRQLKVEVKVSSKDPCCIEVALRCLATEGDGFGLHEANDGGLLAAIMAAGFKGELNRFQPGVSMEISRLDAWYSDCHGSVESTAAYIIRGLCRRCCLPETILRSMQASISLSEAGDSLDHCDKLIELVASSDSGMMHLFSQQQLQEFLIFERECFICKMELEEEQMPADG

SEQ ID NO: 768 - protein, 874 aa, Hordeum vulgare
MGGGRKRGRSQRRHFKQERENVWKDNPRRPPASAGEGGEGNGWQPFATENLAFEAYYKGQQIVPEEEWDAFMSMLRKPLPAAFRINASCQFFKDICSQLENDFRKSLETEVSDDHEKEAIRPLPWYPGNLAWHLNFSRMQLRRNQALESFHEFLKQENEVGNITRQEAVSMVPPLFLNVQPDHHILDMCAAPGSKTFQLLEMIHQSTKPGVLPTAMVVANDVDVQRCNLLIHQTKRMCTANLVVTNHEAQNFPGCSVAKFCPEACVDESKLQRLEFDRILCDVPCSGDGTVRKAPDMWRTWNIGMGNGLHRLQVEIAMRGIALLKVGGRMVYSTCSMNPVENEAVVGEILRRCGDSVELLDVSNELPELIRRPGLRTWKVRDRASWLGSHKDVLHYRKNVILPSMFPSGKGSMDSCTAGGSVEVSIDAVDADMNESGDMVEGKQETKIAIDDSKNGDNANTEEIKQGESESVKLSRGSDEKTDSASIVTEHSNLPLHRCMRIIPHDQNSGAFFIAVLQKLSPLNESQVVEAMKGERSTSKDKTLKCSNGQGSDKVPAEEISVQQPGVVDSHDLVEQQNRDMDTEISKDKSSEEAKVIASEVQNDQATRRDKRKTQNQGRWRGVDPVIFFKDEATIRSIISYYGIKDSFTLEGHLVTRNPDTNHVKRIYYVSKSVKEVLDLNVKVGERLKITSLGLKIFERQSSKEGSPCTFRLSSEGLPLLLPYITKQILYASAIDFQHLLQYRIIKFPDFVDAKFGEQAAALLQGCCVVILREGHEDLESIGMDPSAIAIVCWKGKTNLCVMVTPMDGRELLERISFRFGLKIPKIDDGKPDLKSDDGSDEQPDGGAETVDPECVPESKAPEDMYITDVKDAE

SEQ ID NO: 769 - protein, 126 aa, Hordeum vulgare
MSTVEEEELSECEVLWPETRHGAPGSPYGPSTAAPGGASRDHRRQRSAPVDIPRPAHLPRGRADLDDDEEEEEHDGAMVPPHLMVSRRWSEGKAAAFSLRSGPGRAHRDLSHLRNSVLRMTGFIEG

SEQ ID NO: 770 - protein, 593 aa, Hordeum vulgare
MDIGSVPSPADAAAAPSAAAMPREATLGHHLARRLAEVGARDVFTVPGDFNLTLLDELEAEQPSGGGVRLVGCCNELNAAYAADGYARARAGGVGACAVTFTVGGLSAINAVAGAFSENLPVICIVGGPNSNDYGSNRILHHTIGIPDFTQELRCFQNVTCYQAVVNNLEDAHEQIDTAISTALKESKPVYISISCNLPSIPHPTFSRHPVPFFLSPKLSNQMNLEAAVETAAAFLNKSVKPVLVGGPKMRVAKACEAFVELADACGYPVAVMPSAKGLVPEHHSRFIGTYWGAVSTPFCAEIVESADAYLFAGPVFNDYSSVGYSLLLKKEKAIIVQPDRVVIGNGPAFGCVLMKDFLHALATRLKKNTAAYDNYSRIFVPQGEPLSSEHGEPLRVNVLFKHIQKMLSGSSAVIAETGDSWFNCQKLKLPEGCGYEFQMQYGSIGWSVGATLGYAQAAKDKRVISFIGDGSFQVTAQEVSTMLRWGQNNIIFLINNGGYTIEVEIHDGPYNIIKNWNYTGVVEAFHNGEGKCYTAKVRTEEELKKAIEASLGPNKDSLCFIEVIVHKDDTSKELLEWGSRVSAANSRPPNPQ

SEQ ID NO: 771 - protein, 872 aa, Hordeum vulgare
MSPAAAAPAPRDDRIRSFEDFARVHQFLLIAAGVPPSLHRRLYRKLADEVFDGGESFSVEPCEEGRQRRLVLASGAPLGSEADVFLVDHAWSFRLSDALKQLREVPGLAERMAALMCVDLDRRIEVEEADEQDSEKGGGLEHVLQVVEKERIRIQESGGDFAAWLELEELGIDDDMLVALDLSANFPNLVALNLWGNKLQDPEKVMREIGKCGRLKALWLNENPILNQCTEKDVLDGLPELEIYNSHFTMKAREWALGFCGDMIGAENPCLSVGNIPLDNIVTLDLSDRSIHKLPEVFSSSKLSSLSKLNIRGNPLDQMSGDDLLKLFSLFTQLQELEVDIPGPLGNSAISILESLPNITLLNGVNASSIVESAKHVVDSALKPRVPEWSPEESLAERVIGAMWLYLMTYRLADEEKFDETPIWYVMDELGSAMRHSDDANFRIAPFLFMPEGKLSSAISYTILWPICDVHTGEECTRDFLFGIGEDKQRSARLTAWFHTPENYFIQEFRKYQEQLQSTSICPTKETPSTRSVRPSDGRPLRVFTDIPQVEEFLTRPEFVLTTDPKDADIIWAGMQIDSELKSSLGLTDQQYMNQFPFEACLVMKHHLADTIHRAWGSPEWLQPTYNLETHLSQLIGEYSVRKRDGMDNLWIMKPWNMARTIDTTVSGDLSAIIRLMETGPKICQKYIECPALFQGRKFDLRYIVLVRSICPLDILLCDVFWVRLANNQYTLEKTSLFEYETHFTVMNYNGRMNHMNTPEFVKEFEKEHQVKWLEIHESIRDMIRRVFESTSAVHPEMQNSFCRAIYGVDVMLDNRFKPKILEVTYCPDCTRACQYDTQALVGSQGPIKGSDFFNTVFGCLFLDDLTNVSPL

SEQ ID NO: 772 - protein, 251 aa, Hordeum vulgare
MAACSFALRLGPRFAAPTVASATRGGGGGGVRPTGSRALVSKKPNKDHRLWIRKDSAGSGKKALCLVNTVSKLPNEKEAVYGALDRWTAFEPEFPIIAAAKALEMLKKRRKWLQIIQVTKWLMSKGQVLTWTTYDTLLLALSMDGRVDEAESIWNTILQTYTRSVPKKLFSRMIQIYNTCHLPDKVLEIYADMEELGVRPDEDTTRRIGRAFATSGQEDKQKPVLEKYLKKWKYIHFNGERVRVRRAGPLA

SEQ ID NO: 773 - protein, 314 aa, Hordeum vulgare
MSRPLFGVMAAAAIVVVGCCFAACPVGAGASAGGFYENFEVKWGTDPDPDRRVEIVDGGRLVTLTLNNVSGSGFQSRDAFLFGEFTMEMKLVPGDSAGTVTTFYLTSKDPTAVGDGHDEIDFEFLGNVSGEPYLMQTNVFAQGVGGREQRSYLWFDPTEDFHNYTILWNPLNIIFSVDGVPVRVFRNQEANGVPYLTRRAMKVHATIWDGDTWATRGGRVKIDWAHAPFVASYGTYASSACVSAAGDGDGDEDVPSAFCCPGDAASWMARRLGPDGERALAWARDKYMVMDYCDDPWNLGRPAECDMDRLASAV

SEQ ID NO: 774 - protein, 488 aa, Hordeum vulgare
MATNDKPHAVFVPFPAQGHVTPMMKLAKVLHRKGFHVTFVNTEYNQRRLVRSRGPDAVAGLPDFRFATIPDGLPTSKADADADATQDPPSLCYYTMTTCLPHLKNLLRDLNAAVGAPSVSCVVGDGVMSFCVDAAAELGVPCALFWTASACGFMGYRNFRFLLDEGLTPLKDEEQVKNGYLDTPVTQARGMSKHMRLRDFSSFVRTTDRSDILFNFLLHEVEQSDRATAIVINTIDELEQTALDAMRAILPVPVYTIGPLNFLTQQLVSEGDGGGSELAAMRSSLWREDQSCLEWLQGREPRSVVYVNYGSVTTMSKQELVEFAWGLANCGYDFLWIVRNDLVKGDAAVLPPEFIEATKGRCLLASWCEQEAVMRHEAVGAFLTHCGWNSMMEGLGAGVPMLCWPFFAEQQTNSRYACVEWGVGMEVGDDVRRVVVEARIREVMGGGEVGREMRRRAAEWKEVASRSTAQPGGRSLANLESLLKDVLK

SEQ ID NO: 775 - protein, 867 aa, Hordeum vulgare
MRVAVVGGGVSGLAAAHELLAASGGGDVRVTLYEQEESLGGHARTVAVDDGAGGCVNLDLGFMSFNQVTYPHMTEWLEGLGVEMERSDMSFSVSKQPEGNGRGCEWGNGNGISSLFAQKSNILKTSFWRMLGEILKFKNDALAYLEYHQDNPDLYCNETLGQFIQSHGYSLLFQEAYLIPVCAGMWSSPSQGVLSLSAFFVLSFFRNHDLLQLFRYPQLPTVKARSHSFVEKVKGELESLGCRMKTSCRVKSVSSLDGTSGYRVLENDGSEETYDSVIFGVHAPNALKVLGAEATHDELRILGACRHVQRDIYLHCDQNLMPQNSFAWSAWNFMGITSSVFSVTYWLNHIQKIESVRPFLVTLNPPCVPDRVLLKWSTSLLVPSVAATKAYLQLDQIQGKRGIWFCGAYQGHSFHEDGLKDGKAAAQGLLGKKCELLLNRKQIIPSWTEAGARLMVTRFFNLYVSIGNLIFVEEGGSVFSFGKACDKCRTKSVIRVHEPLFYWKVAIEGNLGLAEAYINGCFSFLDKREGLLNLFLILIANRDERRSNRIARKGGRWTPLHVIARLAHARYILREVSRKNTVTQTRRNISLHYDLSNDFFSLFLDKSMTYSCAVFKMENESLEVAQHRKLSLLINKAKIKRGDHVLDIGSGWGSLAIQAVKQTGCKYTGVTLSAEQHKYAERKVREAGLEDHITFLLCDYRQIPPCKYDAIISCGMIEHVGHEYMDEFFACCESYLAEDGILVLQFISAPEERYEQYRRRTDFIKEYIFPGGCLPSLARVMSAMTTSSRFSMEHIENIGPNYYTTLMHWRDNFIANKDKILALGFDDKFMRIWEYYLIFSAACFKLRALGDYQVVFSRPGNRRLGLP

SEQ ID NO: 776 - protein, 398 aa, Hordeum vulgare
MSSETSKRDHARELLAADRKLMTVARTARRRRLEVRRLGRTASAAAEDEGAKRVRPAPDSSSDSSDSAKVAPEPPLAASRCSACVSHGAVSVIGRRREMEDAVAVAAPFLADTAAVEGSGDVEHGAGEEGFFAVYDGHGGSRVAEACRSRMHLVLAEEVRLRRPRPEGGGQGRAVDNEADGARWKEAMTACFARVDGEVGVDDGTDTGEQTVGSTAVVAVVGPRRIVVANCGDSRAVLSRGGVPVPLSSDHKPDRPDEMERVEAAGGKVINWNGYRILGVLATSRSIGDYYLKPYVIAEPEVTVMDRTDKDEFLILASDGLWDVVSNDVACKIARNCLSGRAASKYPESVSGSTAADAAALLVELAMARGSKDNISVVVVELRRLKSRAAAVIKDNRS

SEQ ID NO: 777 - protein, 949 aa, Hordeum vulgare
MSSKKVPFNRHKENEEARKKREEDEAARVYAEFVESFKGESTSGSKFVRGGVIDPNAKLRADSEGGKSKDGGSVPKKGSRYVPSFLPPSFGKEPHKKKEDERPKEKEKGKPRVIDKFMEELKFEQELRERRNQERDGRHGDTSASSSHFDELPDEFDPSGRIPGSFDDGDPQTTNLYVGNLSPQVDENFLLRTFGRFGPIASVKIMWPRTEEERRRQRNCGFVAFMNRAEGQAAKDEMQGVIVYDYELKIGWGKSVALPSQALPAPPPGHMAIRNKEGGTVIISGPGGPPAASVTRQTSELVLTPNVPDIVVAPPDDSHLRHVIDTMALHVLDGGCAFEQAIMERGRGNSLFSFLFDLKSKEHTYYVWRLYSFAQGDTLQRWRTEPFIMITGSARWVPPALPSSRSPNREKESTFAAGRSRRAEVERTLTDSQRDEFEDMLRALTLERSQIKEAMGFALDNADAAGEIVEVLAESLTLKETSIPTKVARLMLVSDILHNSSAPVKNASAFRTKFEAAIPDVMESFNDLYCSITGRITAEALKERVLKVLQVWANWFLFSDAYLNGLKATFLRPGNSGVTPFHSLCDDAPEIETITSSEGSNNGFRLDEDGALATGKAAATKELLGLPLAELERCCRHNGLSLCGGKEMMVARLLSLEEAEKERAYQKDVDMKCGQGEPHRTSREDIGLNAHNGLRPGEGTVDDESVMLGLSRHTGQKHYGKSSSAELKQVPSKKQRAGPILPASKWNQEDDGSGDEDRKDGQGLGLSYSSGSDIAGDPGKADAKEISTDQAIHHPDTIVDEEHRQKLRQIEIGVMQYRESLEEKGLWNMEELERKVASHRRCLQSEYGLSSSVDGANNRHSSERIPSDRKERYDDARDSSKKRPHSPSRSRSPSKKSSLDRDREHNRSRDRLHGNDVGRDRAREKRSGREKDDHHDRSREREKDRRKGR

SEQ ID NO: 778 - protein, 1226 aa, Hordeum vulgare
MAAPPETTGAPSPPEGEDKGNAGVEVCCFEQSAEDFSRAVRAISELAAGEPEPGFPDAEAERLASSITFLREWRHFNYEPKGVSFTHGTGSTSSRDNTHEITLPQFSSASVPQVTHLEDGRDNNTYSSDFILFAGGNVWSLDWCPRLCDKPSSPVNCEYLAVAAHPPGSSYHKIGMPLIGRGIIQVWCIVAPFEEARTNQSTLAYSNSNRRGRPRKIPNEHNSIESSSVPRKPIGGPRKIKLTTRDDHAEPSLKKPRDHTEPSLKKPRGRPRKYPLSATKAVDSTKNSGSQGSSFVDPLVTSGVIPGDLALSCAIPSVKSVDSAPKRGRGRPRKIPIDKIKCSPDTEWTEDISRALICCTIPKKKRGRPRKYPPPSSSKHVSGTDNEFERETGYTESNSNLSLVTVDAALPVPSSSLTICGKRSRGRNGRGRPKKETNPCILSSSVVSGLQLQSRETISNDPACSVENHLPYGHSNLTSELCSIDGNVHTSPTLEDSLLPMHIAAKSNGEESSGSRRRGRPRRKTLSITNGCLFASGTESSKVATTITDSDNPMALTKSDGETIASDPASVGSLMRCHIGMCNVNMSAASPPHGLCNANYKEKSSAQHRKKPVAVEWCSSTAFSGKEQNNQTTPQTSDNVASVQNCKKELLVYTRRRVRGPTKKPASNETCSLALSGDAQKMERSSTSIMPNNHLFSVENPKLLGSSISEDMANEAGLVGCKSALGNHEVMEKNDSEAANKVVPVPSENSAQIIIVEDAEVVPSKESSKNSNIITCAENSNFSAIPEGIHLPRVVLCLAHNGKVAWDIKWKPPLPNQSEQKSHLGFLAVLLGNGSLEVWEVPSPSMIQKIYSSSSVKGTDPRFLKLQPVFRCAKVKCGNIQSIPLTVDWSPSSHDMILAGCHDGTVALWKFSTDLPSQDSKPFMCVTAESVPIRALSWAPYVSEENTNIFVTAGEDGLKFWDLRDPYRPLWELTTAPRAVLSLHWLKESRGIIISLEDGTLKFISLPRIANDVSVTGRPFAGTKTQGVSTYQLSEYLIWNVHVSEITGYAAYCVADGTAVRFQLTSRFWEKEPGRNRVPYFLCGSVAEEGATIKIGGTLQSSPLSNVPLVAKKGPKPCQKVPKAHDTQTEKVLALTNSEHVDPEPREGRLDGPGEGQETNALVLADSLMPENGGTCNVPVDEDTKDFELFPPKAVALHRLRWNMNKGSEKWLCYGGAAGIIRCQRI

SEQ ID NO: 779 - protein, 748 aa, Hordeum vulgare
MLHELLLALLGFTGDFVLDNSSAPRRPEPAEAGGAADGDAGPAFRLAPDLTFLQPSERSAIERLISLGFYYRELNRFATESRDLSWIQSSVDVSSPNADITLKGKGRKGSAYRRAIGNGIAEILSVYRSAVLQVEQNLLSDPLPILATVTHGLNKFEVLLPPLYELVMEIEQKDIKGGQLLNLLHKRCHCGVPELQSCIQRLLWHGHQVMFNQLTSWMVYGILQDQYHEFFIRRQVDRDEENESAQSDVADKFAQKLARDTSLTSWHSGFHVSLDMLPEYIHMRVAESILFAGKAIRVLRNPSPGATLLEPTNQSQTLKGSHRMQSFIGCSGALKELPNFSNISAEELLPQAEADKVDAMLKQLKHASEFHKRLFESAVSSIRTIAANHLWQLVVVRADLNGHLKALKDYFLLAKGDFFQCFLEESRQLMRLPPRQSTAEADLIVPFQLAALKTIGDEDKYFTRVSLRMPLFGMKSSTSQKDLQKSNTSDLSLQGKASSELALDGWHSIALEYSVDWPLQLFFTPDVLSKYRKVFQYLIRLKRTQMELEKSWTAVMHQDHVDFSDYCKDQKNSSATQLRRLRTKPFWRVREHMAFLIRNLQFYIQVDVIESQWNVLQTHVQDSHDFTELVTFHQDYLSALISQSFLDIGSVSRILDSIMKLCLQFCWSIEQYETGANMFEIDHITEEFNKKSNSLYTILRSSRLAGSQRAPFLRQFLMRLNFNSFFETTARGVMNSGRLRPGTASTQL

SEQ ID NO: 780 - protein, 1051 aa, Hordeum vulgare
MGSASKLLSSLLLTSSPLRLRPSAAAFALILSSRTAASRRQHLLSSPSPLRTLSTSAAAAAASPLPCSSSSASSTPPPHVPFPDWSRLVDRLAAAGYAARAPSPADELAVPSGSGLSAEAESAVSSCLAFARDRPDLLRSLPTKDVEVVVSNVAPALFKRGEESAQRLQQYLAGEDDNAIQSVRAETVDIVRYLLSYTYGSSNNYLEDKELTDSAVRNILAELVNFSGLPHTSSFVESTVDNQPERFSRHPGQNVEMKRGDWICTRCSFMNFARNARCLECNEHRPKKMLTGGEWECPQCEFYNYGRNMSCLRCACKRPATTASAGAGLGGVADLLSVTNAGRSDIERKLAENDEKAERWLSKVSQLDDSADLSSLAADEDFPEIMPMRKGVNKFVVSTRKTPLERRLSSAQYSSNNSPQATASDSKISQTLDRILGRSASTSAPSNQSDNGGVDAGPPRKLTGHLGDIDPVPFVPLSADLFTKPQNANSNEQADTDCQINKETGSSTPDTTQASTGRRDVDKSLDTAEKWSKKVAELDSVNDLSSAISDEDFPDIMPMRKGENRFVISKKKDRSLASPQYKRRSVLEQADNSDFVPFVPFPPDYFAKKDAPAESTPDTGTVSESPPSADKLPETNASPGNSGNSQNTSQVIGPQRSSNMTNENWNRNYSQQSSSTGGYTQGGSSSQQYQQQPYDVGDRSSRTSNTSAWNPNYSQGTFNDGRGGSSNYQHQQQPQELGDQSIRTSNTGALNTNYSQGRFNDGRGGSSNYQHQQQPREMGDRSSGISNTGAWNTNHSQDSFNDGRGGSSNYQQQQQLHGMGDQSSGTSNTGAWNTNYPQGRFNDGRGGSSNYQYQQQPHQTGGRPSGTLDTHAPNSNYSQGSFNEGRDTSTYNHGSYSTQPSYAPGYSNNSNSNAWSSNNNQNWSGSHPDTRATTTGIGSTNPNQATGYSSYGSGGYTGKSLEGSAVKDPDPLDMSEEAKAERWFRRAAQIKDISELANIPDEDFPEIMPMRKGVNRFVVSKRKTPLERRLTSPQYRRNLPIVSSEPDKDGS

SEQ ID NO: 781 - protein, 461 aa, Hordeum vulgare
MEDANAVVDWNVDIIGPDGGSACRKLAKTEDPDATECSSSFGDTLSGSQDDAKPSEISDIEVDSPFCRYPHNGDAAALLDAAASDNLDRLLKKKKVTDHWRNYISPLMWRCQWLELRMKDLQSQVSRYDRELAVLKHEKELQTKMIELDCSSSRSVPFSSHCCRKTMKRKKRKRNEEKINAPSYIATHTILSYYEKEKTEGDGPSIDDNGNLADDSTKGNNDADWLLGNGDDATVEQILLNIQSIQDRVCSLRSDLKKAMAKKSKGLVLKVNTRVNGAQSSNCSHGKGKVAEMPEISPQDASDCDMDDMDMPDSAVSSYGEANNMDIFESTMNLLSVEDPDKIGELHQTSEDVLIDNQPAEGGYQNFEVINHPCQRLRVSVKREQVPVKRETIAHSEDESVAAPMAVVKEEDTTRLGLQGILKPCYTGKRKGRKPKILRRGGSSSVLSSWKSARTRKKRKS

SEQ ID NO: 782 - protein, 741 aa, Hordeum vulgare
MGYHHLLVVSPPAQPPPRRLSLLSRSPRGAVTAAASPDAARSLSVVAASAATRRRAVLLVGISVLPLLRLRDAAAAAQPLAADLVTDKMGIQTSEEMQLEETRAKPPQPEVKRPSPGNPLANLLNAIAVIASGLLAGLLGTTQREKKALQSTISSMEIKLAEDEAAMSVLRENYEKRLLDEQAAQKKQARMFQDEEASLLDQLASTTRTVKKLNGEVMKEEELVGQLKHGIHDLEMSIAQAEEDKHAFEENLRDKLETVDILHGKVNLLSQDVNDKEEHITELSSSLSTKEGDYQNLHLMFNQTKGSLEHANSRMEQLEKYVYAAKNDIKSKISSIDSLNEDVQTLYSAKSDAEEKINELMKQYAELDAASEMRASRDLELLSNKDDQLNQLEEQLSTALSDSIEDRIIIAELNSELEANRTMLVNEVEARKKMSDLIQSTEDALKESRNELFKLSEELNEVNISNHYLRTQISEFTNESNEVKEALTNKVEEAESVSKALSDEVASLKEILQKTQEDLEVTSNQLVSITEVHDELNKELLDAYKKLESATDELVRERQINSILNRELEALVEQSQVESEARRALHVDLDEATVSLNEVNESTLFLSNKLDSTVSRICAIKEEKEVLSAALLEQKKRTAEAQKNMVDAQHLIKRLGMERENSEIRNKKLEEELATAKGEMLYLRRQITASGSQNTDVMEASPTPNFSQPLEDRVPNTSSTDAVPPRSAKKIYRRRKDRPST

SEQ ID NO: 783 - protein, 257 aa, Hordeum vulgare
MAASLPYLPPPPPTPSPAATTLPSNLVSFPAPRPRPAATHRRAVLAAASSRPPPPPPPSPEGGDEEVERAMGMDGGIPGTSGELLRRVSSRAYGMRRHLMESLDSLAYDVLETNPWREQQPKPVYVLARRDNQLWTMKTRRNRSEVERELGMLFSKGGGSGVGTKSKYSGSKFSMVVEDLTEGVLVFEDEDDAVKYCDVLQGGGQGCEGIAELEASSVFNMCRQMKALAVLFRRGRTPPTPQSLERDLRARNRSLED

SEQ ID NO: 784 - protein, 430 aa, Hordeum vulgare
MYGVGGGGGGFNAPSTASGRRRNQEDDEEEEEEEEQTGDGRVLEAWERAYADDRSWEALEEDDSGLLRPIDTKNLVHSQYRRRILLRSAAAAARIQKGLIRYLYIVIDLSRAASEMDYRPSRMAVVAKCAEAFIREFFDQNPLSHVGLVTIKDGISHRLTEIGGSPESQINALMGKLECSGDSSLQNALELVHGYLNQIPSYGHKEVLFLYSALNTCDPGDIMETIEKCKKSKVRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVSPFDEVTFKLGQKGGQNCFGCQQSLINTGGQSNIHVRCPKCNHHFCFDCDIYIHESLHNCPGCESQRSSSR

SEQ ID NO: 785 - protein, 403 aa, Hordeum vulgare
MAPSTSSASALIHLPGLPPRRPHSGGCRNQTRRPRHAAVQCSFAFAPVETARIKVVGVGGGGNNAVNRMIGSGLQGIEFYAINTDSQALVNSQAQHPLQIGEQLTRGLGTGGNPNLGEQAAEESKEVIANALRDSDLVFITAGMGGGTGSGAAPVVAQIAKEAGYLTVGVVTYPFSFEGRKRSLQALEALEKLERSVDTLIVIPNDRLLDIADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYNGEIHVTIIATGFPQSFQKSLLADPKGARILEAKEKAASLVSAAVQQPTPAAVPTWSRRLFS

SEQ ID NO: 786 - protein, 686 aa, Gossypium hirsutum
MDGVTVASTPSPSYSTTAYVSWDEVNVSSDKGRRVVHYYLKRRDGVSDLAVIGKEKSLRHMSYHFAIKNRSLFFSSTSFYKLKSRREVVNWLNSVVSDSSSRESHCSVDGIWNGKDVKSMDFGAVKDLQSQKLVQKEFLWLGSSWTCKRKKKHYESFRRNGVIISVHDFVYVLAEENKRLVAYLEDLYEDSRGNKMVVVRWFHKIDEVDIDLHHNYNCREIFFSHCLQDLSIECIDGLATVLSPLHFKKFLNEATHTRLEPFVCCKQFENDVKPFDVTQVKGYWKQDILRYMYGLSPSNDCVTRQQRADDLKTVWDVDDDVGIRPRKRYCRSKDDYMHMHFSGSRESMDTSFADVQDFHKSKNGNASFNFSGGNFAFLSTGEAKRYSSHHLMVGSEVEVLTQDSGMRGCWFRAHIIKKHRNKMKLQYQDIQDAANEANKLEEWILATKVATSDEVGIRVSGRTTIRPSSQFTKGSTSCIGVGSVVDVWWHDGWWEGLVVQELEDKFRVHFPGEKRESVFGIGDIRQSQEWIGNRWINMKERHDLVSTIIQARKQEASKSYNFNTDKNTICVSGQCGKEATECKGFAVEPGNERAQDTSVVPDLSKDGRLSQLKWKSSRKRKRVTSNCVRKLNCSRNLIKSTAQSVACERFLIPASLKVDNENCKNIGDPLFSSSVVPPLTSLVMTR

SEQ ID NO: 787 - protein, 326 aa, Gossypium hirsutum
MAATFFRRLSKATPATFNNAFRGQPKSGFAGFRFTTIAAVAGGISTYYCFSDSNLVHLDQVNEETGPKVALKSDKWLEFKLQDTARVSHNTHLFRFSFDPSAKLGLDVASCILTRAPLGQDAEGKTKYVIRPYTPISDPDAKGYFDLLIKVYPEGKMSQHFASLKPGDVVEVKGPIEKLRYSPNMKKHIGMIAGGTGITPMLQVIEAILKNPDDKTQVSLLYANVSPDDILLKQKLDILAASHPNLKVFYTVDNPTKTWKGGAGFISKDMVTKGLPGPAADTLILVCGPPGMMEHISGDKAKDYSQGELTGILKELGYTEQMVYKF

SEQ ID NO: 788 - protein, 770 aa, Gossypium hirsutum
MGSSILPDLGAEILIPVCAVIGIVFSLAQWLLVSKVKLSPGRDSGSPGNNGAGGKNGYSDYLIEEEEGLNDHNVVIKCAEIQTAISEGATSFLFTEYQYVGIFMVAFAILIFLFLGSVEGFSTKSQPCTYDKSKMCKPALATAIFSTVSFLLGAVTSVVSGFLGMKIATYANARTTLEARKGVGKAFITAFRSGAVMGFLLAANGLLVLYIAINLFKLYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHELTPMLYPLIISSVGIIVCLITTLFATDFFEIKAVKEIEPSLKRQLIISTVLMTIGIGIVSWVALPSSFTIFNFGDQKAVKNWQLFLCVAVGLWAGLIIGFVTEYYTSNAYSPVQDVADSCRTGAATNVIFGLALGYKSCIIPIFAIAMSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 789 - protein, 282 aa, Gossypium hirsutum
MYAETGLFFPYMQKFSEDFQQFIDYCKSQKPNASTNNLVQISTISEYDLGGEGDLFKAPEPIIEEPNLGLDPMTAAISLISCGEDVITSQGLKAADIESIQYEQLLEVLYECEKDMMAKAAMETPLSEVLDIKIPVVKINENQHLENKVLSDIPFQKSVSSSCLSSMEWVQGAVIKPNFLDFPGMDFGSVYGMRRAFSEGDIQTLGNGNGSVICSPLERPIMISCCSTEDRREKLSRYRNKKTKRNFGRIIKYACRKALADSQPRIRGRFAKTEESDNSKRQ

SEQ ID NO: 790 - protein, 189 aa, Gossypium hirsutum
MAMWVFGYGSLIWKAGFNYDDRLVGFIKDYRRVFYQGSTDHRGTPEYPGRTVTLEPAPGEVCWGAAYKISKEEDKEAAITYLEVREKQYDKKAYVDLFTDPLATTPAISGVMVYIASPDKKLNPNYLGPASIEDIAKQIVRAEGPSGPNREYLFQLEKALLQIGCKDKHLMDLANEARRILSESEHTAS

SEQ ID NO: 791 - protein, 288 aa, Gossypium hirsutum
MSATSASSLILPSLKPKVLSLSDSTPNSLSLFSLSPTPHAKPLFCSALPSFQLLTKKSSFSSGFLTNVAVSSEYDQEEDLFGSDDEERSPTFSPDLKLFVGNLPFTVDSAQLAGLFENAGNVEMVEVIYDKVTRRSRGFGFVTMCTIEEVEAATQQFNGYELEGRALRVNSGPPPPRREEFSPRGARGGPSMGARGGPPMGASNRVYVGNLSWGVDDTALETLFSEQGRVVEAKVVYDRESGRSRGFGFVTYSSADEVNSAIKSLNGCDLDGRPIRVTVAESRPRRQF

SEQ ID NO: 792 - protein, 444 aa, Gossypium hirsutum
MISSWRKRRAGKRAGKEQARNENGEMELSIPRDFRCPISLDLMKDPVTLSSGITYDRPNIEKWIEAGNFTCPLTNRVLRSLEPIPNHIIRKKIQDWCVENRSHGIERIPTPRVPVSSMEVSEILSKIDVACKKQDGSRCLDLVAKVKSLAKESERNKRCIVSNGTGNVLSEAFAAFSMAAFDENVSVLEEILSALVIMFPLDGEAKGFLGSASAMHCLIRFLSSGDLSRRRNAVLALKELVSSMEDQRKILNQLSEMEGAIEALLKLIKSPICSTSTKASLTIIYHMITSYGNEKQVGNKLVNLGIVPLLLEMLVDAERGMCEKALGVLDGIFDTEQGREMACKNALTMPVLVKKILRVSTMATEFSVSILWKLCKNEKKEDGGVLIEALQVGAFQKLLLLLQLGCVEKTKDRVSDLLKMLNPYRSKIECVDPIDHFKGLKRPF

SEQ ID NO: 793 - protein, 675 aa, Gossypium hirsutum
MAVTVSLSVSHLPGCKVHDFSHLPKPTNKDNPSSKASSDIKLSKRNLLLSSMASGLIGRGVFVGEPVKAEPETPMESSSSRLSYSRFLQYLDEGGVKKVDLFENGTVAIAEIYNPALEKIQRVKVQLPGLPQELLRKMKEKNVDFAAHPMEMNWSAALFDLLGNLAFPLVLLGTLLLRSSSVNNPGGGPNLPFGLGRSKAKFQMEPNTGVTFNDVAGIDEAKQDFQEVVEFLKTPEKFAAIGATIPKGVLLIGPPGTGKTLLAKAIAGEAGVPFFSLSGSEFIEMFVGVGASRVRDLFNKAKANSPCLVFIDEIDAVGRQRGTGIGGGNDEREQTLNQLLTEMDGFTGNTGVIVIAATNRPEILDSALLRPGRFDRQVTVGLPDIRGREEILKVHSDNKRLDKDVSLSVIAMRTPGFSGADLANLMNEAAILAGRRGKDKITMKEIDDSIDRILAGMEGTKMTDGKNKILVAYHEVGHAVCATLTPGHDPVQKVTLIPRGQARGLTWFIPIEDSDLISKQQLFARVVGGLGGRAAEEVIFGEPEITTGAAGDLQQVTQIARQMVTKFGMSEIGPWALTDPAVQSSDVVLRMLARNSMSEKLAEDIDSSVKKITETAYEIAKNHIRNNREAIDKLVEVLLEKETLTGYEFRAILSEFVDEPVIKVDRTPVREMINA

SEQ ID NO: 794 - protein, 350 aa, Gossypium hirsutum
MGEEQQGIQIPRIKLGTEGLEVSKLGFGCMGLTGGYSCPVSEEVGISIIKHAFHRGITFFDTSDIYGPKTNEILVGKALKQLPREKVQLATKFGFEKLDSTGIKVNGTPEYVRASIEASLKRLDVDYIDLYYQHRVDTNTPIEDTMSELKKLVEEGKIKYIGLSEASPETIKRAHAVHPISAFQTEWSLYTRDIEDEIVPLCRELGIGIVPYSPLGRGFFGGKGVVETVPANSHLLYFPRFQGENLDRNKMLYLKVEKLAEKHGCSPAQLALAWVLHQGDDVAPIPGTTKIKNLDSNIDSVKVKLTAEDLKEISDAVPINEVAGDVLPDRFSQLHWKFGNTPPKGSKVST

SEQ ID NO: 795 - protein, 313 aa, Gossypium hirsutum
MVLLVQRLSKLYHKLENHYHHHHHHQAEVDALSASLQAFRSDVSNCANQLLHPEPGSEILSFSWIQRCFELLPVINQAFLKLVGDIDYPMSCWDVASLDEYLNYGLHLLELLNCVTSSLSHLAQARLSFAHALNLVESSPSTAIEHLKAIQSQSSSKDLKELVRNKEGGEGKLSSCKERVVHEALMEVKSVGLWVFGVVLATLSGETKPYLEIKQVIVRFNSALLIDVDSCVFKVMVEKGETLKEVKELNSAANSLVSAILSGKTSDAAMDFGGKLGVFEKEMDALEKQVDALFSSVLAARNELLNGVWQRKQ

SEQ ID NO: 796 - protein, 645 aa, Gossypium hirsutum
MPALVNYSGDDDFYNGGSFYTNSTDLGRLCSISFQVDVYCPPRKRTRISAPFHFGEAEVEQNKQPSIDVLPDECLVEIFKRISGGKERSSCACVSKHWLMLLTSIRKGEYESSKVVKENVGSNSGDVEMILSEEDDGYLTRCLEGKKATDMRLAAVAVGTSGHGGLGKLSIRGSSSSRGVTNFGLSAVARGCPSLKVLSLWNVPRVGDEGLCEIAKECHLLEKLDLCQCPHLSNKGLIAIAANCPNLTALSIQSCPKIGNEGLQAIGKLCPKLQSISIKDCPLVGDHGVSSLLSSASSVLSKVKLQGLSITDFSLAVIGHYGKSVTNLMLSGLQNVSEKGFWVMGNAQGLQKLVSFTIASCWGVTDVSLEAIGKGCANLKQMCLRRCCFVSGDGLVAFAKSAGSLECLQLEECNRVTQSGVIGVLSNCGLKSLTLVKCMGIKDISLEAPLSSSCNSLKSLSIRNCPGFGTASLAMVGRLCPQLQHVDLSGLCGITDAGLLPLLENCEAGLVKVNLSGCLNLTDEVVLHLTKLHGATLELLNLNGCRRITDASLAAVAENCVFLSDLDVSRCAITDVGIAALSHAEQLNLQVLSFSGCSGVSNKSMTFLKKLGKTLVGLNLQHCNSISTQTIELLVESLWRCDILV

SEQ ID NO: 797 - protein, 487 aa, Gossypium hirsutum
MAAEYREPLLKKKYYKNCPGCKVDEMKELEQGLPIRPLLSIWIIVLCTALPISSLFPFLYFMIRDFHIAEREEDIGSYAGYVGSAFMLGRALTSVSWGIFADRYGRKPVIIMGTTSVVIFNTLFGLSVNFWMAVITRFLLGSLNGLLGPIKAYAVEIFRDEYQALGLSTVSTAWGIGLIIGPALGGFLAQPAEKYPNLFSKDSLFGRFPYFLPCLAISIFALAVTIATCWLPETLHKHNDNDQSSDDSYDALEAASNESNTKDITEKEEGRESTSKQSLLKNWPLMSSIIVYCVFSLHDMAYTEIFSLWAVSPRKYGGLSYSTEQVGEVLAVSGFSLLVFQMSLYPYVERLLGPVMVSRIGSVLAIPLLQSYPLTAMLSGFTLTLVINCASVLKNVLSVSIITGLFILQNRAVDQHQRGAANGIAMTGMSLFKAVGPAGGGALFSWSEKRLDASFLPGTQMVFFVLNIVEAVGFLLTFEPFLAQHRQ

SEQ ID NO: 798 - protein, 1190 aa, Gossypium hirsutum
MKSTAEAAVAENGRFLGSISTSSLRNLLPKSKLKKSIKKSNSENTPPPDPNIIQINNSAQFSPKSPLSKSLTSDSFVNPSDAHPQIPLSMDSSVKKDMVESEEQNGDLTNLDPSVKVVVRIRPINGQEKEVDRTVTKVSSDSLSVGGRKFTFDSVLDANSSQENVFQLIGVPLVKNALAGYNTSVLSYGQTGSGKTYTMWGPPSAMVEDPSPASHQGIVPRIFQMLFSEIQREQENSDGRQTNYQCRCSFLEIYNEQIGDLLDPTQRNLEIKDDPKNGLYVENLTEEYVSSYEDVTQVLIKGLSSRKVGATTVNSKSSRSHIVFTFFIESWCKGASSKCFSSSKTSRISLIDLAGLDRNKLEDVGRQHLQEGKNVKKSLSQLGYLVNTLAKETQPEKPEDVPYGGSCLTRILRESLGGNAKLTVMCNISADNRNTSEILSTLRFGQRVKAVRNEPVINEISEDDVNGLSDQIRQLKEELIRAKSDAYSSVGSKSGYFKGWNARESLNQLRISLNRSLILPRIDNEYEEEINIGEDDVKELRQQLDYLDSSCETNLRDPLDKRGSIQSSVKESCETDLLSEYDIHCSKETEIEEIDEVEVPPMSSPEPADDLSVTSKTLKAVDPSIRNSISISPHRRSSILEEPTLSESPKIANNLRKSMAVPSALLASQKNVSESSESEVLRELLKYSDHIRSSLRTSKTFLGPTESLAASLQRGRQIIDQHQHSSVPNRSSVAFSFEHLMLKPSPEADKANASVQTLPNDKPSPDGSSTPLFCSSCQRKFDNNHPDEVQDSLKTWIVTVDNQQRDGRNTVEEASKKEKTLESVCKEQAAKIEQLTQLVKKYKLERENSAIEHAPEPLKNEIILFDEQSNNGENGKEYFDMTEKEALLQEIQTLKSKLQSYTASPSPNKSTEILRSSLLSRSIQLRKSVDCRNNSEEELERERQRWMEMESDWISLTDELRMDLESNRCRAEKVEMELKLEKKCTEELDDALSRAVLGHARMVEHYADLQEKYNDLVSKHRAIMEGIAEIKKAAAKAGSKGHGARFAKSLAAELSAIRVEREREKEQLKKENRSLRIQLRDTAEAVHAAGELLVRLREAEQAASIAEENFSNVQQENEKLKKQADKLKRKHKMEMVTMKQYLAESRLPESALQPLYREDSDVAASHNSSAIPYDDQAWRAEFGAIYQEHY

SEQ ID NO: 799 - protein, 296 aa, Gossypium hirsutum
MNTSSKESQPNYPTISPDEYTNPFHQQPHMEPAAATAAAPASTSSSPPPPPPPEQSEKWGTHIMGTPAVPTCHPDNKKAALWGAGDQAQYYHHPYLQYSPVERSSNNPMDSMLQVFNTWSHKAETMANNIWHNLKTGPSVSGAAWGKMNVTAKAISGGGFESLYKQTFATYSNEKLKKSFACYLSTSTGPVAGTLYLSNIHVAFCSDRPLSFTAPSGQETWSYYKIMIPLSKVGIINPVIMRENPSEKYIQIVTVDGHDFWYMGFVNYEKASKHLSESVSSSVATGIAVQPSPVAS

SEQ ID NO: 800 - protein, 202 aa, Gossypium hirsutum
MGIIKLRHQLSSSMESQNLKHRSRDDPRFATTTSNEKNRANRREKRMAMAKRGLRSLVIAVSFPLSLTLLNIYLFGSGRGYASLAKPFWFPPLWLLHTGCLASSFVMGLSAWFVWVEGGFHVKPTALSLYLGYLGLSMAWHPTVLWMGASWAGLLVSLAMVGTLVGCSRDFGKVNPIAGNSVMPCLAWAAFLATVNLKLVFL

SEQ ID NO: 801 - protein, 152 aa, Gossypium hirsutum
MSAVADTLTHWINFPENIEKLMFPSRTHESRDNENKGFSSIPADILDTPKEFIFYLDVPGLSKSDIQVTVEDENTLVIKSGGKRKREEFEEEGCKYIRLERKAPQKLMRKFRLPENANVSAITAKCENGVLTVVVEKLPPPPKPKTVEVAIA

SEQ ID NO: 802 - protein, 63 aa, Gossypium hirsutum
MADKCGNCDCSDKSQCVKKGNSLVIETQESYISTVVAKPLAENDGKCKCGTSCSCTNCTCGSH

SEQ ID NO: 803 - protein, 616 aa, Gossypium hirsutum
MDSDYGIPRELSDLQKLRSQYQPQLPPCLEGTTVRVEFGDTTTSLDPADAHTIARAFPHTYGKPLAHFLRAAAKVPDAQIITEHPAIRVGLVFCGRQSPGGHNVVWGLHKALKIHNPNSTLLGFLGGTQGLFAQKTLEITDDILSTYKNQGGYDLLGRTQDQIRTTEQVKAALAACNDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDITKQICDAVQARAEQDKNHGVILLPEGLIESIPEVYALLKEIHSLLRQNVSADKISSQLSPWASALFEFLPHFIRKQLLLQPESDDSAQLSQIETEKLLAHLVENEINKRLKAGTYKGKKFNAICHFFGYQARGSLPSKFDCDYAYVLGHICYHVLAAGLNGYMATITNLKNPVNKWRCGAAPLPAMMTVKRWSQNPNAASIGKPAIHPATVDLKGKAYEMLRQNATRFLLDDIYRNPGPLQFDGPGADAKAVTLCVEDQDYMGRIKKLQEYLDKVRTIVKPGCSQEVLKAALSVMASVTEVLSVMSSSSSGGQAL

SEQ ID NO: 804 - protein, 417 aa, Gossypium hirsutum
MAEICYGVVSEGEASIPCEPSSRAARRRRMEIRRIKIVDVAPSEADNGRKRKNLQAYGASFSLDCENAVENCASDEDGKKRTVKPKNGRLKTKGTIMKSNSSPSLLIPEIDSELHPKFGVASVCGRRRDMEDAVAIHPSFHRQGQDSAAIGFHYFGVYDGHGCSHVAMRCRERLHELVKEELASEEEWKGAMERSFTRMDKEVIKWNESVDGANCRCELQSPECDTVGSTAVVAIVTPDKVVVANCGDSRAVLCRNGRPVPLSSDHKPDRPDELNRIQEAGGRVIFWDGPRVLGVLAMSRAIGDNYLKPYVSCEPEVTVTDRTAEDECLILASDGLWDVVSNDTACGVARMCLRGKCDVQAPLLSPEGEAVVGSMMGGGEIPDKACADASMLLTKLALARHSTDNVSVVVVDLRRAT

SEQ ID NO: 805 - protein, 290 aa, Gossypium hirsutum
MGANISGGGSIDGDATGPPLRPRLDDIPESCAALILARLNPPEICNLARLNRSFRSASLADFIWESKLPSNYKLIVEKLFVEEDRDLMNLKKKDVYARLTKPIPFDGGTKEIWLDKNTGGVCLSMSSKALTITGIDDRRYWNHISTEESSYRTVAYLQQTWWFEADGELEFQFPAGTYSLFFRLHLGKSSKRLGRRVCNTEHVHGWDIKPVQFQLTTSDGQHVLSRCYLDNPGSWVLYHVGDFIVENSNALTNIKFSSTQIDCTHTKGGLCVDAAFIYPSSARKQVKLCS

SEQ ID NO: 806 - protein, 597 aa, Gossypium hirsutum
MVSDASKKKAAQKKAAAAAKRGGKAAASSKAAAAATAENGVDNASDKVSMLQISDRTCTGVLCSHPLSRDIRIESLSVTFHGHDLIVDSTLELNYGRRYGLLGLNGCGKSTLLTAIGLRELPIPEHMDIYHLTREIEASDMSALQAVISCDEERLKLEKEAEILAAQDDGGGETLERIYERLDALDASTAEKRAAEILFGLGFNKMMQAKKTRDFSGGWRMRIALARALFMNPTILLLDEPTNHLDLEACVWLEENLKRFDRILVVVSHSQDFLNGVCTNIIHMQNKKLKLYTGNYDQYVQTRSELEENQMKQYKWEQEQIASMKEYIARFGHGSAKLARQAQSKEKTLAKMERGGLTEKVVRDKVLVFRFVDVGKLPPPVLQFVEVTFGYTPENLIYKNLDFGVDLDSRIALVGPNGAGKSTLLKLMTGELTPIDGMVRRHNHLRIAQFHQHLAEKLDMEMSALQYMIREYPGNEEEKMRGAIGKFGLSGKAQVMPMKNLSDGQRSRVIFAWLAFRQPHLLLLDEPTNHLDIETIDSLAEALNEWDGGLVLVSHDFRLINQVAEEIWVCENQAATRWEGDIMDFKQHLKSKAGLSD

SEQ ID NO: 807 - protein, 373 aa, Zea mays
MLGVARRRLGSGCVLAQLAQALRPAAAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 808 - protein, 478 aa, Zea mays
MPLALAQLQDLRDRISDRLRPWSRSAQFWVRAADIYTSYKVCQLRAGFVKDEDEREAMWEQQHELGAQKMYSLCSELGGLFLKAAQILGKPDLAPMAWVKRLVTLCDKAPATPFDVVRNVVEKQFRKNFDDIFEFFDVEPVGSASIAQVHRARLKLSNTDVAVKVQHPGAEHLMMVDIRNMQAMALFLQKYDINFDLFSATKEMEKQICYEFDFVREASAMERIREFLRITNKKPPVMVPRVIPGMVTREVLVMEFIKGTPIMNLGNEMARRGIDPSGKIAAMAKQKILSDLTLAYGQMILKDGFFHADPHPGNILICKDTEVALLDYGQVKEMPEDLRLAYANLVVAMADDDFLRAEESFRELGIRTWAISDNKLEELFQLSLRMFDTRLPPGVTVMSPFADDSSLTKIGVESFPEELFSVLRTIQLLRGLTVGMGLTFSCAKHWRSIAEDELLKAGRQSASKSRKQKRSFLRRLFW

SEQ ID NO: 809 - protein, 427 aa, Zea mays
MVNAVATIISTVASTATVVVIIALIRRCRVVRKKMKKKIVKKVLEEIEKKNSEMQGSNAVEDVAIEVGPVETFLNQILNEKPMRFSSEQLAACTRNYSSELGSGGYGVVYKGELPNGLLVAAKVLKVSSMNRKVQEAFMAEIGTIGRTYHVHLVRLYGFCFDASTKALVYEFLENGSLEKYLYGGDEGSTTSMRLEWGTLHGIAVGTAKGIRYLHEECQQRIVHYDIKPANILLTADYTPKVADFGLARLGERENTHMSLTTGGGRGTPGYAAPELWMALPASEKCDVYSFGMVLFEILGRRRNYDPCLEGESKEWFPRWVWEKYEQGEIEHVVSCSCDGIVGGADREKAEIMCKVALWCVQFQPSARPTMSSVVRMLEGEMPIVPPVNPFHYLMESGGGSTISGLWSGTYQSSSRDTAGAELSPVG

SEQ ID NO: 810 - protein, 518 aa, Zea mays
MTAPRALPVPPHTARRAQGRHPRSTPAPPPPPRHHLHPQQQGATASVLGVGVPRAWLSQRTPVLGLRAWVLVAAGAAAAALALFCLAVCLCRRCSRRRAPRLAPCPHRPGASKSLKHRVHAHHQAATMPPLPPPANKDAEEAAARWRPASFEQPPIQAIKAEQKAPLILAEHFANSTSGESTASDQGGSDAEVPEAARRGWGRRYTRREMEEATGGLAAANMVGEGGYGVVFRGVLRDGTAVAIKNLHNNRGQAEKDFRMEVQTIGRVRHKNLVSLLGYCSEGACRMLVYEYMEKSNLDKWLHHDDSETSSLTWDIRMRILLGTARGLAYLHEGLEPKIVHRDIKSSNILLDRQWSAKVSDFGLAKLLCSERSYVTTRVVGTFGYVAPEYAETGMLNERSDVYSFGVLAMEVMTGRTPVDYTRPADEVNLVEWLKRMVADRRVEEVLDPRLPEPPPSKALKRAVLAALRCVDPDGSQRPTMAHVVHMLEDDQILRDEFKLARDLSPRESDSYEREHSR

SEQ ID NO: 811 - protein, 102 aa, Oryza sativa
MAQYYSEVDHCAEEMNRPPHAGGEHYAVRRESYEEVDEMARAGRGHHHGNGGGGGHLGYSGSRHGDAHLGGHREEHLVHGDEHRHGHGGGRQYDSCTGQYYG

SEQ ID NO: 812 - protein, 88 aa, Oryza sativa
MASTKMAVVAILAALLLMAAVEPALATPPSLLPARKLQMPRLMDVVSAESKLACLPAGGFCMFRPMDCCGNCGCLYPVGVCYGSRCEE

SEQ ID NO: 813 - protein, 208 aa, Oryza sativa
MRLLRRKSSMGGGGGGGRALRRVVSLPRSPMALSLAPRASLAKTESIKKRDKNNNKGSKRARLRAGLSAALHLGGGHRRAGRRGGGGDEGAGAVSSAAAPGVAVLLRAAADDADERPAAAAANVGHGGRDHASGGRGRSWAVAVAMVLVLACVVALGRGPAICCCTCAAWWCGGRAVDPACRRRWSSIGGGGGGRHSSVPPQAGCLKH

SEQ ID NO: 814 - protein, 379 aa, Sorghum bicolor
MLLAAEPDDAHEEGENQQLLITTKGGPGLEGLVVGSYCHDVLIRGGRVVGETLGGAAAFVSNVLDAASPQDAALNGTAPFVVVAKVGHDFVYASAPAPARHPPLLCASPTTSFHAQFSETAASAHAPDRELRRVRACDPIYPADLPDRRFAYGLAVGVAGEVLPETLERMIRLCRAVLVDAQALIRAFDSDGAVGHVALDDTPYARLLPRVAFVKASSEEAPYVGVETTRQRCCVIVTEGRDGCRLYWDGGEARVAPFPAVQVDPTGAGDSFLAGFATGLLWGLSATDAALLGNFFGAAAVSQVGVPTFHPKMLQAVKEILEEKTTKRYSPCINGTSFTFEKSNLHNELHAALQEAAMLMSEQQQADKANGNGGDICSP

SEQ ID NO: 815 - protein, 316 aa, Sorghum bicolor
MASRDFLRVFGEGSGSGSPKAANAGAGGQSDDVELSLGLSLGGRFGTDAAAKRPRLARSSSIASVCSVSSLHGDGDGEGDADADPSPAAPLPLLRTTSLPTETEEERWRRREMQSRRRLEARRKRVERRNSSMASLVPAGPKPAAAAADANANAAVGSGRRSNASQGSNSVSTTEQGIGGSAINQSTDARSPSTSDNTNQNSMLPPTKAAEKPLNGTPTEQPRLRTLGSLTTRTSSTSDIRKLMMEDMPMVSSKVEGPNTRRIDGFLYRYKKGEDVRIVCVCHGSFLTPAEFVKHAGGGDVSNPLRHIVVNPAPFS

SEQ ID NO: 816 - protein, 177 aa, Sorghum bicolor
MEAAVATSTRVPPLPLPPTAVRPLLPSGLARSRRGFASISDAGGGGGRVSGGGGGGGGGGGDDSGAGAAAAAAAVAALGEAEQQADGGDSDAIVLHVGGMSCGGCAAKVKRILESQPEVAAATVDVEKATAIVWTTPEAKATKDWQKQLAEKLANHLTSCGFQSHVQDEGEAEQTDS

SEQ ID NO: 817 - protein, 583 aa, Sorghum bicolor
MDQLPKRPANYVPLSPVGFLPRANAVYGDRASVIYGRVRFTWRQTYHRCRRLASALLSLGVRRGDVVSVLAPNVPAMYEMHFAVPMAGAVLNTINTRLDAGAVATILRHSGAKLFFVDYDYVRLASDALRLLAADGTPAVPLVAVIDDIDSPTGARLGELEYEALVAHADPDADLPPLEDEWDAVTLNYTSGTTSAPKGVVYSHRGAYLSTTSLLLQWGVTTEPVYLWTLPMFHCNGWTFTWGMAARGGVNVCIRDARPADIYRAIARHRVTHMCCAPVVFSILLEGQGAGDGAARQLEAPVHVLTGGAPPPAALLERVERIGFKVTHAYGLTEATGPALACEWRGQWDRLPLPERARLKARQGVSVLSLADADVKNAETMVSVPRDGKTVGEIVLRGSSVMKGYLNNPEANENAFRGGWFLTGDVGVVHQDGYIEIKDRSKDVIISGGENICSKEVEEVLFRHPAVADAAVVAMPHPRWGETPCAFVVRRNSAAELSEDDVLAFCRKRMARFMVPKKVQVVGALPRNALGKVEKVKLREAARKLAPTVPAQKPKGKTTTSSTTVGGRREDQPVAHVMAVSRL

SEQ ID NO: 818 - protein, 91 aa, Sorghum bicolor
MAKQQQAVALLMMLVLAAETASAASCNAGQLTVCASAMLSGAAPSAACCSNLKAQQGCLCQFAKNPAYARYVNSPNARKTVASCGVALPRC

SEQ ID NO: 819 - protein, 466 aa, Sorghum bicolor
MAGHAQSWRTYLCCGAGGSAAVEDDSGSTTRRRRITRRRGKDSPRSSSSRMSFTSLSSSEMLSPEDLSLTLSGSNLHAFTYAELRSATAGFSRANYLGCGGFGPVYRGAVGEALRPGLRAQDVAVKYLDLEGGTQGHKEWLAEVFFLGQLRHKNLVKLIGYCYEAKHRMLVYEFMSFGSLENHLFKSVNGALPWMTRMKIAVGAAKGLAFLHNADPPVIYRDFKASNILLDSDYNTKLSDFGLAKDGPQGDETHVTTRVMGTHGYAAPEYILTGHLTAKSDVYSFGVVLLELLAGRQSVDRARRPREQNLVDWARPYLKHPDRLYRVMDPALECQYSCRGAEVAAVVAYKCLSQNPKSRPTMREVVRALEPVLGMDDFFPAGPFVFTISVEEDKVVGVKVEVEEKLPQQHQSHQDRHRQMYPNSSIHAGGIVLHGREGMVGGDDYTATLRRQRRAAAASYHKERGA

SEQ ID NO: 820 - protein, 874 aa, Sorghum bicolor
MGGGRKRGRTQRRHFKQGRENVWKHNPQRPLAGEGGEGREGNPSWQPFATENPSFEEYYKEQQIVPEEEWDSFMSMLRKPLPATFRINASCQFYQDICSQLENDFRKSLETEVTDEHEEDAIRPLPWYPGNLAWHLNFSRMQLRRNQALESFHEFLKRENEVGNITRQEAVSMVPPLFLNVQPDHHILDMCAAPGSKTFQLLEMIHQSTKPGVLPNALVVANDVDVQRCNLLIHQTKRMCTANLIVTNHEAQNFPGCNLAKFCSEVCMDEAKLQRLEFDRVLCDVPCSGDGTVRKAPDMWRKWNAGMGNGLHRLQVEIAMRGMGLLKVGGRMVYSTCSMNPVENEAVVAEILRRCGDSVELLDVSNELPELARRPGLSTWKVRDRGSWFGVHEDVPRYRKHVISPSMFPSGKGSKDSLTVSSSVEVNTDVADADMKDSTDIGEGEQETNITIDDSDNADNLKTKEGTKVDCEFGEVTASSYKKSNSTPIRTEHSDYPLHRCMRIVAHDQNSGAFFIAVLHKLSPLNENQVIDGVKGEQNISKDKTEKLEKDLGSDKASSEENIVHHEVIDNTNVLDGEQNEDRDNKSSKDKSSEDSKVNVNEAEKGQAGTRDRRRQQNQGRWRGVDPVIFFKDEATVKSIVSFYGIMDSFPLEGHLVTRNPDASHVKRIYYVSKSVQDALQLNIKVGERLKITSLGLKIFERQSSKEGSPCTFRLSSEGLPLLLPYITKQILYASAIDFQHLLQYRTIKFPDFVDAKFGEEASALLPGCCVVVLREGHQDIGSIATDPSAIAIVCWKGKTNLCVMVSPLDGKELLERISLRFGLKIPKGDKEKPSEEIAGSDELLDCATEVDDQECFPESKASDIEISDAKDAD

SEQ ID NO: 821 - protein, 171 aa, Sorghum bicolor
MGSQAIEAHRAGAEVYTGAALCAEKSTELLSEVHLPLGLLPLADMEEVGYNRATGFVWLRQKKALTHTFRQIGRQVSYAAEVTAFVEDRRMKRMTGVKTKELLIWVTLSDMFLDKDDQSKITFKTPTGLGRTFPVSAFAKEGDAAAKPKDASAAANGNKEAVAAGKAAASK

SEQ ID NO: 822 - protein, 911 aa, Sorghum bicolor
MSLFAGVGGGAADAASGGGTGRALLELTPHKMAVCHLVQVFAPPAQAGGDVVPPFPFESLAHHNRLGLFLFTLTRSCEDFLEPPLEEFLRQLKAVDDLANGWFCEQLTSSLSALISPDDLFNFFDKLQGVLTASEGASAEDVFLDPNSQLGVFIRCCILAFNSMTFEGVCHLLADLVMYCNSTDASYDLAEDEDFNSEMGNLMDADIGSQVGIFDKFHQGYASERHMGESSSALIRAPMSINDFDDANIFKADGNPTCLRSRWQLEAYLNQQADILEKDPGSVPLNSFNATMTQLQTLAPELHRVQFLQYLNALCHDDYVASLDNLHRYFDYSAGMQGLFGRSVSQVQDIVVGKYESALLCLGNLHCYFGHPKKALEAFAEAVRVSQMNNDDSCLAYVLGAISNLLSKIGISNTVGIITSPYSLGTNIGLGTPLSIQQQLLVLLKRSLKRADALKLPSLLSFDHLLLAKFDLKHVQRPLVSFGPNASTKLRTCPADVIKNLRLGSRVLTDFGADVLSTSNDNGSFSTSWLRNLSATSDSWRRSSKNTKKLHINDFDNFHYHAQPSPVPAPILQLAGSACLLRATAWEHYGSAPMVRMNALVYATCFADAASSSELSLAYVKLIQQLAVFKGYSAAFCALKLAEKKFPSSTSLHIQLLGMQILHERALHRGHLKVAQQICDEFGVLSSSVSGVDIELKTEFSVRRARTLLAAKQFSQAAAVANSLFSTCYKYNMQVENASILLLLAEIHKKSDNAVLGLPYALASQSFCKSFNLDLLEASATLTLAELWLALGSSHAKKALSLVYQSLPMILGHGGLELRARAHIVLAKCHLADPKFSVLEDPEAVLDPLNQATEDLQALEYHEMAAEAYYLKAMAYNHLGKLDEREEAAARFKDHVTALENPQNEEDSLAY

SEQ ID NO: 823 - protein, 329 aa, Sorghum bicolor
MAASHPPTLLLLLLVLAAIAPRPSSARHIITFAPSRAVNPSSLAWDPTAQHFVVAGGGDAVLSVSDAGVTESIVSTGASSVAIDDRRRRLLVASPGSVSAFDLRSPRPHSLIFSTPVPDPAPPGGIAVDPHTGNAFLTVGARIYKLSVEGDLAALASAPALGSDPLASLTAHVSRGFLLVGQPSTGRILRVDMEDGATRTVSCPLTPPTPTAVAVRTDGAVAVGGAAGLRLVVSNDGWVSCGVRDEAAPAPDGPVAAVAVRERRRVYALVEAGATDGGNKWRIEETSWKSESEGEMVVVLVFVGVALAIFMFWRFQMRQLAGNMNKKIR

SEQ ID NO: 824 - protein, 569 aa, Sorghum bicolor
MLVLFETPAGFALFKVFDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGDRANAVNLDFSEILSDEELETQLKEAAVISMGTEVSDLDLLNIKELCDQVLALSEYRAQLYEYLRSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKKGAGALTTPAKTYNPAADLVLGHSTEETPKKSELASKKRKHHEAETAPSAEPEEEAIQEDGDQEGRKKKKKKKNKETEETPAVEADGEKKKKKKSKEDGEPVAALEGEKKKKKKISDADGENVAMQTEASAKKDKKKKKKRHADDE

SEQ ID NO: 825 - protein, 283 aa, Sorghum bicolor
MEDERSTQQHQGGEVQENAAEVKDRGLLDSLLGRKKHEDQDKKQEEELATGMEKVTVAEPEKKEEEHEAAGEKKESLLAKLHRSSSSSSSSSDEEEEVIDENGDIVKRKKKKGLKEKIKEKLPGHHKDHDGDHHTAAVPAPAPVVDAHAHHHQEEEHKPQHFPAPAPPPHVETHVHQHDHGVVVQKVEDDVKTETPPPAPEEEKKGLLDKIKEKLPGGHKKPEDAAAAAPAVHAPAPAPHAEEVSSPDGKEKKGLLGKIMDKIPGYHKGEDHKDAAGEHKTSS

SEQ ID NO: 826 - protein, 250 aa, Sorghum bicolor
MERGDDCQFMVVHQYDEAAQLMHQLMVAAAGDQQDPNAGAAGRGAGGGGGERKRRFTEEQVRSLETTFHARRAKLEPREKAELARELGLQPRQVAIWFQNKRARWRSKQLEHDYAALRARYDALHARVDSLREEKLALAKQVDELRGRLQSVSERQDQSGSCEVNDAADDGKRNLNSTTTTGLVLVQEDDGATPPAAVDASGSEDSAATEYGYDYDYDHVVAYGEGLHDPLCATPDLWDTWPLLEWNAVA

SEQ ID NO: 827 - protein, 172 aa, Sorghum bicolor
MTELFDTAVTSLLHLPEVLDRLAAADGDRRSGGHHAAHHHGHARVHGLGGGGGGAPVDIVETPGEYTFVLDVPGLSKSDIQVTLEEDRVLVMKGGSGKRKREEEEEGEGEGCRYIRLERGATPRSFVRKFRLPEDADTGSVAARCENGVLTVTVKKLPPPEKKTKSVQVTIA

SEQ ID NO: 828 - protein, 674 aa, Sorghum bicolor
MASSLPVHDRLAAAMHGRRLFTVVVLIFALVTPPADAVTAACNSTGGTYTSGSAYDINLSRVVGGLPTNASASPELFATATVGTGGGDNQTVYAIGLCRGDMAADSCLLCLQSSFSDAQGFCPSDMDVSMDYDSCHMRYSGADFLAASTNNSVQQAVFSSFPAVTPSSAAAAFNGLVARLLNATAEYAAANSSRRFATGVMEVDSGYSQGKFSNIFATAQCTPDLTPAQCRGCLAAAMADMPSQVYARNSTGASLVGERCGFRFAPYQFYNGDIMVQLRVGEPPAGKKTATTLVLAIVLAVLGGLCSLTLIIFCHWRKIRSPRKSSLFINVEDIESFESIFISLSVLRSATSNFDEKNKLGEGGFGVVYKGALPDGQEVAVKRLSETTTQGLGQMTNELALLAKLQHRNLVRIVGVCLEEGEHLLVYDYMPNKSLDTIIFDPDKSRQLDWGARFKIINGIARGMQYLHEHSQLKIVHRDLKASNVLLDADMRPKISDFGLAKIFEDDQTRHVTSRIIGTRGYMSPEYAMRGQYSAKLDIFSFGVLVLEIVTGRRNNYAVNSEHSPNLFCLVWKHWVEGTIAQIADPSLGRHYPMAEVLKCINIGLLCVQQSPTDRPSMSAIVVMLSSDTVAVEAPYRPAYVDRSRSYTEMTVELIKEKEELCSPQSSITELMPR

SEQ ID NO: 829 - protein, 753 aa, Sorghum bicolor
MWRLKVAEGAGPWLKSSNNFRGRAVWEFDPELGTPEERAEVERVRREFTERRFEKRESSDLLLRMQYAKHKHLQVDPPPTKLAENVEVTEEIILAALRRALDQHSSLQAEDGCWPADYSGILFIMPLLVFALYTTGSLDTVLSKEHRREICRYIYNHQNEDGGWGKQVLGPSTMFGSCLNYVALRLIGEKPTNAALTKGRQWILSHGSAAAIPQWGKIWFSVMGLYDWSGNNPIVPELWLVPHFLPIHPGRFWVFCRMVYLPMAYLFGRKFIGTITPTILELRDELYSVPYSEVDWEKARDTCAKVDLIYPRTMAQNLVWTCLNKVIEPMLNCWPVNKLRDIALKNIMKHIHYEDETSKYICTCPINKALDMICCWAENPNSDSFKKHLPRIYDMLWIAEDGMKAQVYDGNPTWETSFIVQAYCSTGLVNEIGSTLRKAHEFIKSSQICENHPDYKTYYRHKSKGSWTLSTADNGWSVSDCTAEAVKALMLLSKISPDLVGEPIEGQSLYNAVDCLLSYVNNDGTFSTYECKRTTPLLEVLNPSESFINIVVDYPSVECTSSVLQALIMFRDLDHGYRKEEIGNCIESATKFIEKEQRKDGSWFGSWGVCFTYGSFFAIKGLAASGRTYKNSDTIRKACNFLLSKQLHTGGWGESYLSSETEEYVDASRPHAVNTAWAMLALVYGGQVERDPTPLYKAAKVLINMQLESGDFPQQEHVGCFNSSLYFNYGNYRNLYPIWALGEFRQRLLARKK

SEQ ID NO: 830 - protein, 486 aa, Sorghum bicolor
MVVSPILFLLLGCPTSRAADEELELTVVDVSLLQEPRASCSGHRVMPPHPYNNSWVPLFRPLGPCSPSFKGAAAAAARTKPSLADVLRQDRLRVHHIHRRVSGSSRGARASKGSFKEPVSVEETQLHHQAAISVEVGTSQTSSEPSSGIHPAAATDGSSSPPVTVVLDTAGDVPWMRCVPCTFAQCADYDPTRSSTYSAFPCNSSACKQLGRYANGCDANGQCQYMVVTAGDSFTTSGTYSSDVLTINSGDRVEGFRFGCSQNEQGSFENQADGIMALGRGVQSLMAQTSSTYGDAFSYCLPPTETTKGFFQIGVPIGASYRFVTTPMLKERGGASAAAATLYRALLLAITVDGKELNVPAEVFAAGTVMDSRTIITRLPVTAYGALRAAFRNRMRYRVAPPQEELDTCYDLTGVRYPRLPRIALVFDGNAVVEMDRSGILLNGCLAFASNDDDSSPSILGNVQQQTIQVLHDVGGGRIGFRSAAC

SEQ ID NO: 831 - protein, 472 aa, Sorghum bicolor
MAPAASSPPPHVAVVAFPFSSHAAVMLSFARALAAAAAPFGATLSFLSTASSLAHLRKASGGAGGSAGNGLPMNLRFVEVPDGAPVAAAGETVPVPRQMQLFMAAAEAGGVKAGLEAARVAAGGARVSCVVGDAFVWPAADAAASAGAPWVPVWTAASCALLAHLRTDALREDVGDQAAKMADELLISHPGLARYRVRDLPDGVVSGDFNYVINLLLHRMGQRLPRSAAAVALNAFPGLDPPEVTAALTEILPNCLPFGPYHLLLPKDDGVDTADPHGCLAWLDRHPARGVAYVSFGTVASPRPDELRELAAGLECSGSPFLWSLREDSWPLLPPGFLDRVASAGSGLVVPWAPQVAVLRHPSVGAFVTHAGWASVLEGVSSGVPMACRPFFGDQRMNARSVAHVWGFGAAFEAGMTRDGVAAAVEELLRGEEGARMRARAQELQAAVADAFGPGGACRKNFDKFVQIVCRA

SEQ ID NO: 832 - protein, 445 aa, Sorghum bicolor
MGRRLSASTAAAASAEPLLPRALKRGVLLERCASRADDELQWFRSCLRWVCMDHSSGPAQAALSWLLFLVLAIIVPAAAHFLLAFRASRRPFSAVVQLSLSAASAAGFLCLSSSFRRVGLRRLLHLDKLRGKSDRVRLNYTARLAFSFRLLASLVAPCFAAEAAYKAWWYATSADRVPFFANDVLSDVLACSLEMASWMYRSAVYLLTCVLFRLICHLQGLRLEDFAGSLLEEVEEGRAGVETVLREHLDIRKQLKVISHRFRKFIVAALLIATASQFASVLLTTRRDSVDDLLNTGELALCSVVLMSGLIIILSSAAKITHQAQALTGHTTKWHACCTIEPVLEDGEPGSNQNSMIEQEPESDSDTEYSEETGDEDLLENTKIHMPHAHVISFQKRQALVTYLENNRAGITVFGFTLDRSYLHTIFMLEWTLFLWLLGKTIGFS

SEQ ID NO: 833 - protein, 449 aa, Sorghum bicolor
MASSLPPFTVRRGEPVLVRPSAPTPRETKPLSDIDDAEGMRFYSSGIHLYRANPSKASQDPARVVREALATALVPYYPLAGRLREEPGRKLVVDCAAQGVLFAEADADLTADDFGDVKCPPFPCFERFILESTTVAGVEPVVDRPLLYVQVTRLKCGGFIFGQRICHCVVDAPGAMQFEKAICEFARGATEAPSVTPAWGREMFMARQPPRPSYPHLEYREPACGAEPDRMMTTPPGDMARVPFFFGPREIAGLRQRAPPGMRCSRFELVAACIWRSRAAALEYAPEEEVRLSFIVNARGRREIPLPEGFYGNAFAYSVAAITAGELCGGDLGFALDLVKKAKSAVTYDYLLSVADLMVLTGRPLFALSRTYIVSDVSHAGFKSVDFGWGEAVYGGPAKGGEGPLPGVTNYFSRAKNGKGEECIVVPICLPKDAMEKFLLEVEGLTAEL

SEQ ID NO: 834 - protein, 81 aa, Helianthus annuus
MSSSCCGGNCGCGSGCKCGNGCGGCKMYPEMVSGESTNNETLILGVAPTETGIETTGGVATAAENEGCKCNPCTCNPCTCK

SEQ ID NO: 835 - protein, 199 aa, Gossypium hirsutum
MDSFLLESPNSISSSESSFGSPEFSPFNHNSLPFNENDSEEMLLYGLLTEVKTETSSSTEKGSPTKEKSYRGVRRRPWGKFAAEIRDSTRHGTRVWLGTFESAEAAALAYDQAAFAMRGSAAILNFPVERVRESLEEMKCNQEEGCSPVVALKRTHSMRRKRTSRSKKERDARINNVMVIEDLGADYLEQLLTQTATPY

SEQ ID NO: 836 - DNA, 474 bp, Nicotiana tabacum
tgcggccgctctagtgcactggaaaaccttgttattctatacagtaagaattttggccagatttgtatctggcctggaaaatgttgcatgttgcaagggcaatatctgagaagagtcctggcagcaatatggagaagtataaaatctttgctgctcttgctaaagtctctgtggaaatagacgacaccgattactcgctcattgcgtgcttcaaagctttggccgtgttggagcatttgctggagtgtgatcatcatcatattatcaatctaaacttacaggtacgttttgccttcgagttggaatccatgattggagatgcaaaggctatttcattgttcaagtcacgtatagagaacttgaaaagggcgagtgaagatttgttggctgataatggtgatgatgcatcatttactgaagttggctcagaaaaatcctttccagccaaggaaatacggttccttactgacacat

SEQ ID NO: 837 - DNA, 570 bp, Saccharum officinarum
cggagattcagacatgagaacccaagcgctgttcttcctcacgttcgcccttctcgccgtgctcgcgcaatccagcaacaggcaccaccaccaccaccactcccatgttcaaagcagagggcagggaggaggaggaggaggggagctggcgagccgggggaaggcggcggcgcgagcgtggccgtgctgcgacagctgcggcgggtgcaccaagtcggagccgcggcggtgccagtgcctggacgcagtgccccgcgggtgccacccggcgtgcagggactgcgtcaagtccagcctcagcgccgacccgccggtgtaccagtgcatggaccgcgtccccaacttctgccagcgtcgctgcaccgcgcccgccgctgcgcactgaccgttcggtcggccggccgcccagccgagccgacgactgatttctgcttgctcttgacccaccagccaccaaccggtccaacctttacccacccagcccggcggtggattaggatttttgggtgtgtaaagactaccgagagatgaggaatctgtaatctgattagcgagcaacctaaaccatct

SEQ ID NO: 838 - DNA, 674 bp, Saccharum officinarum
caaccggaagagaacagtagaggagaggaggctcaccagtcgcgagcaattctcgtagagagaagcaatcagagattcagtcattcagacatgagaacccaagtgctgttcttcctcacattcgcccttctcgccgtgctcgcgcaatccagcaacaggcaccaccaccaccaccaccactcccatgttcaaagcagagggcagggagcaggaggagaaggaggaggagggaagctggcgagccggggcaaggcggcggcgcgagcgtggccgtgctgcgacagctgcggcgggtgcacgaagtcggagccgcggcggtgccagtgcttggacgccgtcccccgcgggtgccacccggcgtgcagggactgcgtcaagtccagcctcagcgccgacccgccggtgtaccagtgcatggaccgcgtttccaacttctgccagcgccgctgcactgcgcccgccgccgcgcactgaccggccggccgcccagccgagccgacgactgatttctgcttgctcttgacccaccaaccgctccaaccttttacccacccacccgccggcgggtcctgtgtctcaaggccagctgtggattaggatttttgtgtgtgtaaagactacagagagatgaggaatctgtaatctgatgagcgagcaaccgaacatttcaagcc

SEQ ID NO: 839 - DNA, 1168 bp, Zea mays
agatagataagcaactccagtccaagcaggagcaagaacaacaggaagagtcgaagagaggagagggacaagaacagccagaaagaggagaggaggctcatcaatcgcgactaattctcgcagtcgcagagacaagcaatcatcagacatgagaacccaggcgctgttcttcctcgcactcgcacttctcggcgccgtgctcgcgcagtccagcaacaggcaccaccaccactaccaccacgcccatgtccaaagcaaagggcagggagccggaggaggaggaggggagctggcgagccgggcgaaggcggcggcgcgcgcgtggccgtgctgtgacagctgcggcgggtgcaccagatcggagccgccgcggtgccagtgcctggacgcggcgccccgcgggtgccacccggcctgcagggactgcgtcaagtccagcctcagcgccgacccgccggtgtaccagtgcatggaccgcgtccccaacttctgccagcgccgctgcaccgccgccgccgccgccgccgcgcactgaccgaccgcgcggggcagccgagccagccgacgactggtttctgcttgcagcttggtattattgacccagcaacctttttgcccacccacccacccgctcgcccgcccgccggcgaatcatggcgtctggagcctttgaagccagccgtggattaggatttttgtttgtttgtgtttgtgtagactgtaactgtaaagagagatgaggaatctgtaatctggtgaacgagcaaccaatccgagcttacgttgtccgtctgtggtgtggtgtccttcttcttcttcttgtgttctgttttctttcattcagttacacactttggtaggtagttggcactgctttgctctgtatggctgactcttgttgtctgtgtgagagagatgagcatgatggatcactgagatttaagaaaagagtcaaagagacgtttgcttttcttgccgtctatacgaagctttcgacagggaaggaaacacgccgtcagggtcagattgtcgtggatctttcgtctgggtattttgggagcagtcgagcagaggcagagctcgtgcctgtacaagtggaggatgatgcacctggacgctaatccggcggcaggtcgaggacgaggctgagaagcaggttcatccaccg

SEQ ID NO: 840 - DNA, 779 bp, Panicum virgatum
agcagctcgagtccaaccaaacaacaaccggaagagaagagaaggcaagaagagactcacccgtcgctacgaacaccaattcttgcagagaggaggcatgagaacccaagtgttcttcctcacattcgccttgctcgctgtgctcgggcaatcgagcaacaggcaccaccaccaccaccaccactcccatgttcagagcaaagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgcccactgaccggccggctgagcggacgacaacgagtcgacgactcgttctgattgctactgttgacccaccaactgtccaacccaacccacccacccgcccgcaattcctaccttctgaaggcaagctgtggattatagatttttgtgtgtagagagatgaggaatctgttcatcagatgagcaaaccaaaccaagcttggatttttttttccttttttttttgtcttttgacttgacactgctctgtaattgctggctactactgcttgggctgtgttcagttcccacaaaatttccaaactttctaaacttttcat

SEQ ID NO: 841 - DNA, 445 bp, Setaria italica
caaagcacaaacggaagaggagaggaaagacacccgttgctaacaagaccaattcttgcaaggagaagcagacatgagaacccaagtgttcttcctcacattcgccttgctcgcagtgctcgcgcaatccagcaacaggcaccaccaccactcccatgttcagagcaaagggcatggagggggaggaggaggaggaggagagctagcgagccgggggaaggcggcggcgcgggcatggccgtgctgcgacaactgcggcgggtgcaccaagtcgatcccgccgctgtgccagtgcctggacgcggtgccccgcgggtgccaccctgcctgccaggactgcatcaagtccagcctcagcgccgatccgccggtgtaccagtgcatggaccgcgtccccaacttctgcgaccgccgctgcaccgccgccgccgcccactgaccggcc

SEQ ID NO: 842 - DNA, 818 bp, Panicum virgatum
gcagctcgagtccaaccaaacaacaaccggaagagaagagaaggcaagaagagactcacccgtcgctacgaacaccaattcttgcagagaggaggcatgagaacccaagtgttcttcctcacattcgccttgctcgccgtgctcgggcaatcgagcaacaggcaccaccaccaccaccactcccatgttcagagcaaagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgccgccgcccactgaccggccggctgagcggacgacaacgagtcgacgactcgttctgattgctgctgttgacccaccaactgtccaacccaacccacccacccgcccgcaattcctaccttctgaaggcaagctgtggattatagatttttgtgtgtagagagagatgaggaatctgttcatctgatgagcaaaccaaaccaagcttggatctttttttttcctttttattttgtcttttgacttgacactgctctgtaattgctggctactactgcttgggctgtgttcggttcccacaaaatttccaaactttgtaaattttcatcgcatcaaaacattgaatataacaaatgattcat

SEQ ID NO: 843 - DNA, 1726 bp, Zea mays
agccgcgtacagcagcaagcaaagcaagcaagagatagacaagcagctccagtccaaccaagaacaaacaacaaccgcagcaagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccactcccacgttcaaagcagagggcagggagcagcatcaggaggaggaggaggaggggagctggcgagccgggggaaggcggcggcgcgcgcgtggccgtgctgcgacagctgcggcggctgcaccaggtcggagccacggctgtgccggtgcctggacgcggcgccccgcgggtgccacccggcctgcagggactgcgtcaagtccagcctcagcgccgacccgccggtgtaccagtgcatggaccgcgtccccgacttctgcctgcgccgctgcaccgcgcccgccgccgccgcgcggtgaccaggcgactggtttctgcttgctcttgagtcttgacccacccacccaccaccaaccgctccagcctttcgcccaccccaccgccggcgaatcgtgtcgtctgaactctgagccagctgtggattaggtttttttttgttgttgttgcgtggaaagagaggctgtgagagacgagggatgtgtaatctgatgagcgaacaaccgaccaaaccaaccttggacgctgtcctgtccgtctgtggtgtggtgtggtgtgttgtgttgtcctttttcttgttcttctgttttcttttgtttttaatccgacttcacactgctctgcgctgtatggttgactcttctcgtctgtgaggagacgagcacggtgaatcgccgagactggggaaaagacgcttgcttttcttgcttgccgttcacagcatgagctttgagctttcgacagggaacacgccgcggcttatgctcatcatgttgttgtctggatattttgggaggggagcagagacgctcgtgcctattcatggctgaagatgatgcacctggacgctaatccggcggcaggtcgaggacgaggctggctgagaggcaggttcatccaccgcgggacaccaaggttgctttgctctcactgacccgaggcggccgacaagcttgacaagcacaggcaaagcggtcaggaagtggagtggatgtggaggctccagcagcgaccctacacgcggcgcagatgcgcatttcccacgcggatatgcggcaattgtgcgccgtatctcaagttgcagaggcacgcagggaagaaggaatatcccatcccaattcccaacaagaaactcaacctctgaaccgcttgcatatctctctaacgtgaaggtttctgaacatgtatttcgtcgatacaggtactccatccgattaaggccctgtttgggaataaagtttttgaaaaccacagtttttaaaatactacagtatactttagtcatgacaataccgtagttgacaataccgtagtttacaataccacaattttggaaactgaggtccagacctaagtttagaataccttaaaacaactatagtatttgcaatacttcagttttgaaaacagagattttagccaccttgccaaacaacattctgtatataatactgcagtatttgagaatactgcggtattcttccaaaactgtgaaaaaacttcactccc

SEQ ID NO: 844 - DNA, 1431 bp, Solanum phureja
gaagagaagagaaaagaaagttgatcacgaggagaaagtgagttgtgttgacaaggaattaaattaaaaatggagaaaaatgaagtgatgaagatgaaaagtagtgagagtcaggtgatggacggttcagatataatgaagttagttggaaatgaggctgtgtttagtaactttgtagatcataagtttcaagaacttgacatagacaaagacggtaaactttcagtaaaggagttacaacctgctgttgctgatattggtgttgcccttggtttacctcctcaaggttcttcccctgaatctgatcatatctactctgaggttcttcaagaattcacacatggaaagcaagagaaagtaagcaagactgagtttaaagaggttctttcagatattttactaggcatggctgctggtctaaagcgagatcctattgtactccttcgtatggatggtgaagatcttcttgagttcgttaaaagtcctgcattcgaaccagagatgctttctctgtactctgagttagaattgcctgatggatccctcaaagattacatcatcaaggcttttgagaagcttacagttgatcaagggatgcctcctgcatcagactcatgggtaatgagtaatgtggtggagccagtagttgaatcctgcattggagcatctaatgatcaacctgttacacaagagacatttttggctgaatttaagaaagttgcagagagtgctgctcaacgtctcaaggagcagccagtcattgttgctcatagcgagaacacatttgatggaagtggaattaaaagactattgtctaacaagtttgaattggataagacgctggattctgccttaaagactatacctagagatcgccatgggaaaatgtcaaaggaatacctacgagttgcacttgatgttcttgcaccatcagctggtctacctccaattggtgctgttgaccagatggataaggtcatacaagaagtctgtaagatgttggatgccgatgatgggaagatggttaaagaggaagagttcaagaagttgttgactgaaatactgggcagcatgatgctgcaattagaagggaatccagtttcggtgtccacaaactctgttgtgcacgagcctcttgcttcttcctctacactcttgcagcctccatctatttctgagatgtaactgatcttatggaactagacaaaaaaagaataacaggggatgtatgatgtaaatttctgttaaaattaaaggctgagagatactgtcttactaatacagcatccatttcagcaattaatactgtcatatttcttgaattaaatcagtgtctgtttaaataacttaatcatcaactatggacagagtaatttagtgagtgtaaccatattcaaataaatcatgagcatagactatcatcatatttta

SEQ ID NO: 845 - DNA, 1351 bp, Solanum tuberosum
tgaagttatgaagacgaaaagtagtgagagtcaggtgatggacggttcagatataatgaagttagttggaaatgaggctgtgtttagtaactttgtagatcataagtttcaagaacttgacatagacaaagacggtaaactttcagtaaaggagttacaacctgctgttgctgatattggtgttgcccttggtttacctcctcaaggttcttcccctgaatctgatcatatctactctgaggttcttcaagaattcacacatggaaagcaagagaaagtaagcaagactgagtttaaagaggttctttcagatattttactaggcatggctgctggtctaaagcgagatcctattgtactccttcgtatggatggtgaagatcttcttgagttcgttaaaagtcctgcattcgaaccagagatgctttctctgtactctgagttagaattgcctgatggatccctcaaagattacatcatcaaggcttttgagaagcttacagttgatcaagggatgcctcctgcatcagactcatgggtaatgagtaatgtggtggagccagtagttgaatcctgcattggagcatctaatgatcaacctgttacacaagagacatttttggctgaatttaagaaagttgcagagagtgctgctcaacgtctcaaggagcagccagtcattgttgctcatagcgagaacacatttgatggaagtggaattaaaagactattgtctaacaagtttgaattggataagacgctggattctgccttaaagactatacctagagatcgccatgggaaaatgtcaaaggaatacctacgagttgcacttgatgttcttgcaccatcagctggtctacctccaattggtgctgttgaccagatggataaggtcatacaagaagtctgtaagatgttggatgccgatgatgggaagatggttaaagaggaagagttcaagaagttgttgactgaaatactgggcagcatgatgctgcaattagaagggaatccagtttcggtgtccacaaactctgttgtgcacgagcctcttgcttcttcctctacactcttgcagcctccatctatttctgagatgtaactgatcttatggaactagacaaaaaaagaataacaggggatgtatgatgtaaatttctgttaaaattaaaggctgagagatactgtcttactaatacagcatccatttcagcaattaatactgtcatatttcttgaattaaatcagtgtctgtttaaataacttaatcatcaactatggacagagtaatttagtgagtgtaaccatattcaaataaatcatgagcatagactatcatcatatttta

SEQ ID NO: 846 - DNA, 1306 bp, Nicotiana tabacum
agaaattgcaatatacattgatttgagacacacccttttgaaaaagaaagaaaatctagtcacgagaagtatactagaaagttagaaagtgataaagaaaatggagaaaaatgaagtgatggacggttcagatataatgaagttagttggaaatgaggcagtgtttagtaattttgtagatcataagtttgaagaactggacatagaccaagacggtaagctttctgtaaaggagttacaacctgctgttgctgatattggtgttgctcttggtttacctgctcaaggttcttctcctgaatctgatcatatttactctgaggttcttcaagagttcacacatggaaaacaagagaaagtaagcaagactgagttcaaagaggttctttcagatattctactaggcatggctgctggtctaaagagagatccaattgtacttcttcgtatggatggcgaagaccttgttgagttcgttaaaagtcctgcatttgaaccagaaattctctccatattctctgagatagaattgcctgatggatctcttaaagatcacattatcaaggcttttgagaagcttacagttgatcaagggatgcctcctgcttcagactcatgggtaatgagtaatgttgtggagccagtggttgaatcctgcattggagcatctaatgaacaacctgtttcacaagagacattcttggctgaatttaagaaagttgcagagagtgctgctcaacgtctcaaggagcaaccagtaattgttgctcacagtgaaaatacatttgatggaagtggaattagaagactattgtctaacaagtttgaattggataaggcgctggattctgctgcaaagactgtacccaaagatcgccatgggaaaatgtcaaaggaatacttacgagttgcactcgatctccttgcaccatcagctggcttacctcccattggtgctgttgaccagatggataagatcataattgaagcttgtaagatgttggatgctgatgatgggaagatggttaaagaggaagagttcaagaaattattgacagaagtactggggagcatgatgctgcaattagaaggaaatccagtttcagtggccacaaactcagttgtgcatgagcctcttgcttctgcctctacactcttgcagcctccatctaattctgagatgtaactgatcctatggaactagacgcaaaagaataacaggggatgtattatgtaaatttctgttagaaatgactcagagataatgccttactaatacaggatttatttgagctattaactgtcc

SEQ ID NO: 847 - DNA, 1262 bp, Petunia hybrida
gcgggggaaaagaaagaaaatatagtcacgagaagcatagtaaagaaagtaaaagaaaatggataaaaatgaagtaatggacggttcagatataatgaagttagttggaaatgaggctgtgtttagtaactttgtggatcataagtttgaagaactagacatagacaaagacggtaagctttctgtgaaagagttacaacctgctgttgctgatattggtgttgctcttggtttacctgctcaaggttcttctcctgattctgatcatatatattctgaggttcttcaagagttcactcatggaaaacaagagaaagtaagcaagactgagtttaaagaggttctttcagatattctattaggcatggctgctggtctaaagcgagatccgattgtactccttcgtatggatggtgaagaactccttgagtttgttaaaggtccttcattcgagccagagatgctctccttgttctctgagatacaactacctgatggaatgtccctcaaagattacatcattaaggcttttgagaagctaacagttgatcaagggatgcctcctgcatcagattcatgggtgatgagtaatgttgtggagccagtagttgaatcctgcattggagaatctcagcaacctgtttcacaagagacatttttggctgaatttaagaaaattgcagagagtgctgctcaacgtctcaaggagcagccagtgattgttgctcacactgaaaacacctttgatggtagtggtattagaagactattgtctaacaaatttgaattggataagacgctggaatctgctgtaaagattgtaccccgagatcgccatgggaaaatgtcaaaggaatacctgcgagttgcacttgatcttctggcaccatcagctggcttacctcccattggtgctgttgaccagatggataaggtgataaccgaatcttgtaagatgatggatgctgatgatgggaagatggttaaagaggaagagttcaagaagttattgacagaaatactgggaagcttgatgctgcaattagaaggaaatccagtttcagtgtccacaaactctgttgtgcatgagcctcttgcttctgcatctacactcttgcagcctccatctaattctgagatgtaactgatcttatggaactaaacacaacaataacaggggatgtattaagtaaatttctgtttagaaagacggagaaaatgcgtactatagggatccgtttgacagaagatctctggctact

SEQ ID NO: 848 - DNA, 454 bp, Solanum phureja
acacacaaaaatctcactgaaaaaaatcactatgaagaatacatcaaaaagttccaaaattacccccaaatcaggccaggatgctcggaaggaccggcgatcggccaccggagtaagtggatctccgaagaaaggcggccatggtggaaagtttacttgggccggcgacggaagttattcttctaagaaagaagcagctgatgttgttgttgttgttgatgcaaatgaccctaattttgatgaaccggaagagaatccgattgatgaatcttagatttagatttagattttgaatgatctgaattgttaatgtaaatattaaagaatctggtaatgtttggtgattttatgcagaatttagagagggaaatggaaatgacaaatggaagggaagatctgttatctgtgttgtttaacttttgtttgataaataaaaatgtaatttttccctctc

SEQ ID NO: 849 - DNA, 483 bp, Solanum tuberosum
aaagttccaaaatcacccccaaatcaggccaagatgctcggaaggaccggcgatcggccaccggagtaagtggatctccgaagaaaggcggccatggtggaaagtttacttgggccggcgacggaagttattcttctaagaaagaagaagctgatgttgttgttgttgatgcaaatgaccctaattttgatgaaccggaagagaatccgattgatgaatcttagattttgatttcgaatgatctgaattgttgatgtaaatattaaagaatctggtaatgtttggtgattttatgcagaatttagagagggaaatggaaatgacaaatggaaggggagatctgttatctgtgttgaataacttttatttgataaataaaaatgtagattttccctctcttagtttatagatactgttttgttttattttcaagcatgatatatattgtgtaatgatgaaagtttttaatgaaacgtatgcttt

SEQ ID NO: 850 - DNA, 414 bp, Solanum phureja
aaaaaaagtcactgaagaatacatcaaaaagatccaaaattatccccaaatcaagccaagatgtgaggaaggaccggcgatcggaccccgaaataagtggatctctgaagaaaggcggccatggtggaaagtttacttgggccggcgacggaagttattcttctaagaaagaagaagctgatgttgttgttgttaatgcaaatgaccctaattttgatgaaccggaagagaatccgattgatgaatcttagattttgattatgaatgatctgaattgttaatgtaaatattgaagaatttggtgattttatgcagaatttagagagggaaatggaaatgacaaatggaagggaagatctgttatctgtgttgtttaacttttgtttgataaataaaaatgtaatttttccctct

SEQ ID NO: 851 - DNA, 1724 bp, Solanum phureja
caagaagaaatatttctctcgtgttctctttctccttttccatataatgaaattctccgccctgcctttcactttctctctgcaaatctaacctctctctccgccattgctgtttttggaatctaagctcattttccatggtgatgtaggagccaacttgtgtgccccacggctaatcccacgggttacctgctgcctcccgtcaagagaggtaaaggtaaccttgctcgccaagacttacgcagattgaaggaatccaccccgactctgtgggaattcgtgcaatcgaggttgttactctagctcttagatcactttgccactgggctccgtgactaatttgaaagctgctatcttaaatcagtttggattagcaatgcctccaaaccctagggtcgatcgtgcctttcgttctatgaaagctctcgggatttctggagagaaggtgaagccagtgttgaagaatcttttaagattgtataacaaaaattgggaccttatagaagcggagaactacagggtcctcgccgatgcaatatttgatgatgatgaagcaaaggatgcagaaagtaaaaagtcaactgaggataccgaacaagaggctctggtgcaagatgagcctgaaccacctctgaaaaggcagcgcttaaaaaatcaatcaagtcaaccaaatgagtctcttgaatctcaattgcaaaaccagtcacctagtgtttttgattcccctcagtccatgggcaatgaatcacagcctggatcacgcccatcacttgatagaaacaaaggaaagcagcccatgttttccgactcattagtaccacaggaaggattgccttcatctcagccttctgacgtggacaagagccttccggttcccaggagagctggatctacttctggttctggcatcccagtgtcacctacgaaggatgctattgctaatcacacttttatcaaacctaaggatgagccaatcactgatgacctgccacgtcttgaagttcctgttgccatcatccgcccaggttcatcaagtaaagggaagtcttcagttgcaagcagttcaaaaggtagacaagatgatagtaacgcatcggccactgtagttgaagcagatacaaatgatggaaatccacctagtccaggagtagctaatggcaagcctgaaacaaacacggttaaaccttcttccgccctggagatagcttcctcacaatctggagaggtgaaaattatcttgaactatggctcggttctcggaagatcagatttccacttgcctactcttgatgcagtggtgaagttaatggacgataaatgtctgaaagaatacaaagaacttgatcctaatttttccgtgatgaagatcatgacagacatttgtcagtgcttctgggagatgagcagtgaatcaacaaataaatcatctgacgagtgaacgaaatatgtcctatgaaagcatggagagggaaggaacgagacaagttaactttgcatgacttacattgagctaacaacattttgtgttgagctcaaattgagcttaataacatcttcctagaattctcctgtttctcttttctgtgttcttttatgtatccatttggtattagaactcccttttttcgacgttaagaagttcccttttcagagaggaggaaaatgtgtaaatgtgttggtgaaaaacctgtgttcttgaaaatgaagacatattttcctccttt

SEQ ID NO: 852 - DNA, 1080 bp, Solanum tuberosum
gctcagcgatgacgcactttgtcccactttactaaatttggtcagtgctcaccgaataaccgaaaccccgatcaccttataaaaaaatccaattttccatcccatttgttcatcaaaactcaaaaattgtatctttcgtagtaaatccaacaaacattaatggctactccaagtgtacaacaaattcgtcctgcatctcttgattctacttccgaaccgccagccctgtttgatggaactacaaggttgtatatcagttatatatgcccttttgcacagcgtgcgtggattaccagaaatttcaagggtttgcaagataagatcgaattagttccaattgatcttcagaacaggcctgtttggtacaaggaaaaagtgtaccctcaaaataaggtgccctctctggaacacaaaaacaaagtgattggagaaagtctcgatctggttaaatatatcgacagcaactttgagggtccgtctcttctacctgatgaccctgaaaaacagaagtttgctgaagagttgatagcttacagcgatacgttcctgaaagaaatatatggtaacttcaaaggagatattgagaagcatgctggacctcaatttgactacttagaaaaagctctcgacaaatttgatgacggacctttcttcctaggccaattcagtcaggccgacatagtgtatgctcccttcgttgaaaggttccaaatcttcttgaaagaggtgtttgattatgatatcacatctgggaggccaaaactagcaaaatggatagaggaactgaacaagcttgatagctacattcaaacaaaagctgatcctaaggaagtggtggacttatataagaaaaaatatttggcgtaaaactgaacaaaatgctcgatccatcaacgttgttaaattacgaataaggggtgtttcgtgctcagttcatatcaagaacttgaaggattatgcattagcattaatacataaataaagtggttctatgtttgtttgttatctgagagacttatatcagcatagtaatagctgttgtagcatctcatgtattagaattctgttatgtgtgtgtat

SEQ ID NO: 853 - DNA, 1118 bp, Solanum phureja
gctcagcgatgacgcactttgtcccactttactaaatttggtcagtgctcaccgaataaccgaaaccccgatcaccttataaaaacatccaatttttcatcccatttgttcatcaaaactcaaaaattgtatctttcgtagtaaatccaacaaacattaatggctactccaagtgtacaacaaattcgtcctgcatctcttgattctacttccgaaccgccagccctgtttgatggaactacaaggttgtatatcagttatatatgcccttttgcacagcgtgcgtggattaccagaaatttcaagggtttgcaagataagatcgaattagttccaattgatcttcagaacaggcctgtttggtacaaggaaaaggtttaccctcaaaataaggtgccctctctggaacacaaaaacaaagtgattggagaaagtctcgatctggttaaatatatcgacagcaactttgagggtccgtctcttctacctgatgaccctgaaaaacagaagtttgctgaagagttgatagcttacagcgatacgttcctgaaagaaatatatggtaacttcaaaggagatattgagaagcatgctggacctcaatttgactacttagaaaaagctctcgacaaatttgatgatggacctttcttcctaggccaattcagtcaggccgacatagtgtatgctcccttcgttgaaaggttccaaatcttcttgaaagaggtgtttgattatgatatcacatctgggaggccaaaactagcaaaatggatagaggaactgaacaagcttgatagctacattcaaacaaaagctgatcctaaggaagtggtggacttatataagaaaaaatatttggcgtaaaactgaacaaaatgctcgatccatcaacgttgttaaattacgaataaggggtgcttcgtgctcggttcatgtcaagaacttgaaggattatgcattagtatttatacataaataaagtggttctatgtttgtttgttatctgagagacttatatcagcatagtaatagctgttatagcatctcatgtattagaattctgttatgtgtgtgtatcaagctaagtacataatgaagtattaaagttcataatt

SEQ ID NO: 854 - DNA, 978 bp, Solanum melongena
aacaattgcatttttaatggctacttcaagtgtagaagaaattcgtcctgcatctcttgattctacttccgaacctccgcccctcttcgatggaactaccaggttgtatatcagttatgtatgcccatttgctcagcgtgcatggattatcagaaatgtcaagggtttgcaagataagatcaaattagttccaattgatcttcagaacaggccagattggtacaaggaaaaagtttaccctcaaaataaggtgccttctctagaacacaacaacaaagtgattggagaaagtctcgatctgattaaatatatcgacagcaactttgaggggctatcacttctacctgatgaccctgaaaagcagaagtttgctgaagagttgatagcttacagcaatacattcctgaaagaaatatatggtagctttaaaggagatatcgagaagcaggctggttctcaatttgactacttagaaaaagctctcgacaaatttgaggacggacctttcttccttggtcaattcagtcaggccgacatagcatatgctcccttcattgaaaggttccaaatcttcttgaaagaggtgtttaattatgacatcacatctggaaggccaaaactagcaaaatggatagaggaagtgaacaagcttgatggctacattcagacaaaagctgatcccaaggcagtggtggactcatataagaaaagatttttggcgtaaaactgaataaaaattcgatccatccacgatgttaaatttatgaataagtggcgttccgtgctccgttcatgtcaaggacttgaaggattgtgacataaataaagtggttttctatgtttgtttgttatgtgtgtggattgtaccttggaacctatctattatataatctcatgtatgagaattcagttgtgtgtgtatcaagttaatgaaatattattattcataattaatgttgatttcattgcctcaagaat

SEQ ID NO: 855 - DNA, 1179 bp, Capsicum annuum
gcacgaggatttgtatcttttgttagctgcaattacagtcaaagtaaataagcaacattaatggctactccaagcgtacaagaaattcgtccttcgtctctcctttctacttctgaacccccgtctctgttcgatggaaccaccaggttgtatatcagttatatttgcccgtttgctcagcgtgcgtggattaccagaaatgtcaagggtttacaagataagattgaattagttccaattgatcttcagaacaggcctgcttggtacaaggaaaaagtttaccctcaaaataaggttcccgctctggaacacaacaacaaagtgattggagaaagtctcgatctgattaaatatatcgacagcaactttgaggggccatcccttctacctgatgaccctgaaaaacagaagtttgctgaagagttggtagcttacaccgatacattcctgaaagaaatatatggtagctttaaaggagatgttgagaagcaggctggacctcagtttgactacttagaaaaagctctcgagaaatttgacaatggacctttcttcctaggtcaattcagtcaggccgacatagcgtatgcttccttcattgaaaggttccaaatcttcttgcaagaggtgttcaactatgatatcacatctgggaggccaaaactagcaaaatggatagaggaattgaacaagattgatggctacattcagacaaaagccgatcccaagaaagtggtcgagatatataagagccgctttatggcataaaactgaataacgctcaatccatcaatgttgttgaattacgaataactggtgaacattctgtggcacaaaactgaataacgctcaatccgtcaatgttgttgaattacgaataattggtgttccgtgcttcgttcatgtcaaggacttagagattatatattagtaatacataaataaagtgattctatgtttgttttctatatatatagattgtacttgaaacctgttgcttgtgctggaaacttgtttcagcatactaaaagctgttatatcgtctcatgtaatagaattctgtcgtgtgtggatcaagccacttaaatgaaatattattgttcataattctgtattttgcctcatgggttgattgttttggcattgagccacttatgtacaaggaaaagaataagtaac

SEQ ID NO: 856 - DNA, 1003 bp, Solanum phureja
ccacattctcgtcggaaaagtaagtatgagtgacaatcggagtcaaagacggcgggtcggagagtcgtccgaatcgggaatttacaatgagaggattcttatcttggtgtttgcgtcaatgaattgggatattcgtacactatgtcaaacggcgtcggtcaataggaaactccgtgcagttgcgagaaggattctatggagagagctatgcgtgtatcgagctccgcaaatgataacggcgttaactgacggctctccgagcggtagaattggcggcggatggcaggcgatggcaaaattgatgtttttctgcaatggatgtcaatcgacccggcatttccaagtgcgcgaatcgccatcgggtcacttcgtgaaaacatctcggttttcgaagacatccggtcggagttttttggtgaagaaatgtagaagtgatttgctgtacgtgagtgatccgtgtgagcatccaactgggagcgatgatttggggcttttcagaggggtgttttggggatttatgaaatctaggacaagggcgagtttgatcagaagacgagtggagcttgaagaaggagccaagtgtccattctgtcgagctcgggtttggagtatgacggcggctcggctcatacccaaaagtgcggcgcggcggcttggttcgatggagactggattggagtactttgtatgtgttaatgggcacttatatggtgcttgttggctggttcctttatcgtctgatgaaggtgaagaaaaagatggtgatgatgaagatgaagctgaagatagcagtgaagaagctgaccagagatttgacggcggcggctattttcatcgtgggaatcagatagtaataaatgggtgtctgaattacgggcttacttcttgatatgaccaaaatggaatcaaaagggacgggaagaagggaagagggatcatttttgtagttcagcttgttgtttacttgagaatatgaactgaatcaaaattttctgtttatttg

SEQ ID NO: 857 - DNA, 982 bp, Solanum tuberosum
gagtgaacaatcggagtcaaagacggcgggtcggagagtcatccgaatcggggatttacaatgagaggattcttatcttggtgtttgcgtcaatgaattgggatattcgtacactatgtcaaacggcgtcggtcaataggaaactccgtgcagttgcgagaaggattctatggagagagctatgcgtgtatcgagctccgcaaatgataacggcgttaactgacggctctccgagcggtagaattggcggcggatggcaggcgatggcaaaattgatgtttttctgcaatggatgtcaatcgacccggcatttccaagtgcgcgaatcggcatcgggtcacttcgtgaaaacatctcggttttcgaagacatccggtcggagttttttggtgaagaaatgtagaagtgatttgctgtacgtgagtgatccgtgtgaacatccaactgggagcgatgatttggggcttttcagaggggtattttggggatttatgaaatctaggacaagggcgagtttgatcagaagacgagtggagcttgaagaaggagccaagtgtccattctgccgagctcgggtttggagtatgacggcggctcggctcataccaaaaagtgcggcgcggcggcttggttcgatggagactggattggagtactttgtatgtgttaatgggcacttatatggtgcttgttggctggttcctttatcgtctgatgaaggtgaagaaaaagatggtgatgatgaagatgaagatagcagtgaagaagctgaccagagatttgacggcggcggctattttcatcgtgggaatcagatagtaataaatgggtgtctgaactacgggcttacttcttgatatgaccaaaatggaatcaaaagggacgatgttcaagcaggaagaagggaagagggatcatttttgtagttcagcttgttgttaacttgagaatatgaactgaatcaaaaatttctgtttatttg

SEQ ID NO: 858 - DNA, 604 bp, Pseudoroegneria spicata
  misc_feature (5)..(6): n is a, c, g, or t
  misc_feature (72)..(72): n is a, c, g, or t
  misc_feature (341)..(341): n is a, c, g, or t
  misc_feature (368)..(368): n is a, c, g, or t
  misc_feature (419)..(419): n is a, c, g, or t
  misc_feature (430)..(430): n is a, c, g, or t
  misc_feature (512)..(512): n is a, c, g, or t
ctccnncaaacacagcaaaccaatccagagtcccatcggctatcaatcagtagaaggaagaaccagctgctngatcggggaagaagatgcaggctgcgaaggacaaggtgaaggacggcgcgagcgcggccaaggccaagaccaagatcacgcaggccaaggcggcggagaaggcggaggcggccaccgcgaggtcgcacgcggagcgggagctagcgcacgagcgcggcaaggccaaggtggccgcggcaaagatggagctgcaccaggacaaggcgctccaccgtgaggaggccatcgagcaccgcatccacaagcacggcggccacggccaccaccancacaagcacggcgtcggcatcgtggcngcgcccccgccggcgaccggggccggggcgtactaccctcctcctgccgcnggtggccacgntactaattagctaagcctaagcggctcgttagctagatgggcacatgcgcggcgtgtgtgatgtgatctcgctagctaagcntgtatactttgcactgtttgtgttttgacttacccacgcgagctttttaattttgcacttggttgggagatgagagctgtatctatgcataa

SEQ ID NO: 859 - DNA, 480 bp, Festuca arundinacea
ggcacgaggggccgactgagtgaaagaatcgaagagagacaagaaaggaagaacaggagaggaagctagacaagtgaagaaaatgcaggctgccaaggagaaggtgaaggacggcgtgagcgcggtgaaggccaagaccaagatcacgcgcgccaaggcggaggagaaggcggaggcggcgacggcgaggtcgcacgctgagcgggagctggcgcacgagcgcggcaaggccaaggtcgccgccgccaagatggagctccaccaggacaaggcgctccaccgcgaggaggccatcgagcaccgcatccacaagcacggcgccaccgggtgcctcggcggccacggccacgcccgccacaacaagcatggggtcgtggccgcgcccgctccgccgcctggtgccggggcgtactaccctccggctgccggtgccggccattactaggcagccagcggcatgcaggacatctaagatagacg

SEQ ID NO: 860 - DNA, 1016 bp, Gossypium hirsutum
acgagcggccagtatcaacgcagagtacatgggggtgatggctagaatttacaacggaaaaatgcaaataccaaagagcgttgagaggtgctgccatggctggtggtgcttgcattggaagacaaagagccaccccatttgtcctttcatcttctccattatttttcagggtacgatcccttcattcccattcacatcctctcctaagattcacatcttttcctaaccccaaaactggatttaagtatcagattcgggcaatacaagaggtaactgcagatactgtaaaatcccagaaaggaaaagaagatgatgaacagagttccccacaaaattggaagattaaaatgctttatgatggagattgtccgctttgcatgcgtgaggttgatatgctaagggagagaaataagcaatatggcactatcaagtttgttgacataagttctgatgattattctcctgaagaaaatcaaggattggactacggaagaattcatgccattctctctgatggaactgttgtcacagatgttgaggcatttagaaaattgtatgagcaagttggtcttggatgggtttatgccattaccaaatatgaaccaattgcgacaattgccgattccatctatggtgtttgggcgaaatatcgtcttcaaataactggccggccaccattagaagaggtcttggagacaagaagaaagaaaaaggctgacatatgcaatgacaacaattgcaagatatgaagtttcctattaattgcagataacaggatacttttgtgaaaccttatccttatgatacgaccttaaactctttttaaactttccacattatacaagacaccctattaattgcagatgacaggatacttctgtgaaaccttatccttatgatacgaccttacactgtttttgaactttccaacattatacaagacatgcaattgatctttagcatattagattataaagatatatactttgggaaaaagaaaaagtaccgactgcgac

SEQ ID NO: 861 - DNA, 695 bp, Arnica chamissonis
tcttttgaatatccgtggatcattcgaacaattctttcaccttttttcttaatattcgcaccaaccctaaaacaaataatcctttcgaatcctgaaaccgtcatcgttcttacacttcggttcttaatttcagattccgtgagttgtttgatcgtatttgctaaagtaattcctcggaaaatgaaggaaattgccggaaatcctctgcacctgaagtcgttaaatcacatctcgctcgtatgccggtcggtggaagagtctattgatttctacaccaacgttcttggatttgtcccgatcagaaggcctggatctttcgatttcgacggtgcatggctatttaactacgcaattgggattcatctattgcaatcagaaaaccctaataatatgcccaagaaaaacgagataaatcctaaagacaatcatatttccttccagtgtgagagcatgggagcagtggagaagaagctgaaggagatggggatagcttacaaaagacagagggtagaagaaggtggaatctacgtggatcagttattcttccatgatccagacgggttcatgatcgagatatgcaactgcgataaccttccggtgatcccaatcgccggagaagtggtccgatcatgctcccggctaaacttggatattatctcacagaaacaaatacaaacatttgtgcagctgtaaac

SEQ ID NO: 862 - DNA, 841 bp, Artemisia annua
gttacatatcgtttttttatcgaatcatcaaaactataattttatttctagctttttatctgcatttcatccaaacaaataattatcattttcgttttccttaaatcgtttgtgattttgtccaaaaaaacgttgttgaaaatgaaggacacagctggaaaccctttgcatctaaaatctctgaatcatatctcggttgtttgcaaatctgttgaagaatcgattgatttttatacgaatgttttaggattttttcctattagaaggccaggatcctttgattttgacggtgcatggttgttcaactatggtattggaattcatctcttgcaatcggaaaagcctgataatatgacaaagaaactcgaaattaatcccaaagataatcatatttcttttcagtgtgagagcatgggagcagtggaaaagaagctaaaggaaatgggaataacatacaaaagacaaagggtagaagaaggtggaatatacgtggatcaattattctttcatgatccagatggtttcatgatcgagatatgtaactgtgataatcttccagttatcccactcgctggagaaatggttcggtcatgttctcgtcttaacttagacatcatttctcagaaacaaatacaaacatttgttcaattgtaaacaaaaacaaaaacaaaaaaccaatccaatgtatacattgtttctggttttgttgttgttaagctttatgttttttagttatgtttgtgttttgttctccgttgttttattttttagttaatcagtattgtgaactttaatttggtggtaatcttgtgtggttaatgccatttttatcatttgtttt

SEQ ID NO: 863 - DNA, 820 bp, Helianthus annuus
gggacatcaaccaaccattattccccttcacttcactgccagccatcttttgaatctttgtggatcggtcgaagatttctgtgacccactttgtttaatattcacatcaaccctaataaacaacaatctttctttctgatcttgtttttgatcgtcagaaaataatgaaggaagttgctggaaaccctctgcagttgaagtcgataaaccacatctcgctagtatgccgatcggtcgaagaatctatagatttctatacgaacgttcttggattcgtcccgatcagaaggcctggttcttttgattttgacggtgcatggctgtttaactttggaattgggattcatctattgcaatcagaaaacccggaaaacatgtccaagaaaagcgaaataaaccccaaagataatcatatatccttccagtgtgagagcatggggacagtggagaagaaactgaaggagatggaaatagtttacaagagacaacgagtagaagaaggtggaatctacgtggaccagttattctttcatgatccagatgggttcatgatcgagatatgcaactgtgataacctgccggtcatccctattgccggagaaatggtccgatcatgctcccgggtaaacttagatattattattcctcagaaacaaattcaaacatttgttcagatgtaagcatgtatggtcttatggttatttcattatgtttttggactatggtttgtgttttgtaaggtgtaacctttaaggtcgatttagaggtgttaatgcaaaacccggaaaacatgtccaagaaaagcgaaataaaccccaaa

SEQ ID NO: 864 - DNA, 694 bp, Parthenium argentatum
atcctttttaatctttgtgcatcacttgaagtgttctgtgacaacctttcttattattcgcatcaaccctaacaaacaatagtctttctgatccctgtaattgtagttgttgttttttaaattgtgctcttgttttttattgctttgatcgtcgggaatatgaaggaagttgctggaaatcctctgcagcttaagtcgttaaatcacatctcgctcgtatgccgatcggtcgaagagtccattaacttctatacgaacgttcttggatttgtcccgatcagaaggcctggttcttttgatttcgacggtgcatggctatttaacttcggaattgggattcatctattacaatcagaaaaccctaataatatgtccaagaaaaatgaaataaacccaaaagataatcatatatcttttcagtgtgagagcatggggacagtagagaagaagctgaaggaaatggaaatagtttacaagagacaaagagtggaagaaggtggaatctacgtggaccagttattctttcatgatccagatgggttcatgatcgagatatgcaactgtgataacctgcccgtgatccctatagccggagaaatggtccgatcatgctctcgggtaaacttagatatcattcccaagaaacaaattcaaacattcgtacagatgtaagcctgtacgtatggtccctggt

SEQ ID NO: 865 - DNA, 833 bp, Cynara scolymus
  misc_feature (771)..(771): n is a, c, g, or t
tgttgatcttcctcatcacttgcttaatatccgcattaaatccaacaactgacaccctttccacatcctatcatcgtcgttatctccttaatcggttcttggtctgacatttcgtcgatttcgatcggttttttgcgttttccgttgaaatttgtgttgaaaaatgaaggaaactgctcaaaatcctctgcatctcaagtctttgaatcacatctcgctcgtatgccaatcggtcgaagaatctattgatttctatactaatgttctcggttttgccccaattagaaggcctggatcttttgatttcagcggtgcatggctatttaactacggaatcgggattcatctattgaaatcagaaaatccggataatattccgaagaaaagtgaaataaatcccaaggataatcatatatccttccagtgtgagagcatgggagccgtggagaagaagctgaaggacatgggaatagattacaagagacagagggttgaagaaggtggaatctacgtggatcagttattcttccatgatccagatggattcatgatcgagatatgcaactgtgacaaccttccggtgatccctctcgccggagatatggtccgatcatgctcacgtctcaacttagagatcatttctcagcaacaaatacaaacatttgttcaactgtaagccagtatgatctatcatttcttgtcgtcaatgtattaccttgtaaacttcaagttggattgtagagatttctttgctcttctgtcgttcttcangtttttaagtttattaatcgatttatgtggttttcgagggttcttgaataaatttgttctgg

SEQ ID NO: 866 - DNA, 859 bp, Carthamus tinctorius
cgtgttccaatcttcctaagatcaattctttgctcaatatccgcatcaacaacaaaaccctaaccaatccttatcttcttcttcatcatcatcatcatcatcaattcatcatccttatctcttccatcgtttcttgttttgaaatttcctcaatctctatctctatctctatctcgatctcgatcgattgattggcgtttttgatcaaaatttcgtgttgaaaaaaatgaaggaaactgctgaaaatcctctgcatctgaagtcgttgaatcacatctctctcgtatgccaatcggttgagaaatcgattgatttctacactaatgtcctcggttttgccccgatcagaaggcctggatcgtttgatttcagcggtgcatggctatttaactacggaatcggaattcatctgttgcaatcggaaaatccagatcatgttccgaagaagagtgaaataaaccccaaggataaccatatttccttccagtgtgagagcatgggagccgtggagaagaagctgaaggacatggagataaattacaagaggcagagggtggaagaaggcgggatctacgtggaccagctgttcttccatgatccagacggtttcatgatcgagatttgcaactgcgacaaccttccggtgattcctctcgccggagatatggtccgatcatgctcacgtctcaacttagatatcatttctcagcaacaacagatacaacaaacatttgttcagctgtaagcaaattaaatatggttttatatcttatctgcttcttaattttgcgttcaatgtattaattaatcgctttgtgaaaaacttcaattcggagtgtagagattttctttctgctct

SEQ ID NO: 867 - DNA, 819 bp, Cichorium intybus
ggtgttttatcctttatttccttgtgaatcactcgaagaattctttaatcttcttgattgatattcgtattgcacgcagcaaattttcgttcagggtcctgtaattttcgtcgtcgtcgtcgtttcaatcggttcttttgaatttcgtcaattgttaacattcggtcgagaatatcgtcggaaaatgaaggaaattgctggaaatcctctgcacctcaagtcattgaatcacatctcgctcgtatgccgatcggttgaagaatctatcaatttctatactaacgttctcggattcgtccctatcagaaggcctgggtcttttgatttcgacggtgcatggctattcaactacggaattgggattcatttattgcaatcagaaaaccctgataacatgacgaagaaaagcgaaataaatcccaaagataatcatatttccttccagtgtgaaagcatgggagcggtggagaaaaagctgaaggagatggagatcgtttacaagcgacagagggtggaggaaggtggcatctacgtcgatcagctgttcttccatgatccagatgggttcatgatcgagatttgcaattgcgataacctgccggtgatccctctcgccggagaaatgatccgatcatgctcccggcttaacttagacatcatttcccagcaacaaactacaaagttttgttcagctgtaacccagtgaatcctacgatggtctctggttcattgttgtgatattatattgctttgtaactttcaaagttcatctagtggtttatagttctatggtactatcatatttgtgctaaaaaaaag

SEQ ID NO: 868 - DNA, 640 bp, Arnica chamissonis
gaaaatgaaggaaatcgctggaaatcctctgcacctcaagtcgataaatcacatctcgctcgtatgccgatcggtcgaagaatctattgatttctatacgaatgttcttggatttgtccccatcagaaggcctggttcatttgatttcgacggtgcatggctatttaactacggaattgggattcatctattgcaatcagaaagccctaataacatgcccaataaaaccgaaataaacccaaagataatcatatatctttccagtgtgagagcatgggaacggtggagaagatgctgaaggagatggggatagtttacaagagacagagagtggaagaaggtggaatctacgtggatcagttgttctttcatgatccagatgggttcatgattgagatatgcaactgtgataaccttccggtgatccccatagccggagaagtggtccgatcatgctctcgggtaaacttggatataatttctcagaaacaaatgcaaacatttgttcagatgtaagtagggtcatgattatggtttgtaagttgtgatctttaagttggatttagaggtattgtgtagtgctttgttgtttgtgatttaattatgtgtttagggtgcttaattaaataaattgtatacc

SEQ ID NO: 869 - DNA, 773 bp, Centaurea maculosa
atttatccctttataaacatcacttcttcttgcttaaaatcctcattaataaatccaacaaccaaaaccctaaccaattctatcttcattatcaattcatcatccttatctcttaaattcgttccttactttgaaatttcatcaatcttaatccatcgattgcgttttcgattgcgtttttcgatcgaaaattctcgaaaaaatgaaggaaactggtgaaaatcctctgcatctgaagtcgttgaaccacatctctctcgtatgccaatcggtcgagaaatcgatcgatttctacacgaatgttctcggttttgccccgatcagagggcctggatcgtttgatttcagtggtgcatggctgtttaactacggaatcggaattcatctattacaatcggaaaatccagaggatgttccgaagaaaagcgaaataaatccaaaggataatcatatttccttccagtgcgagagcatgggagccgtggagaagaagctgaaggatatggagataaactacaagaggcagagagtggaagaaggcgggatctacgtggaccagctgttcttccacgatccagacggtttcatgatcgagatttgcaactgcgacaaccttcccgtgattccgctagccggagatatggtccgatcatgctcgcgtctcaacttagatataaacatttctcatcagcaacagatacagacatttgttcagctataagccaaatattgaaatatatatggttaaggttttatcttatctggttcttttt

SEQ ID NO: 870 - DNA, 820 bp, Taraxacum officinale
accgcagagtgcccttacggccggggacggtgttttcattgtttctggatcagttgaaaaatcctttaatcttcttgcttgatatatcatattaccctaacaaattatcctttcgaatcctgtaattgtcatcgtgatctttccaatctgttatttaattgtgtttcatcgattgattgatcgcattccaccgaagattttgccctgaaaatgaaggaagctgcgggaaatcctctgcacctcaagtcgttaaatcacatctcgctcgtatgccggtcggttgaagaatctatcgatttctatacgaacgttcttggatttttcccgatcagaaggcctgggtcttttgatttcgatggtgcatggctgtttaactacggaattgggattcatttattgcaagccgaacgccctgataatttgccgaaaaaacgcgaaataaatccgaaagataatcatatttcgttccagtgtgagagcatgggagcggtggagaagaaattgaaggagatggagatagtttacaagagacagagggtggaggaaggtggaatctacgtggatcaattattcttccatgatccagatggtttcatggtggaaatttgcaactgtgataaccttccggtgatcccgctcgccggagaaatgatccgatcatgctcccggcttaacttagatatcctttcccagaaacaaaatacaaccatttgttcagctgtaacccagtgaaccatatgaatggtctctggtgtgttgttgtgctatcgttttgtaacttttaagttcgatttaaaggtttatagttctatgtgctatc

SEQ ID NO: 871 - DNA, 873 bp, Lactuca sativa
gcggggggtgttttcatcctttctgtaaatcagtcgaagaattctttcatcttttttcttcatatacgtattgccctcaacaaattatcctttcgaatactctgattttcatcgtcatctttccaatttgttcttcagttgaatttgagtttcgtcgattaatcaatcgcattcgctccaaaaatttgtcggaaaatgaaggaaactgctggaaatcctctgcacctcaagtcgttgaatcacatctcgctcgtatgccgctccattgaagaatccatcaatttctatactaatgttctcggatttatcccgatcagaaggcctggatcgtttgatttcgatggtgcatggctgtttaactacggaattgggattcatttattgcaatccgaacaccctgataacatgccgaagaaaaccgaaataaatcccaaagataatcatatttccttccagtgtgagagcatgggagcagtggagaagaagctgaaggagatggagatcgtttacaagagacagagggtggaagaaggtggaatctacgtggatcagttattcttccatgatccagatggattcatggtcgaaatttgcaactgtgataatcttccggtgatctctcttgccggagaaatgatccgatcatgctcccggattaacttagatatcatttcgcagcaacaaagtccaaacatgtgttcagctgtaactcagtgaatcccataaatggtctctgctctgttgttgtagtaatgctttgtaatttctacgttctatttaatggtttatactttatagttctatcaaatatcaatggtgctatctttctgatttcggtgtgtgctctgttttggtgctttatttctatggtta

SEQ ID NO: 872 - DNA, 966 bp, Theobroma cacao
ggcgaagtgccgtgactttctctccttcgtttcctcgttcctagtttatttggtttttctaataaattctgtttctcacatctgtctgttttcttttttttttttatttatattttctcaagaaacctttgccggcgcttcagtggtttgtttgtctttcggattggttgaaacaaatttttgtcgtgaaaaaaggaaaaaaaaagatgaaggaaaatgtggacaaccctcttcaccttaaatctttgaaccatgtctccctcgtgtgtagatcagttgaggaatccatcaatttctatcagaatattcttggttttgttccaatcaggaggcctggatcatttgacttcaatggcgcttggttgtttgggtatgggattgggattcatcttctgcaatctgaggatccagataacatgccaaagaaaaagaaaatcaatcccaaggacaaccacatttctttccagtgtgagagcatgggggcagtggagaagaagctgaaggagatggaactggagtacgttcgggcaatggtggaagaaggtgggatctatgttgaacagctgttcttccatgatccagatgggttcatgattgagatatgcaactgtgataacctacctgtgatccccctggcaggtgagatggttcgatcatgctctcgactcaatctgcaaatgctgcagcatcagcagatacagcgagtggtccagcagtaaagaccagcagtccttttatttaggtgtattttagtcgaaatcatgagaagaagcaccccaatctgctttgtttttgtgtctttttcttttgtctaagtactctacgcatgagtagtttgttttttcttcatttggtttagtaggtttttcttttaaattctgtaataaagacaaggcagatgtgatcccaagggaagtgatcattttatgagctgattttaataaactaaaaatggaatattctcca

SEQ ID NO: 873 - DNA, 970 bp, Theobroma cacao
  misc_feature (554)..(554): n is a, c, g, or t
cggggggcgaagtgccgtgactttctctccttcgtttcctcgttcctagtttatttggtttttctaataaattctgtttctcacatctgtctgttttcttttttttttatttatattttctcaagaaacctttgccggcgcttcagtggtttgtttgtctttcggattggttgaaacaaatttttgtcgtgaaaaaaggaaaaaaaaagatgaaggaaaatgtggacaaccctcttcaccttaaatctttgaaccatgtctccctcgtgtgtagatcagttgaggaatccatcaatttctatcagaatattcttggttttgttccaatcaggaggcctggatcatttgacttcaatggcgcttggttgtttgggtatgggattgggattcatcttctgcaatctgaggatccagataacatgccaaagaaaaagaaaatcaatcccaaggacaaccacatttctttccagtgtgagagcatgggggcagtggagaagaagctgaaggagatggaactggagtacgttcgggcaatggtggaagaaggtgggatntatgttgaacagctgttcttccatgatccagatgggttcatgattgagatatgcaactgtgataacctacctgtgatccccctggcaggtgagatggttcgatcatgctctcgactcaatctgcaaatgctgcagcatcagcagatacagcgagtggtccagcagtaaagaccagcagtccttttatttaggtgtattttagtcgaaatcatgagaagaagcaccccaatctgctttgtttttgtgtctttttcttttgtctaagtactctacgcatgagtagtttgttttttcttcatttggtttagtaggtttttcttttaaattctgtaataaagacaaggcagatgtgatcccaagggaagtgatcattttatgagctgattttaataaactaaaaatggaatattctccga

SEQ ID NO: 874 - DNA, 1129 bp, Ricinus communis
attcactttcgcggttccttttctgcctcaaacatccaatttttcatatttccttttctttctttgatcattttttttcttggtttctttcattttctatctctgattcttgaattaagaaacccattttgattcttttattggagggtgtttttttggtgttaagtttattcttttttcttggaaaatgaaggagaatactggaaaccctcttcatctgaagtccttgaatcacatctctctgttgtgtagatcagttgaggaatctattgatttttatcaaaatgttctagggtttgtgcctataaggagacctggatcttttgactttgatggtgcttggctatttggctttgggattggaattcatttattgcaatcagaagatccagagaacatgccaaagaaaagtgaaattaatcctaaggataatcatatctcttttcagtgcgagagcatgggagcggttgagaagaaactgaaggagatggaaataaagtatgttcgagcaacggtagaagaaggtggtatacatgtagatcaactgttcttccatgacccagatggatttatgattgagatatgcaattgtgacagtcttccagtgatcccacttgctggagagatggcaagatcctgctctcgtgtgaatctacagatgattcagcacaataagcagatgcatcaagtggtccagcagctgtaattaattaaagagagactagctagtagttgaattgaagccagcatattcggtgctgtgtcaattaagaatcatagtggggtcttattatgtgtatgttttccttttgtactttttttttttttttttttggttgggtatgtttggtgggtcttcctgtgcaggtatagcaaataagacaaaagcaaatgtagtgatgatgaaaaaaatatcattgctttcttttatctttagctttttgatcctggaaaatcctccaggaaatccattttcttgatgctccttccagctggtttctagtatttattttgtttttccgttttctatttgatcgagttgcctgtttaaggagcacaactatttgagtgcagttttccctttttcttggtgcccagattttaatttatgaacccttgcattaagaag

SEQ ID NO: 875 - DNA, 897 bp, Euphorbia esula
  misc_feature (6)..(10): n is a, c, g, or t
  misc_feature (421)..(421): n is a, c, g, or t
  misc_feature (439)..(439): n is a, c, g, or t
  misc_feature (733)..(733): n is a, c, g, or t
aatcgnnnnngattcaaatttcagttcttgaatttcggttctttttcaattattttttctctgtttcgcaataagatttttcatcatcgatttctataaacccatttatagaaccacataatttcttgccaattcttattttttttgctgtttatatcaaaatcttgtagaaagaatgaaggacaatatgggaaacccccttcatttgaaatcgttgaatcacatatcgctggtgtgcagatcagttgaagaatccattaatttttatcaaaatgttcttggatttttcccgattaggaggcctggctcgtttaatttcgacggagcttggttgtttgggtttggtatcggaattcatcttttgcaatcagaagatccggagaatttacccaaaaaagttgagattaatccgaaagataancatatttcttttcagtgngagagcatgggagcagtggagaagaagctgaaagagatggagataaagtatgtaagatcaatggtggaggaaggaggaatccacgtggaccagctattcttccacgatccagacggtttcatgattgaaatttgcaactgcgataatcttccggtgattcctctcgccggagaaatggtgaggacttgctcacgtgttaatttgcagatattgcagcacacacagcagatccagcaagtggtccagcagtagtaataatcaatcgtccgtacaatttcagtgcagtttctatcntatgtaatatatactagtatggtcctactactactacggtgatggatcggtgtcgttttatattgttgtaatttgtacctttataagtaaatattaagaaatgcaaatatgatcttattataatagagatgatcatttgcttttcctttggtggtttgtttgtt

SEQ ID NO: 876 - DNA, 653 bp, Gerbera hybrid cultivar
tcctctgcaactcaagtcattgaatcacatctccctcgtttgccgatcaatcgaagaatccattgatttctacaccaacgttctagggttcgtcccggttcaaagacctggatccttcgatttcaatggcgcatggttatttagctacggaatcgggatacatctagtgcaatccgaagatccagataatctgccgaagaaaagcgcgattaatccaaaagacaatcatatttccttccagtgtgagagcatgggagcggtggagaagaagctgaaggagatggagataaaatacaagagacagagagtggaggaaggcgtgatctgcgtggatcagttattcttccatgatccggatgggtttatgatcgagatctgcaactgcgataaccttccggtggttcctctcgccggaaatatggtcaggtcgtgctcccggcttaatctcgatatcatgtcgcagcaacaacagagacacacgattgttcatctgtaagaatctaggaccattaacacacataacatcgctcttttgcattcatgaaatcgtatgagtttttagctttttagggttcttaaatcaactgaatttgttaaggacacgcccttgcgtatgttttactcctttctctcttttcatataatataacgtc

SEQ ID NO: 877 - DNA, 998 bp, Gossypium hirsutum
acgagcggccagtatcaacgcagagtacatggggaccgcacttgccgttttccttggcactctgcatctctaatttgtttggtttttctttttggctaatcattcgctttctgtttctcgcatctttatatttttctccgattcatacacagtcgaaatcttttatctttgtgatttgcaaagaaaagaaaatgaaggaaagtatgggaaaccctcttcacctcaaatctttgaaccacatctcccttgtgtgtagatcagttgaggaatccatgaacttttatcaggatattcttgggtttgctccaatcaggagacctggatcatttgactttaatggggcatggttgtttggatacgggattggaatacatctcctgcaatcggaggatccagagagtttgcccaagaaaaaggaaatcaatcccaaggataatcacatttctttccagtgtgagagcatgggagcagtggagaagaagctgaaggaaatggaactggaatacgtacgggcaatagtggaagaaggtggaatctacgttgaacaactcttcttccatgacccagatgggttcatgatcgagatatgcaactgtgataacctacctgtcgtcccactagccggtgagatgcctcgttcatgctcccgacttaatctgcaacacatgcagcgtcagcagatacagcaagtggttcagcaataggaacgacgaaacaacctcagcctctttcatttaattagctgtttattaatggagatcactagataaaaccaaaccacccaccctatctgctttgtttgtttctgtaatgatccctgtttaagtatgtggttggttttttacttgttttgtaataaagacaatgcaatgtgatcccaagggaagtgatcatttcaattaatttagaagtgggtttcatatatggtcccttttcttgcttgaattgcacaagtctattataatataatgcacaagttgaagtcagtttattcatca

SEQ ID NO: 878 - DNA, 1010 bp, Gossypium hirsutum
gtatcaacgcagagtacatggggaccgcacttgccgttttccttggcactctgcatctctaatttgtttggttttctttttggctaatcattcgctttctgtttctcgcatctttatatttttctccgattcatacacagtcgaaatcttttatctttgtgatttgcaaagaaaagaaaatgaaggaaagtatgggaaaccctcttcacctcaaatctttgaaccacatctcccttgtgtgtagatcagttgaggaatccatgaacttttatcaggatattcttgggtttgctccaatcaggagacctggatcatttgactttaatggggcatggttgtttggatacggaattggaatacatctcctgcaatcggaggatccagagagtttgcccaagaaaaaggaaatcaatcccaaggataatcacatttctttccagtgtgagagcatgggagcagtggagaagaagctgaaggaaatggaactggaatacgtacgggcaatagtggaagaaggtggaatctacgttgaacaactcttcttccatgacccagatgggttcatgatcgagatatgcaactgtgataacctacctgtcgtcccactagccggtgagatgcctcgttcatgctcccgacttaatctgcaacacatgcagcgtcagcagatacagcaagtggttcagcaataggaacgacgaaacaacctcagcctctttcatttaattagctgtttattaatggagatcactagataaaaccaaaccacccaccctatctgctttgtttgtttctgtaatgatccctgtttaagtatgtggttggttttttacttgttttgtaataaagacaatgcaatgtgatcccaagggaagtgatcatttcaattaatttagaagtgggtttcatgtatggtcccttttcttgcttgaattgcacaagtctattataatataatggacaagttgaagccagtttattcatcaaaaaagaaaaaagtaccgactgcg

SEQ ID NO: 879 - DNA, 746 bp, Glycyrrhiza uralensis
gccgtgacaaaacaatctcttctagacttctagtagaatcactaacatcacctttttcatttctctgcctcttctcttcttccttcaattatttctagtcctttttccatttttttgactaccctttttccttaagttttagtctttgttggattaattaacatttccatttttccttgagagaggattattaattttctggggagagaagaaaatgaaggaaagtgtgggaaaccctttgcaccttaagtctgtgaaccatatctccctcatatgcagatcagtggaagaatcaatggacttctaccagaacgttcttggttttttcccaatcaggaggcctggctcttttgattttgatggggcatggctatttgggtacggtattggaattcatttgctacaagcagagaacccagagaagttgccaaggaagaaggaaattaacccaaaggataaccacatatcattccagtgtgagagcatgggggcagtggagaagaagctaaaggagatggagatcgattacgcgagagccacagtagaggaaggtgggattcaggtggaccagttgtttttccatgacccagatgggttcatgatcgagatttgcaattgtgatagcctccctgtgattcccttggtgggtgaggtggcaagatcatgctcgaggttgaatctgcagataatgcagaatcagcagcagatacataagatggttcagtaaatcaatttgtgatttgtga

SEQ ID NO: 880 - DNA, 1157 bp, Fragaria vesca
aaccagacggtttaatttcttctgcttctctctacatttcctcgcccggccccctctgaatctattgcttgtctgcctacccctctccctctccctttcagtctcgctctttgatcataatgaaggagaccctgggaaaccctcttcatctaaaatctctgaaccacatctcacttatctgcagatcagttgaagagtccattgctttttaccaaaatgttcttgggtttgtcccaataagaaggcctggatcttttgattttgatggggcatggttattcgggtatggaatcggaatccatcttttgcagtctgaggagccggaaaagatgcccaagaaaactgagattaatcccaaagataatcacatttcttttcagtgtgagagcatgggagccgtggagaagaagctgaaggagatggagctgaaatataaacgttcgatggtggaggaaggcggtatccacgtcgatcagttgttcttccatgacccggacggcttcatgatcgaaatatgcgactgtgacaacctcccggtgattcctcttgccggcgagatggctcggtcatgttctcttgtaaacctgccgatgttgcagcatcaacagcagatacgagtcacccaacagtagtcggattcttagtgcctatacaagctatagcagcacgttgctgctagtactactccgtctccggccaggctccacttgttttgtgtgaaatctataatatctgtgttttaagtatgagtttttgtaataaaatttagctccattcgagtgcgcaaacattagaggaatcacattttctggggttaattactcgcatgatatggcaaatcgtcgccaattgatgtttaattaacagaaagcgaaatgcggtttcttttagtttatatatattgtggctttaaagtagtgtgtggaatcttttgagctggcttgcattgtgggatgttgaaatcattgtttttttctttcctggatatgtagtttgttttgctcttttatccttttgtttgagttgctacagatggagatggagatgtcatcgtttgttttgaagtgcatggttgattatatttaacgatctttaggttgagacaaatggtgctcgatcaatgatatagtaatatacaattggcttaagatttgtaa

SEQ ID NO: 881 - DNA, 805 bp, Fragaria vesca
  misc_feature (805)..(805): n is a, c, g, or t
taatttcttctgcttctctctacatttcctcgcccggccccctctgaatctattgcttgtctgcctacccctctccctctccctttcagtctcgctctttgatcataatgaaggagaccctgggaaaccctcttcatctaaaatctctgaaccacatctcacttatctgcagatcagttgaagagtccattgctttttaccaaaatgttcttgggtttgtcccaataagaaggcctggatcttttgattttgatggggcatggttattcgggtatggaatcggaatccatcttttgcagtctgaggagccggaaaagatgcccaagaaaactgagattaatcccaaagataatcacatttcttttcagtgtgagagcatgggagccgtggagaagaagctgaaggagatggagctgaaatataaacgttcgatggtggaggaaggcggtatccacgtcgatcagttgttcttccatgacccggacggcttcatgatcgaaatatgcgactgtgacaacctcccggtgattcctcttgccggcgagatggctcggtcatgttctcttgtaaacctgccgatgttgcagcatcaacagcagatacgagtcacccaacagtagtcggattcttagtgcctatacaagctatagcagcacgttgctgctagtactactccgtctccggccaggctccacttgttttgtgtgaaatctataatatctgtgttttaagtatgagtttttgtaataaaatttagctccattcgagtgcgcaaacattagaggaatcacattttctggggttn

SEQ ID NO: 882 - DNA, 1009 bp, Prunus persica
gaatttctagatttttcgtctctccattttggttgtctttttgattcgttttctgatcgtagtttgaagccatatttttttaatcatcatcatcttcaacaccatgaaggaaaccatgggaaaccctcttcatctgaaatctttgaaccacatctcactcatctgccgatcggttgagcaatccattgatttttaccagaatgttcttgggtttgtcccaatcaggaggcctggatcttttaattttgatggtgcatggctatttggatatgggattggaattcatcttttgcaatcggaggacccggagagcatgcccaagaaaactgagattaatcccaaggataatcatatttctttccagtgtgagagcatgggggctgtggagaagaaactcaaggagatggagctcaagtacaagcgagccatggtggaggaaggtggcatccacgttgatcaattgttcttccacgacccggatggcttcatgatcgaaatatgcgactgcgacaacctcccagtgatccctatcgccggggagatagcccggtcatgctccctcgtaaaccggcctatgttgcagcagaagcagcagcagcagctaagattgttgcagcaatagatgtttgtgtcaataagattcatgagaggaagaggaaggaagaaactactactactactactactactactaagtcgatttgtgctctacgtgtcattattatgtggcttttgtaataacactttaattaatgttgagaaatgaaaatcttcatccaaattgaaggtggttgtttttggctctcaagtgtgggaatcttctgagctggcctgcatgtattttgtgttgagttgagttggagatggagagatttgggttgctttgaagagaatacttcaattatatttttatggtgatggcatcatcaggtgttgtgttctgagaggtaggacttggttcctgtcctttttagcaatataatatagtaatattttattgagctgtcgt

SEQ ID NO: 883 - DNA, 518 bp, Solanum tuberosum
caaaatatgaagcagagaagtaattttgttgcaatattcttagtcctttttcttagtgaattgcttgtcacggaggccgtgacatgcagtgttacagagttatttccatgtgccggggcgattatgtcatcacaaccaccctcttcggcatgttgcattaagttgagagagcaaaagccttgtctttgtggatatctcaagaatccaagccttaagcaatatgtcaactctcctaatgcccaaagagttgctaaaacatgtggagtatccactccaagttgttaggattctaacaaataaaaaatattcacaaatgatgatcactcatggatgaccacaaaacgcctttcgttttccacacttcctcgaagtgtatatacactattatctatatatctgtggcaatatattgtaactcgtactcattttatatatgtactcctaagccatgttaggtcttttgagaataatgagtaattgattgatatattaatatatattgaatcatgcttctttta

SEQ ID NO: 884 - DNA, 551 bp, Solanum phureja
ccacctttaccattactcaaatttctccaaaatatgaagcagagaagtaattttgttgcaatattcttagtcctttttcttagtgaattgcttgtcacggaggccgtgacatgcagtgttacagagttatttccatgtgccggggcgattatgtcatcacaaccaccctcttcggcatgttgcattaagttgagagagcaaaagccttgtctttgtggatatctcaagaatccaagccttaagcaatatgtcaactctcctaatgcccaaagagttgctaaaacatgtggagtatccactccaagttgttaggattctaacaaataaaaaatattcacaaatgatgatcactcatggatgaccacaaaacgcctttcgttttccacacttcctcgaagtgtatatacactattatctatatatctgtggcaatatattgtaactcgtactcattttatatatgtactcctaagccatgttaggtcttttgagaataatgagtaattgattgatatattaatatatattgaatcatgcttcttttatcattc

SEQ ID NO: 885 - DNA, 667 bp, Triticum aestivum
cactctccaccgccgccaccgccgccgacgccgacgccggcgagccacgggccatctccgcgcatccttcccctcgccaagaccggaagatccgcgcgcaggagggtctcctctgacagcggtcgccgactccattcagccgccgccgcccccgcccccctccaggtaatattctactgtaccgagcacattgaaagatggttaatgcaatcaaggggttgttcatctcctgtgacataccgatggctcagttcattgttaatatgaatgcgtcaatgcccgcatcggagaagttcatcgtgcacattcttgaccccacacacatgtttatccagcctaatatgggagattacatcaaaagtaagatggcggagttcagagaccagaacagctacgagaagccaacgtgaagggccaccatacattaccgcggtgctagcttcaaactccatccagagatacctatgttgattatcgctatgtagaatggttatatgctgagactgaacattatgtttcactctctcgtgatgttctggaatgacagttctgtagtatcacagagttttgtgtcttatgtatcttcggagtgagcctttagctgataatatttctggtgatgatgatcgtgatgccgtgcgctgaataaagtaccacttcttatgta

SEQ ID NO: 886 - DNA, 668 bp, Triticum aestivum
  misc_feature (657)..(658): n is a, c, g, or t
ggttcctccccagctcgggaatccccttccactggccaccgccaccgccgccgccggcgagccacgcaccttctccgcgcccccatcccctcgccaagacaggaagattcgcgcccaggaggttctcctctgacagcggtcgcgcccgccccctccaggtaatattctactgtaccgagcacattgaaagatggttaatgcaatcaaggggctgttcatctcctgtgatataccaatggctcagttcattgttaatatgaatgcgtcaatgcccgcatcggagaagttcatcgtgcacattcttgaccccacacacatgtttatccagcctaatatgggagattacatcaaaagtaagatggcggagttcagagatcagaacagctacgagaagccaacatgaagggccactatccattaccgcggtgctagcttcaaactccatccagagatacctatgttgattatcgctatgtagaatggttatatgccgagactgaatgttatgtctctctcgtgatgttctggaatgacaattctgtagtatcgcagagttttacgtcttatgtatctttggagtgagcctttagctgataatatttccggtgatgttgatcttgataccttgcactgaataaagtaccacttcttatgtannaaaaaaaaaa

SEQ ID NO: 887 - DNA, 748 bp, Triticum aestivum
  misc_feature (5)..(7): n is a, c, g, or t
  misc_feature (10)..(10): n is a, c, g, or t
  misc_feature (12)..(14): n is a, c, g, or t
  misc_feature (16)..(16): n is a, c, g, or t
  misc_feature (18)..(18): n is a, c, g, or t
  misc_feature (20)..(22): n is a, c, g, or t
  misc_feature (29)..(30): n is a, c, g, or t
  misc_feature (34)..(35): n is a, c, g, or t
  misc_feature (38)..(39): n is a, c, g, or t
  misc_feature (736)..(737): n is a, c, g, or t
gtggnnncgncnnnantntnnntccccgnnctgnnganntcccaagattcccaacccgccgccccccggagtaggccggattcgaactccgccgccgtcgagccgcgtccccgcggagcgccgccttcctctccccaagcccacccggctcccaggtttcccctcacggcggccgctgcatccatccatccatccggaagacgccggcgcggccgccgcgtctcctcctccaggtaatattctactgtacggagcacattgaaagatggttaatgcaatcaaggggttgttcatctcctgtgacataccgatggctcagttcattgttaatatgaatgcgtcaatgcccgcatcagagaagttcatcgtgcacattcttgaccccacacacatgtttatccagcctaatatgggagattacatcaaaagtaagatggcggagttcagagaccagaacagctacgagaagccgacatgaagggccaccatccattaccgcggtgctagcttcaaactccatccagagatacctatgttgattatcgctatgtagaatggttatatgctgagactgaacattatgtttcactctctcgtgatgttctggaatgacagttctgtagtatcacagagttctgcgtcttatgtatcttccgagtgagcctttagctgataatatttctggtgatgttgatcttgataccgtgcactgaataaagtaccacttcttatgtannaaaaaaaaaaa

SEQ ID NO: 888 - DNA, 783 bp, Triticum aestivum
ccgccgccccccggagtaggccggattcgaactccgccgccgtcgagccgcgtccccgcggagcgccgccttcctctccccaagcccacccggctcccaggtttcccctcacggcggccgctgcatccatccatccatccggaagacgccggcgcggccgccgcgtctcctcctccaggtaatattctactgtacggagcacattgaaagatggttaatgcaatcaaggggctgttcatctcctgtgacataccgatggctcagttcattgttaatatgaatgcgtcaatgcccgcatcggagaagttcatcgtgcacattcttgaccccacacacatgtttatccagcctaatatgggagattacatcaaaagtaagatggcggagttcagagaccagaacagctacgagaagccaacatgaagggccaccatccattaccgcggtgctagcttcaaactccatccagagatacctatgttgattatcgctatgtagaatggttatatgctgagactgaacattatgtctctctcgtgatgttctggaatgacagttctgtagtatcacagagttttgcgtcttatgtatcttccgagtgagcctttagctgataatatttctggtgatgttgatcttgataccgtgcactgaataaagtaccacttcttatgtattattaccttgtcaaagatgttccgggtaactaatactgggactcctggatagaccaactagaactttactaacatgctttccaaacccaaaacatgctccccaatg

SEQ ID NO: 889 - DNA, 475 bp, Avena sativa
caggtaatactctactgtccggagcacacaaaagatggttaatgcaatcaaggggttgttcgtctcctgcgatgtaccgatggcccagttcattgtcaatctgaacgcttcaatgcccgcatcagagaggttcatcgtgcacattcttgaccctacgcacatgtttatccagcctcatatgggagaatatatcaaaagtaagatggcggagttcagagaccagaacagctacgagaagccaacatgaagggccatcctataccttgattccagcttcaaactccatctagagaaacctgcactcagttgatttagctatgtggaatggttacatacttgactataatgtctcaaacgtgatgtctgtagtaacacagatcattgtgtcttatgcatcttctgcgtgagcctttatacctgataatgtattcggtggtgctggtatgggtactgtggagaatatagtgccaatttt

SEQ ID NO: 890 - DNA, 716 bp, Brachypodium distachyon
atgggtctgatagcactgggccgaaacaaatggacttcctctacctatggcccatcagcatcaacatcagcccgtcttctccttcttctattctgcccaacaccggccgccgctctccgtcgacaccgccgccgccggttactttctctccgtcgccgatccttcgcgcagccctcgtctcctcgtcgccaacgcttcctcgtgcagccaggtactggaacaaagatggttaatgcaatcaagggtttgttcatctcctgtgacgtgccgatggcgcagttcatcgtcaatctgaatgcatcgatgcccgcgtccgagaagttcatcgtgcacatgcttgacccgacgcacatgtttgtccagcctcatgtgggggagatgatcaggagtaagattgcggagttcagagaccagaacagctacgagaagccgacatgaaggatcgtgttatactgcggttcacagcttcatactccgtccagagatgctctacatttgtgtttgggtttgtagctgtgtggattggttagagtcttaataccatgtcgcattttcgtgatgctcttggatgataattctgtagcatgagagagtgttatgttttatgcgccttctcagaattcctttgatctgataagatatctggtggtgttgatactttgatactgtgaagagaataaacatatcttcttatgaattactcttcccacgttgtt

SEQ ID NO: 891 - DNA, 736 bp, Oryza sativa
atccaaacaagaccagcaggttggtcggaaccctatgcctgacctccgcctccgatcctccgccctgagccgcgcgccgccgccgccgccgctgcaggctccttgttcctcgccggtttgctcgtatcgctccgtacaacgacgcaccggtgctagagaagacaacagcacagggaggcgacaaaggtggcattctgttctccaaagagcagaaaacatggttaatgcaataaaggggttgttcatctcctgcgatgtaccgatggcacagttcattgttaatctgaatgcttcaatgcccgcttcggacaagttcatcctgcacatgcttgacccgacacacatgtttgtgcagcctcatgtggcggagatgatcagaagtaagatttcagagttcagagaccaaaacagctacgagaagccaacatgaaagatcactctaccccacaattcctgtgtgtgcaccattgaaaagataccaacgcttgtctatggtttatagtttttctttagatagtctatggtttagtatagttgtgtgtgatgtgacttgtgagcgtcatgtgccactcatcaatcatgatgatgttcaagaatgataaacttgcagtatcagaaaatgttgtggcttatgacttatttgtcttcagtgatagtattaatcacctgtccatttggtagcgttggaacattgagagacagcctatttctgaagaatcagttaactttatgtgta

SEQ ID NO: 892 - DNA, 509 bp, Saccharum officinarum
ccgctggcagacttcgaagaacggcagccgccagcctgccaggcgacctctgttgattctggttctaccgaaggagaacaagggcaggcagctaccgtcaaaaggagacgaaaaagggccggcagattggattgagcacagacaagatggtgaatgctatcaaggggttgttcatctcctgtgatgtaccaatggcacagttcattgttaatctgaatgcttcgatgcctgcatcagacaggttcatcgtgcacatgcttgatcccacacacatgtttgttcagcctcatgtggcagagatgatcagaagcaagatagctgagttcagggatcagaacagttatgagaagcctcagtaaagcatcaccctaccctgcatttccattgtcgctcaccatatgtataattgttatggaatagatggatggcattcttccttccccttccccttccccttctcctggagaagatctatttgcatattgcattatatatgctgggagcctgtg

SEQ ID NO: 893 - DNA, 767 bp, Citrus clementina
aaaaaattaaaaataatgagttttcggagcaatccttgattctcaccatctttctcggaacgacggtctccccctctgttttcaggttcttcctctatttcttttcgagtagccgccacagcctgaacgccgtagactgtagccacggctgctcgcaccgtgctacactgccaccgtcgcaccattcaggctcctaagcttgctgattcattatggtgaacgccattaaaggactgtttatttcctgtgacatacccatggcacaattcatcatcaatatgaatgcttcaatgccacaatcacagaagttcataatacatattctggatagtactcacctctttgtgcaaccgaatatggctgaaatgatacggagtgcaattgctgagtttagagaccagaattcttatgagaagcctgcatgactccattttttttttccccctcttatttctattcgcagtcttacgtgaaagatgtaatggtgttgaaaactgtctcatctttgatggttagttctacagggcaatcagtttacttctctgtaaaacgaaccagactctccaacaacatacttggaaagttattcgctgattaatactggcctgcaaattggactatgatgagctgctaatgttgagctgcaattattttaggcttttgccttttagcatccaccgtacgctattttctgcattttcaacacttttacagctgtcgtgcaagcgtttgttttcgtatcgagtaatgctattcgttacatcata

SEQ ID NO: 894 - DNA, 770 bp, Citrus sinensis
aaaaaattaaaaataatgagttttcggagcaatccttgattctcaccatctttctcggaacgacggtctccccctctgttttcaggttcttcctctatttcttttcgagtagccgccacagcctgaacgccgtagactgtagccacggctgctcgcaccgtgctacactgccaccgtcgcaccattcaggctcctaagcttgctgattcattatggtgaacgccattaaaggactgtttatttcctgtgacatacccatggcacaattcatcatcaatatgaatgcttcaatgccacaatcacagaagttcataatacatattctggatagtactcacctctttgtgcaaccgaatatggctgaaatgatacggagtgcaattgctgagtttagagaccagaattcttatgagaagcctgcatgactccatttttttttttttccctcttatttatattcgcagtcttacgtgaaagatgtaatggtgttgaaaactgtgtctcatctttgatggttagttctacagggcaatcagtttacttctctgtaaaacgaaccggactttccaacaacatacttggaaagttattctctgattaatactggcctgcaaattggactatgatgagctgctaatgttgagctgcaattattttaggcttttgccttttagcatccattgtgcgctattttctgcattttcaacacttctacagctgtcgtgcaagcgtttgtattcgtatcgagtaatgctattcgttacatcata

SEQ ID NO: 895 - DNA, 782 bp, Citrus sinensis
ggacactgacatggactgaaggagtagaaaaaaaattaaaaataatgagttttcggagcaatccttgattctcaccatctttctcaaaacgacggtctccccctctgttttcaggttcttcctctatttcttttcgagtagccgccacagcctgcaagccgtagactgtagccaccgctgctcgcaccgtgctacactgccaccgtcgcatcattcaggctcctaagcttgctgattcattatggtgaacgccattaaaggactgtttatttcctgtgacatacccatggcacaattcatcatcaatatgaatgcttcaatgccacagtcacagaagtttataatacatattctggataatacccacctctttgtgcaaccgaatatggctgaaatgatacggagtgcaattgctgagtttagagaccagaattcgtatgagaagcctgcatgactccatttttttttatttctcttcgcagagtcttatgtgaaagatgtaatggtgttgaaaactttgtctcatctttgatagttagttctacagggcaatcagcttacttctctgtaaaacgagccagactttccaacgacatgcttagacagtgattaatactggcctgcaaattggactatgatgagctgctaatgttgagctgcaattattttaggcttttgccttttagcatccattgtgcgctattttctgcattttcaacacttctacagctgtcgtgcaagcgtttgtagtcgtatcgagtaatgctattcgttacatcata

SEQ ID NO: 896 - DNA, 1168 bp, Citrus sinensis
  misc_feature (1048)..(1048): n is a, c, g, or t
ggacactgacatggactgaaggagtacgaaaattgagttttcggagcaatccttgattctcaccatctttctcggaacgacggtctccccctctgttttcaggttcttcctctatttcttttcgagtagccgccacagcctgaacgccgtagactgtagccacggctgctcgcaccgtgctacactgccaccgtcgcaccagttagttcgaatttttgctggcatcaagctctttttttttttttttaaatttttgggtatatttcgaattatttgttgttaacttgttccgtatgattgtattaatacggttttcgtttatgttgaatgggattgaaaagataacaaatttgtgaattcttgataattaatatctgctgattttttccggatccggagcgagaatgcatccggatttcgccatcactatttaaaattatgaagcataacctttgtctgtttggcaagctgttgtcgaagatccttgttttctattactgttatatgttcttttcaagtgtttaccgattagtgttttttgtatgattaaatttaaattaaaaaaagtatgcgttacatatatacatcatttagatacatgtaccagaatctaaatattgttttacatgtcaaatctttccgcattctaattgggtggactgttcatgcattcgatcagtaactatgctctgatttgcaattgcatttgcctttgcagttcaggctcctaagcttgctgattcattatggtgaacgccattaaaggactgtttatttcctgtgacatacccatggcacaattcatcatcaatatgaatgcttcaatgccacaatcacagaagttcataatacatattctggatagtactcacctctttgtgcaaccgaatatggctgaaatgatacggagtgcaattgctgagtttagagaccagaattcttatgagaagcctgcatgactccattttttttttccccctcttatttctattcgcagtcttacgtgaaagatgtaatggtgtgtgaaaactgtctcatctttgatggngtagttctacagggcaatcagtttacttctttgtaaaacgaaccaaactctccaacaacatacttggaaaggtattccctgattaatactggcctgcaaattggactatgatgagctgct

SEQ ID NO: 897 - DNA, 596 bp, Cynodon dactylon
gaaggcgacggaggagcggcggcgccggcgaccgagagagcgacggaggcggcctgcttcgtgctggagaggggggagtgcagcggaaggaggaggacgcgggtccaggagatccgtacccaaaggaaggggtggccggatccgaccagcggcgggcagtgaacagcggtaatcctctcttgaagagagctcaaagaaaatggtcaatgcaatcaagggcctgtttatctcctgtgatataccaatggcacaattcattgtcaatctgaatgcctctatggggggaggagagaggttcatcgtgcacatgcttgatccaacacacatgtttgttcaaccccatgtgggagatttcatcagaagtaagatagcagaattccgggaccaaaatagttacgagaagccacaaggataattctaattccatgctgcatttccattgtcaccctccaatcaaagttatctttggcccatatctttgtagagcttttataggttggatggatgctatgtctcagtcgtgatactgtactaataagaagcatcttgtaacagaaaatgctgtgatttgtactgtcctccaactcttgagtgac

SEQ ID NO: 898 - DNA, 767 bp, Oryza sativa
ggtaataggagatccacgcttttaggtttggatgataagctgagggagaagagtaagaggataagccgatcggattctcacaggttcaaccagctgcttgagggcatcgatggggtacagcaagctcaacatactactgcaagtcttgacacttgtgagcattctcctccgctccttgcgccgccgggacgagtcgtggccggcgatctccatcgggcgagcagagcaggggagaggatcatggtggcattctgttctccaaagagcagaaacatggttaatgcaataaaggggttgttcatctcctgcgatgtaccgatggcacagttcattgttaatctgaatgcttcaatgcccgcttcggacaagttcatcctgcacatgcttgaccctacacacatgtttgtgcagcctcatgtggcggagatgatcagaggtaagatatcagagttcagagaccaaaacagctacgagaagccaacatgaaagatcattctaccccacagtaagatatcctgtgtgtacaccactgaaaagataccaacgcttgtctatggtttataatcgtgtgtgatgtgagcttcatgtgccactcatcaatcatgatgatgttcaagaatgataaacttgcagtatcagaaaatgttgtggcttatgacttaatgtgttttcagtgataataatcacctgtccatttggtagcgttggagcattgagagacagcatatttctgaagaatcagttaactttatgtgtattcatcttcc

SEQ ID NO: 899 - DNA, 796 bp, Panicum virgatum
ggcctcaagttcatctcttcctcttcctctcccttctctcggactctctcgatccttgctcctctttccccttgcggcgacgactgggcgagcggcggcgccatttgttacgtcttcgtccagcccctttgccggcggcgagcatcctccaggtaattttcttgtctgtagcatagacaagatggttaatgcgatcaaggggttgttcatctcctgtgatatacctatggcacagtttattgttaatctgaatgcttcaatgccggcatcagagaggttcatcgtgcacatgctcgatcctacacacatgtttgttcagccccatgtggcagaaatgatcagaagcaagataggggagttcagggaccagaatagctacgagaagccgcagtgaaggatcatcccacctcgcagtttgcattgtttccctccctcccaaagatgcataccttgcactcaaatctgcgcaactgctatagaatggttggttggatggcattgccatgcctcaccctgtcacccgtgatgatctagaataatgtatgtattcgtgtttctagtctcagaagcagctgtatttcagtgacttatttgtatccggattgatccttttatctggccctttgccacttggcaacgcacttggtggcgccgataaattgaaagtgcgttgcctgcttaggaaagggtaagatgtcttgcatgtattgctgttgtggactcgactctgatgtttgtgagctttttatgagtcgatggttccgtgaaataaaataagtagcactattgtcgtcgt

SEQ ID NO: 900 - DNA, 646 bp, Panicum virgatum
actccctccaggttcatctccttccccactttcccttctctcggactctctcctcccttgctcctcctttcctaccggcgacgactgggcgagcggcggcgccatttgtcacgtcttcccccagccctttgccggcgacgcgcatcctccaggtaattttcttttctgtatagcacagacaagatggtcaatgcgatcaaggggctgttcatctcctgtgatatacctatggcacagttcattgttaatctgaatgcctcaatgccggcatcagagaggttcatcgtgcacatgcttgatcctacacacatgtttgttcagcctcatgtggcagaaatgatcagaagcaagataggggagttcagggaccagaacagctacgagaagccgcagtgaaggatcagtccacctcgcagtttgcattgtttcccctccctcccaaagatgcataccttgcactcaattctgcggaactgctatagaatggatcacccgtaatgatctagaataatatgtatgtatccgtgtttttagtatcagaagctgctgtattccagtagcttatttgtatccggatcgatccttttacctggccctttgccacttggcaacgctgataaattgaagtgcagctggttgcctactt

SEQ ID NO: 901 - DNA, 706 bp, Panicum virgatum
  misc_feature (69)..(69): n is a, c, g, or t
  misc_feature (405)..(405): n is a, c, g, or t
  misc_feature (572)..(572): n is a, c, g, or t
ggccgagaagggtgccagctgccttcagccttggtgttggatccgattccggagccaggggctgaaacnggcgacgcacccgcagtggacgccagatctcgggcagggtcgccaacgctgagcagcggtgaggtaattttcttgtccaacagacaagatggttaatgcaatcaaggggttgttcatctcctgtgatatacctatggcgcagttcattgttaatctgaatgcctcaatgccggcatcagagaggttcatcgtgcacatgcttgatcctacccacatgtttgttcagcctcacgtggcagaaatgatcaggagcaagataggggagttcagggaccagaacagctatgagaagccacagtgaaggatcatcccacctcacaatttgcattgtttccntccctcccaaagctggatacctcgcactcatatctgcaggaactgccatacaatggttgcttggatggcattgccatgcctcgcccatgatgatctagaataatatttattcaccttcatttgtctaaaaaaaaactggtgtatttcggtggcttgcttttgtatcnggattgagtatttttactcgtcctctccacttggtggcatcgataaactgaagcttcaattggttgtgaagatatgggattggtccaaacgattttcttctgaaacaaaaaacaataatgatttggtgttggat

SEQ ID NO: 902 - DNA, 3280 bp, Brachypodium distachyon
gcggcggcgggcggggcgccatgaacgtgttcgcgggggtcggcgcgggggcgaaggagggaggacccgcgcgcggcggcggtggggtgctgctggagctgacgccgcacaagatggcgctgtgccacctcgtgcaggtcttcgcaccgtcggggcagcaggcgcaggcgggcccgccgttcccgttcgagtccgtcgcccaccacaaccgcctcgggctcttcctcttctccctcacccgctcatgcgaggattttctggaaccgccattggacgagcttttaaggcagttgaaggcggtagatgatttagctaatggttggctctgtgatcagctgacaactacactgacagggcttaactcaccagatgatctgttcaacttttttgataaactaagaggtgttctcacttcaccggacggtgcaaatgtggaagatgaatttctggaccctaatagccagcttggtgttttccttcgttgctgtatacttgccttcaattcaatgactttcgagggtgtctgccatctgttagcaaatcttgtggtgtactgtagctctgctgacacttcatatgatttggcagaagacgaggactttaacagtgaaatggaaatgagcgacctgatggatgcagatataggtgttagtgctggcatgtttgacaaatacagtcaaggttatgccactgagagccatatgggagagagctcttcatctctaatccatgcaccaaccacactccataattttgatgaagccaatattttcaaagcagatgataacccaacttgtctgagatcaaggtggcaattagaggcatatcttaaccagcaagctgatattcttgagaaggatcccagctcagtgcctttgaattcatttaatgccactatgacgcagcttcagacgttagccccagagcttcatcgttctcaattcttttggtttatttcttacccttgttctatctgtcaggtccaattcttgcaatacttgaatgctgttagccatgatgactatgttgcatcgctagacaatcttcaccgctattttgattacagtgcagggatgcaaggactttttagtcgttctttgtctcaattccaagatgttattgttggaaagtatgagagtgctcttctttgcttaggcaacttgcattgccacttcggacatccgaagaaagccctagaggcattcacagaagcagtgcgtgtttctcaaatgaacaatgatgattcatgccttgcatatatattaggagccatttccaatctgctgtcaaagataggaatatcaaacgcagttggaataattggttcgccatattcacttggaaacaatattggactaggcactccattgtccattcagcagcagttgcttgttcttttgaagcgatcgcttaagagagctgatatgttgaaacttacaagcttactatccttcaatcacatctctcttgcaaaatttaatctgaagcatgtccaaaggccattggtatcctttggccctaatgcttctacaaagcttagaacatgtcctgcagatgtcttcaagaacttgagattaagttcccacgtattgtctgactttggcacggatggtttatcaacttcaaatgataatggtagttttagtacctcctggcttaggaatctgtctgctgcttccagttcttggtgtagcagctcgacaaaatctagaaaactgcttacaaacgacttcgataatttccactttcatgcacaaccaagcccaatacccacatcagtattgcaattagctggctcaacatatttgatgagggccactgcctgggagcactatggaagtgctccgatggttcgaatgaatgctttggtctatgcaacctgctttgctgatgctgcaagttcatcagagctgtcacttgcatatgtcaagctaattcaacaacaagcagtcttcaaaggatattcagcggcgttctgtgctctcaaactcaccgaagagaagttcccatcctcaacaaattcaaacatccagcttctcagaatgcaattgctacatgagcgtgccctgcatcgaggacacctgagagttgcgcaacaaatttgcgatgaatttggggtgctctcatcttctgtcagtggagtagacattgaactaaagactgaagctagtctacgacgtgcccgcacactacttgccgcaaaacagtttagccaggcagcaattgtggcacacactcttttctctacatgctacaagtacaacatgcaagtagagaatgcaagtgttcttttattacttgctgaaatacataaaaaatctgacaatgcagtacttgggctaccttacgcattagccagccaatcgttctgcaaatcatttaacttggatctgctcgaagcttcagccacacttacccttgctgaactgtggttagctcttggaccaagccatgtgaagagggccttgagtcttgtttatcaaagccttcctatgattcttggccatggtggtctagagctgcgtgctcgagctcagatagtcttagcaaaatgccatttaactgatccagaatttacagtttctgaagatccttgtgctgttctggatcctctaaaccaagcggccgaagatctgcaggttttagagtaccacgagatggcagcagaggcgtactatctgaaggcgatgacatataaccatctgggcaaggaagtcgagagggaggaagccgcggcttgcttcaaggagcacgtcaccgctcttgagaacccgcacaacgaggatgtttcactcgcttactgaggttgcagagtcaaggagtagattgcaagatgcatccttgtatggcggatactgacaggccgacacgactaggcaacaaagttagtgtgaccccttcctgacttgctttgcaaggccgcctcgttgataactcaacgtgcagactggctgaagcttagcacggttcatcagaagggcgacatgctacacagactctatgagaacatgtgtcgctagctgagtcatggccggcattgatgtgttcgtgttacaagttcaggagattattcagttttgcttcatgatggagaatcaatgtagtaaggaatattacatgctcatgtgttaattgttgtaattttaaatcggtttctctcgactgaatgtatatctgccattcttgcaaaacaatggttaactagctaaaacttttgacatcgtctgatgtaaaagcgaacgcctttcaggtgatgcatcataccatgccaataactgaa

SEQ ID NO: 903 - DNA, 3436 bp, Oryza sativa
aatccccgcaaaaagccatagacattttgctccgtcgcgagccaagcgaattcaaaaccctcgtctccggcggcggcggcgacggcgaggcggcggagatgaacgtgttcgcgggggtgggcgggggcgcggcggggaaggaggcggggacggtgggcggcggggcgctgctggagctgacgccgcacaagctggcgctgtgccacctcgtgcaggtgttcgcgccgccgccgcaggccggggtctcggcccccgcgctgcccttccccttcgagtccgtcgcccaccacaaccgcctcggcctcttcctcttcgccctcacccgctcgtgcgaggattttcgggaacctccactggaagagcttctaaggcagctgaaggcagttgatgctttggttaatggctggctctgtgagcagcttacaagtaccctttcagcgcttacttcaccggatgatctgttcaacttctttgataagctacgaggcgttctgtctgcgccagaaggtgcaaatgtggaagacgaatttctggatccaaatagtcagcttggagtttttcttcgttgctgtatactttccttcaatacaatgacctttgagggtgtctgccatcttttggcaaatcttgtggagtattgtaactccgctgacacctcatacgacttggcagaagatgaggacttcaacagtgaaatggaaatgagcaacttcatggatacaaatatgcatgttagagatggtgtatttgacaaatacaatcaaggttatgcccctaggagccatatggtagacagctcgtcatctctagtacatgctccagcctcactccatgattttgaggaagctaatatgttcaaggcagatgataacctgggtccaacttgtctgaggtcaagatggcaattagaggcatatcttaaccaacaagctgatattcttgagaaggatcctagttcggtgcctttgaattcatttaatgctactatgagtcaacttcagaaattagctccagagctccatcgtaattgtgaagagttccttgtcacaatggtttattttgatctatattctacctgtcaggtccaatttttgcagtatttgaatgctcttacccatgatgactacgttgctgcattagataatcttcaccgctattttgattacagtgcagggatgcaaggacttttcagtcgtaccgcgtctccattccaagatattatagttgggaagtatgagagtgctttgctctgcttaggtaacttgcactgttattttggacatccgaagaaagccttagaggcattcacagaagcagtgcgtgtttcccaaatgaacaatgatgattcatgcctggcctatatattaggagctatttccaatctgttatcaaagataggcatgtcaagcacagttggaacaattggttctccttattcacttggaaataacatcggattaggcacaccgctgtccattcagcaacagctgcttgttcttttaaagagatcacttaagcgagctgataccttgaaacttacaagcttgctgtcctttgatcacctttctcttgcaaaatttgatctgaagcatgtccaaaggcctctggtgtcctttggccctaatgcttccacaaagcttagaacatgtcctgcagatgtctgcaagaatttgagattaagttcacgtgtgttgactgactttggcacagatggcttatcagcatcaaatgataatggtagttttagtacttcatggcttaggaatctgtctgctgcttctaattcttggtgtagcagctcgaaaaaatctggaaaactacttacgaatgacttcgacaatttccattttcatgcacaaccaagtcctatacctgcatcagtattgcaattagctggctcagcttatttgctgagggccactgcttgggaacactacgggagtgctccgatggttcgaatgaattcgttggtctatgcaacctgctttgctgatgctgcaagttcatcagagctgtcgctagcatatgtcaagctaattcagcatttagcaactttcaaagggtattcagcggcattctctgctctcaagcttgctgaagagaagttcccgttgtcagcaaattcacatatccagcttcttaaaatgcaattattgcacgagcgtgctctgcatcgaggacacctgaaagttgcgcaacagatctgtgatgagtttgctgtgttgtcatcttctgttagtggagtcgacattgagctcaagacagaagctaggttacggcatgctcgcacgcttcttgccgcaaaacaatttagtcaggcagcaaatgtggcaaattctcttttctctacttgctacaagtacaacatgcaggtggagaatgcaagtgttcttttattacttgcagagatacagaaaaattctgacaatgcagtccttgggcttccttacgcattagctagtcaatcattctgcaaatcatttaacttagatctgcttgaagcctcggctacactaactcttactgaattatggctggctcttggatcaacccatgcaaagagggccttgagtcttgtttgccaaagccttccaatgatccttggtcatggtggacttgagctgcgcgctcgagctcacatagttcttgcaaaatgctatctgtccgatccaaaattctcagaaaaaccggttcccctttgtcctttcatcatggcagtttccgaagacccttctgctgttctagatcctctgaaccaagctgcggaagatctggaggttttggagtaccacgaaatggcggcagaagcatactacctaaaggcaatggtctacaacaatctaggaaaactggatgagagggaggaagctgcagcttctttcaaggagcacacactcgcccttgaaaacccatataacgaagaggattcacttgcttgctgatactatcaactgaaatggcaagctcagctcccgtttgtccagcagaatgccttgctgagaagaagaaggcggcgtcagcagatcggtggtgcatccatggatgattgatcagtctacatatgccccctgtgcatgcattggttgcattacgagcccaaccaaatggctacatggaaagtcggaaacgatcagcatctgatgttaatttgctagctgctgcaatccaatcgcactttcattttcatcctttttctttttgccaagctactactgtacatacatgccatggtttggtttgataatttgacaagatatgatggccatggctactgtcctgctgacaactactggacatatatatgcgtgttgatgatgttcttgtacgtttcgtaccttttgttagtggcacatgctcatattatgcgttacgctcatgtaaatattttcgatccatacatatatatattctcgatcgctactttcctttctgtctc

SEQ ID NO: 904 - DNA, 2255 bp, Brachypodium distachyon
gcaagagatcgtcttaacgctggggaagggggagtgtgagtgagagcagcataatgggctcctggtggtcgccggcgtcggtggaaccgcggtcggtgcagctgctgcttctgggcgtcgccctcgtcgccgcctccttctacgcgggcaccctgttccagtcctccgcctcccccgcgctcatattaccccctcccggctcccggtcgcgggattcttccaatccccaagatgctccagaatttgcaaacagagttattgttacttatcgcacaacaccaatctcagttccagatcatggacttgatgtgtgtcctttggaatacaatgagtatgttccctgtcatgatgcagcctatgtaagcaaattaagcaacttggatagaactagacatgaagatcttgaagatatttgccctccacaagagaaacgtttgttctgtttggtgcccccaccaaatgattacaagataccgataagatggccaacaagtcgggactacgtatggcgtagtaatgtgaaccattcacgtctttctgaggtaaaaggagggcagaattgggtgcatgagcatggtaagctttggtggtttcctggaggtggtacgcacttcaaacatggtgcattagaatacatagagaggttaggaaatatgacaacaaatagtactggggatctcagttcagcgggggtagttcaagttttggatgttggatgtggtgttgccagcttttctgcttatcttctttccctagacattcatactatgtcatttgccccaaaagatggccatgagaatcaaatccagtttgctttagaacgtgggattggtgcaatgatctctgtgttggccacgaaacaattaccctatcctggaaattcatttgaaatggttcattgttcccgatgccgtgttgactggcacgaaaatgatggaatattgctcaaagaggtcgatcgtcttctgcgacctaatggatatttcgtatactctgctccaccagcttatagaaaagataaagatttccctgttatctgggagaagctaattaatatcacaacagcaatgtgttggaagcttattgctaaacatgttcagactgctatatggctcaagcctgaagatgaatcttgccgacagaaaaatgctgatacgaaactcctgaatatctgtgatcccaatgttagttcttcctcatcgtggaaagccccgttgttgaactgtgtgaggtttaacaaggatcaatcgaaaatgcagaaactgcctcccagacctgatcgcctgacattttattccaggaatttggagatgataggtgtgactccagagaagtttgagaataataaccagttctggtgggaccaggttcgcaagtactggtcattactcggtgtagaaaagactagcatacggaatgtcatggatatgagtgctaattatggtggatttgctatggcactgagcaatgatcctgtctggatcatgaatatagtaccccatacaacggtcaacacattgccagttatctatgatcgtgggttaattggttcttaccatgactggtgtgagccattctcaacatatcctcggtcttatgacttgctacatgctttccatctattttctcattatcaagatcgaacggatggttgctccatggaagacatcatgctagaaatagatcgcataattcgcccacagggttttatcattatcagagacgatgataccactcactcaagaattattgacctcgcaccaaagttcctatgggatgtcaccactcatagtttggaaaacgaggaaaacaggccagagcaggttttgatttgcaggaaaaagttttgggctatcgtttgagaaatgcttatgcctggagatttcatcttatgtcctgtccttccctgtctctctgacacaagacttgggtgtagcaaagtatgagatgttgctccagtatacccaatattccatcaccagttctttccagctgaggctaccacattattgaaaaagcagaaggcatgactgggtgttctttgtcgtatgatgttgatttttttcttaatcttgacaggtccgatcgataggtgcaagaacatctctaatagatgatgtaaaatagggcatctgaaaactgttttagggtaccaatttttgggttttagggcatgaaatttgggcacctctgtaccagatgtaaaatagggcagcagcaaaatttcacatgatgtaaaataggtcactcaaact

SEQ ID NO: 905 - DNA, 2362 bp, Oryza sativa
gcggggggagagtgtcagtgactcagtagagagagaggggggcagcggaagaatggggcggtggtggccgccgacgtcggcggcggccgcgacggcggagccgcggtcggtgcagctgctgctgctgggcgtcgccctcgtcgctgcctccttctacgccggcaccgtcttccgctccccctccgcccccgcgctcttactgcccccatccgcctcccgatcgcccgatccttccagaaccccaggtgctccaaagtttacaaacagagtctctctttcttatcgaacaaaaccaatctcagttccagattatggagttgatgtttgtcctttgaaatacaacgagtatattccctgtcacgacgcatcctatataagccaattaaagaaactggatagatctaggcatgaggatcttgaaagtatttgcccaccacaagagaaacgcttgttctgtttggtgcccccaccaaatgactacaagatacctataagatggccaacaagtcgggactatgtttggcgtagtaacgtcaaccattcacgccttgctgaggtaaaaggaggacagaactgggtgcacgagaagggtaagctttggtggtttcctggaggtggtactcacttcaagcatggtgcatcagagtatatagagaggctagggaatatgacaacaaacagtactggtgatctccgctcggcaggagtggtccaagttttggatgttggatgtggtgttgcgagcttttctgcttaccttcttcccctagacattcatactatgtcatttgctccaaaagatggccatgagaatcaaatccagtttgctctagaacgtgggattggtgcaatgatctctgtgttggccaccaagcaattaccttatcctgaaaatgcatttgaaatggttcattgttcccgttgtcgtgttgactggcatgaaaatgatggaatattgctgaaagaggtagatcgtcttctgcggcccaatggatattttgtatactctgctccaccagcttatagaaaagataaggactttcctgttatctgggagaagttaatgaatataacaacatcaatgtgctggaagcttattgctaaacatgttcagaccgccatatggatcaagcctgaagatcaatcctgccgacagaaaaatgctgatacgaaactactgaatatctgtgactcgtatgataattctccaccttcatggaaaattccattgatgaactgtgtgagattgaacaaagaccagtcaaatatgcagaaactgccttccagacctgaccgcctatcattttattccaggagtttggagatgataggagttactccagagaagttcgcaaagaataacaagttctggagggaccaggttagcatgtattggtcatttcttggtgttgagaagactagcatccgaaatgtcatggacatgaatgctaatattggtggatttgctgtggcactaagcaatgatcctgtctggattatgaatgtagtaccccatacaatgagcaacacattgcctgttatctatgatcgtgggttaatcggttcttaccatgactggtgcgagccattctcaacatatcctaggacatatgatttgctgcatgctttccacatcttttctcattaccaaagtcggaaggaagactgttcattggaagatatcatgctagaaatggaccgtatcattcgccccgagggttttatcattattagagatgagaatgccatcttgtcaggaatcaatgatcttgcaccaaagttcctttgggatgtcaccacacatatgttggaaaatgaggaaagcaagccggagaaagtcttggtttgcaggaagaaattctggtccatcgtttgagtgagcggatactattcaggccagttctttccagatgagtgtcctattattgaaaaagcagatgtcattcggcaaaaggaacacagaaaaatacatggaaaagaaaagaggacaacaccgggtttccttcagcaactatttagattcgtatttcagtgcttgagtatatgtcgatttttctgactttaaaaagggcagaccaaaggtgtaaagatgcaagatgactttttcacttgtttgatgacgatgctagtatgtgttatgtactttctaatttctaactagtctaagttaacctaggtgttttagcaaaattttgctggtgtttctgttcttgtatgggagcacatgtggtactactacgactgaacggcatgaaggctaaatttacagtggactttgagggataattatttcattatctgtttaatttgatttattatcctagtttgtatggtgtggattatcaaccatgcgcttgtttgc

SEQ ID NO: 906 - DNA, 2446 bp, Sorghum bicolor
accgggagtattgaagagcgggactctgacagtagcagcagtgagatggggcggtggtggtcgccggcgtcggcggctgtggagccgcggtccgtgcagctcctcctcctgggcgtcgccctcgtcgccgcttccttctacgccggcaccctcttcggctcctccgcgtccccggcgctcgtactgcccgcctcgaggtcccgatcgcccgattccttcagtgccgaagttgcagatgttccgatgtttacaaacagagtttctcgtaagtaccgggcgaaaccagtcgcagttccagatcatggagttgatgtgtgtcctttggaatacaatgagtatgtcccctgccatgatgcatcctatataagaagcttgaagaacctggatagatctaggcatgaggatcttgaaagtatttgtcctccacgagagaaacaattgttctgtttggtgccccctccaaatgactacaagataccaataagatggccaacaagccgagactacgtatggcgtagtaatgtcaaccattcgcatcttgctgaggtcaaaggaggacagaactgggtgcatgagaagggcaagctttggtggtttcctggaggtggtactcacttcaaacatggtgcatcagagtacatagagaggctaggaaatatgacaacaaataatactggtgatctccgttctgccggagtagttcaagttttggatgttggatgtggtgttgctagtttttctgcttatcttcttcccctagacattcaaaccatgtcatttgctccaaaagatggccatgagaatcaaatacagtttgctttagaacgtgggattggtgcaatgatctctgtgttggccacaaaacaattaccttatcctgaaagttcatttgaaatggttcactgttcaaggtgtcgtgttgattggcatgaaaatgatggaatattgctcaaagaggtagaccgccttttgcgacctaatggatattttgtatactctgctccaccggcttataggaaagataaagacttccctgttatctgggagaagctagttaatattacaacaacaatgtgttggaagcttattgctaagcatgttcaaacagctatttgggttaaacctgaagatgaatcctgccggcagaaaaaggctgatatgaagctactgaatatttgtgaatccaatgacaacgtttcaccatcatggaaaattccgttaatgaattgtgtgaagcttaacaaggacaaatccaatattcagaaattgccttccagatctgatcgcctatcattttatttcaagagtttggagatgataggagtcgcaccagagaggtttgagaagaataaccagttctggaagaaccaggttcacaagtattggtcatttcttggtgttgaaaagactagcattcggaacgtcatggacatgaatgctaattatggcggatttgctgcagcactaagcagtgaccctgtctggattatgaatatagtaccccataccatgacgaacacattgccagttatctacgaccgtgggttactcggttcttaccatgactggtgtgagccattctcaacatatcctagatcctatgatttgttgcatgctttccacctcttttctcattatgaaggtggcaaggaagattgttcgttggaggatatcatgttagaaatggatcgcatcattcgaccccagggttttgtcattattagagatgagaatcacactctctcaagaatcatcgatctagcaccgaagttcctttgggatgttactgcacacatgttggaaaacgaggatagcgggacagatcaagttctgttttgcaggaagaaattctgggctattgtttgagttatattctgggctattgtctgggaaggtgccatcttatatcctcgaacaaacaatcttccttgcgaccttctgggctattgtctgggaaggtgccatcttatatcctacctttggttgccctttgtatcactgagaacagaatgtaaggagagctttttggcatggtggatatttcattgcacgttctctgcagttgagagtagtgcattgttgagaaagcatatggtacggtggtgccgttgagaggtttattcagaaactagctcggatatttttttgcttttgagctgtactgtttgtctatgaaggacatgggtgagccggtaaggtgtagtcttactgacagtgttttgtagtttctctcataaggaatagccgttaattcatttgttatcctattcactaatgactgattaggtttaggttctcaacaatgtgttgatagtgtagtttctgttgttccaattggggatcatctgtagtactataaaccttatggaaggtactgtttgcagcgaatggcgagggaaagaacagtcgcacagatgtatttgaaatgaacagaggaattaccctg

SEQ ID NO: 907 - DNA, 2463 bp, Zea mays
gtaaattcttataatagcttacagggaaaagactcttcaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagttacagatgttccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgaggatcttgaaagtatttgtcctccatgggagaagcggttgttttgtttggtgccccctccaaatgactacaagataccaataagatggccaacaagccgagactacgtatggcgtagtaatgtcaaccattcacatcttgctgaggtcaaaggaggacagaactgggtgcatgagaagggcaaactttggtggtttcctggaggtggcactcacttcaaacatggtgcatcagaatacatagagaggctaggaaatatgatgacaaatagtactggtgatcttcgttctgccggagtagttcaagttttggatgttggatgtggtgttgctagcttttctgcatatcttcttccgctagacattcgaaccatgtcatttgctccaaaagatggccatgagaatcaaatccagtttgctttagaacgtgggattggtgcaatgatctctgtgttggccacaaaacaattaccttatcctgaaaattcatttgaaatggttcactgttcaagatgtcgtgttgattggcatgaaaatgatggaatattactcaaagaggtagaccgtcttttgcgacctaatgggtattttgtatactctgctccaccagcttatagaaaagataaggactttcctgttatttgggagaagctagttaatattacaacaacaatgtgttggaagcttattgctaagcatgttcaaacagctatttgggttaaacctgaagatgagtcctgcagacagaaaaatgttgatatgaatctactgagtatttgtgaatccaatgacaacatttcaccatcatggaaaattccgttaatgaattgtgtgaagctcaacaaggacaaatccaatattcagaaattgccttccagatctgatcgcctatcattttattccaagagtttggagataataggagttgcaccagagaggtttgagaagaataaccagttctggaagaaccaggttcacaagtattggtcatttcttcatgttgaaaagactagcattcgaaacgtcatggacatgaatgctaattatggtggatttgctgcagcactaagcagtgaccctgtctggattatgaatatagtaccctataccatgatgaacacattgcctgttatctatgaccgtgggttactcggttcttaccatgactggtgtgagccattctcaacatatcctagatcctatgacttgttgcatgctttccacctcttttctcattataaacgccgcaaggaagattgtttgttggaggatatcatgttagaaatggatcgcatcattcgaccacagggttttatcattattagagacgagaatgacactctctcaagaatcatcaatctagcaccgaagttcctttgggatgttaccacgcacatgttggaaaatgaggaaagcgggacagatcaagttctgttttgcaggaagaaattctgggctattgtttgagttatacttgggtggaaattgggaagctgccatattttatcctacttttggttgccctttgtatcagtgacagagcagagcgtaaggagagctgtttggcatgatagatgttccaatgaaacataatatttcattgcacgttctctgcagttgacagtagtgcattgttgagaaggcatatggtacggtggtgcggttgacagggttatccagaaactagctcggataatttttgcttttgagctgtactatttgtctacgaaggacatgggtgagccggtaaggtgtagtcttactgacagtgtttgtagtttctctcataatgaatagccgttaattcttttgttatcttattcactaatggctgattaggtttaggttctcaagttctcaacaacatgttggtagtgctgtttctgttgttccatctggggagcatctgtagtactataaaccttatgtaaggtactgtttccagccaatgccgaggtgcatttgttacattatttgttttttgttttgcttatacgttactctctttgttct

SEQ ID NO: 908 - DNA, 2317 bp, Pennisetum glaucum
ggtggagccgcggtcggtgcagctcctgctcctgggcgttgccctcgtcgccgcttccttctacgctggcaccctcttcggcccctccgcctcccccgagctcgtactgcccccttcgcgcccccaatcgcccgattcctccaggtccaaagttgcagatgctcgaatgtttacaaacagagtttctcttacataccggacgaaaccagtcagagttccagatcatggagttgatgtgtgcccgttggagtgcaatgagtatgttccctgccatgatatggcctatataagcagcttaaagaacctggatagatctaggcatgaggatcttgaaagtatttgcccaccacaagagaaacgattgttctgtttggtgcccccaccaaatgactacaagataccaataaaatggccaacaagcagagactatgtatggcgtagtaatgttaaccattcacatcttgctgaggtcaaaggaggacagaattgggtgcacgagaagggcaagctttggtggtttcctggaggaggcactcacttcaaacatggtgcatcagagtacatagagaggttagggaatatgacaacaaatagtactggcgatctccgttctgcaggagtagttcaagttttggatgtcggatgtggtgttgccagcttttctgcttatcttctacccctagatattcagaccatgtcatttgccccaaaagatggccatgagaatcaaattcagtttgctgtagaacgtgggattggtgcaatgatctctgtgttggcaacaaagcagttaccctatcctggaaactcttttgaaatggttcactgctcccgatgtcgtgttgattggcacgaaaatgatggaatactgctcaaagaggtcgatcgtcttttgcggcctaatggatattttgtatactctgctccaccagcttacagaaaagataaagactttcctgttatctgggagaagctagttaatattacaacagcaatgtgttggaagcttattgctaagcatgttcagacagctatttgggtcaaacctgaagatgaatcctgccgacagaaaaatgctgatatgaagctactgaatatttgtgaatctaatgacattgtttcaccatcatggaaaatcccgttattgaactgtgtgaggcttaacaaggtcaaatcggagattaaaacatttccttccagacctgatcgcttatcattttatttcaagagtttggaaatgataggagttacaccagccaagtttgagaagaataacgagttttggaagaaccaggttcacaagtattggtcatttcttgatgttgaaaagactagtgtccgaaatgtaatggacatgaatgctaattatggtggatttgctgctgcactaagcaatgaccctgtgtggattatgaatgtagtaccttataccatgagcaacacattgccaattatctatgatcgtgggttacttggttcttaccatgactggtgtgagccattctcaacatatcctagatcctacgacttgctgcatgcttcccacctcttctctcattatgaaggtcgcaatgaagattgtttgttggaagatatcatgttagaaatggaccgcatcattcggccccagggtttcatcattattagagatgagaagaacactctttcaagaataattgatctagcaccgaagttcctttgggatgttagcacacatatgttggaaaatgaggaaaacgggacagagcaagttctgatttgcaggaagaaattctgggctatcgtttaaaagttacaattgggcaagttacaattgggccggaagctgccagatcctacctgggatgtcctactgtcctttgtgtcattacagaacataacgttaggagaactttttagcatgctgtagtttgagggattgagatccttcgcagtcgactgctggggctgcttacatgggcctgacgggtgacagggcccacgtgcagtgacagctgcagaggatactctcactagtttgagatatcgctccagtgaatgtagtatttcgctgacttatctctgtagttgagagttactgcattgttgagaaagcaaatggtatcatctggaggtttcttcagactatcatactgggatccttttttgcttttgagctgtactgtttgtagaggacatgcgcatggtgtaaagaggtgatattttgatttgtgtagtcttactaatagctaacgttttttagtttcactcaaaagaaataacaatttgtagcttgctacttaattagttaattctcgattggtaatctagggttttg

SEQ ID NO: 909 - DNA, 7384 bp, Brachypodium distachyon
atggcggccgcgcctcctcctcctggcacgtcaggcgtggccccgcccccacccccacccgccggtgcgccgccgccggccggccagccgctgacgccggcggagctcgaggcgcagctcgtggagaaggcccgcaagtggcaccagctcaactcgaagcggtatggcgacaagcgcaagttcggcttcgtcgaggcgcagaaggaggacatgccccccgagcacgtccggaaaatcataagggaccatggagacatgtcttcaaagaagtacaggcatgacaagcgtgtatatctaggagcactcaaatttgtgcctcatgctgtttacaaactactggagaatatgccaatgccctgggaacaggttcgccatgtgaagattttgtaccatatcactggcgccataacctttgtaaacgagattccatgggtagttgaacccatttacttggcacagtggggctcaatgtggatcatgatgcgaagggagaagagagataggcggcatttcaaaagaatgcgctttcctccatttgatgatgaggaaccgccactggattatgctgataatttgttggatgttgaaccactggaggctatacaattggagttggacccagaggaagatggagctgtttacaaatggttttatgatcacaagcctcttgtgaagactaaacttataaatggccccagctacaggaagtggcatctatctcttcccataatggcaacactttatcgccttgctggtcaacttttgtcagacttgattgatcggaattatttctatttgtttgacatggaatctttctttactgccaaagcacttaacatgtgtattccaggaggtccaaagtttgagccattgtaccgtgatatggagaagggggatgaggactggaatgaatttaatgacatcaataaactcatcatccgtcagccgcttaggactgaatacagaattgcgttcccacacttgtacaacaacaggccaaggaaagtgaaactttgtgtatatcatacacctatgataatgtatatcaagacggaggatccagatttacctgcattttattatgatcctctgatcaatcctatcacttcaaccaacaagatagatcgccgggataggaaagccactgaagaggaagatgaagaggacttttgtctccctaccggtgtggagcctcttttgaaagaaactccactctacactgatacaacagcagccggcatttcattactttttgctccaaagccttttaacatgagatccggcagaacacgtcgtgctgaggatattcctcttgtatctgagtggttcaaagagcactgcccaccagcatatccggttaaagtccgtgtgagctaccagaagctgttgaagtgctacgtgctcaatgagctacatcataggcctcctaaggcgcagaagaagaaacatctgttccgttcactgcaagcaacaaagttctttcaaactacagaacttgactgggcagaagcagggttgcaagtgtgcaagcagggttacaacatgctaaacttgttgattcacaggaagaatcttaactatcttcacttagactacaatttcaatctgaagcctgtgaagactctcacaacaaaggagagaaagaaatctcgttttggtaatgctttccacttgtgccgtgagatcttgcgacttactaagctggttgttgatgcgaatatccaatttcgcctaggaaatgtggacgcctttcagttggcagatggtttgcaatacatattctctcatgtcggtcagttaactggtatgtacagatacaagtatcgtctgatgcggcaaattaggatgtgcaaagatctgaagcacttgatatattatcgtttcaatactggtcctgttggaaaaggacctggctgtggattttgggctccaatgtggagagtgtggctgtttttccttcgtggtatcgtgcccttgcttgaaaggtggttaggtaatttgttggccaggcagtttgaaggtcgccattcaaaaggagttgctaaaacagtaaccaagcaacgtgtcgagtcacactttgatctggaacttcgagctgcagttatgcatgatgttcttgatgctatgccagagggcataaagcaaaataaggcccggactatactgcagcatcttagtgaggcatggcgctgctggaaggcaaatatcccatggaaggtccctggcctgccagttcctattgagaacatgatacttcgttatgtgaagtccaaggctgattggtggacaaatgtcgctcactacaatcgtgagcgtatccgtcgtggtgctacagttgacaagactgtgtgccgcaagaatcttggaagattgactcgtctgtggctgaaagcagagcaagagaggcagcacaattacttgaaagatgggccatatgtgacacctgaagaagcagttgcaatttatacaacaacagttcattggctggaatcaagaaagttctcaccgattccttttcctccactctcatacaagcatgataccaagcttcttatactggcactggaaaggctgaaggaatcttatagtgtggcagtaaggttaaatcaactgcaaagagaggaactgggtttaattgaacaagcatatgataatccacatgaagcattgtcaaggataaaacgtcatcttcttactcagcgtgctttcaaagaagttggcattgaatttatggacctgtatagctacttgatcccggtatatgaaattgagcctctcgagaagattactgatgcttaccttgaccagtacttgtggtacgagggagacaagcggcacctcttcccaaattgggtcaagcctgctgattcagaaccacctcctctgcttgtgtacaaatggtgccaaggtttaaacaatttgcaggacatatgggacacaagtgatgggcagtgtgtcgtgatgttgcagacaaagtttgagaagttttttgaaaaaattgatctgactcttttgaacagacttctgcggttggtcttggaccataacattgctgattatgtcactgcaaagaataatgttgtgttgtcttacaaggatatgagccacacaaactcttatggtcttattcgaggtcttcagtttgcatcttttgttgtgcaatactatggcctggtgctggatctccttcttcttggtttaacacgggctagtgagattgctggaccgcctcagatgccaaatgagttcctgacgtatactgacgccaaagttgagaccaggcatcccatcaggctgtattctcgatatattgacaaggtgcatataatgttccggttcactcatgaagaagcacgggatctaattcagcgttacttgacagagcatcctgatcccaacaatgagaacatggttggttacaataacaagaaatgttggcctagagatgcaagaatgaggctcatgaagcatgatgtgaatcttggaagaagtgtcttttgggatatgaagaaccgcctcccaaggagcattacaacattagaatgggagaatagctttgtctctgtgtacagcaaggataacccaaacctgctctttagcatgtccggattcgaggttcgtatactgccgaagatccgtatgacacaagaggcattcagcaacacaaaagatggagtatggaatctgcagaacgagcagacaaaagaaaggacagctattgcatttctgagggttgacgatgaacacatgaaagtgtttgagaaccgagttaggcaaatccttatgtcatcagggtcaacaacatttaccaagattgtcaacaagtggaacaccgctctcattggcctcatgacatatttccgtgaagcaactgttcatacacaagaactcttggatttgcttgtaaaatgtgaaaacaagattcaaacccgcataaagattggcctgaactcgaaaatgcctagcaggtttccaccagttatcttttatacacccaaggaaattggaggtctgggtatgttgtcgatgggtcacattctgataccacagagtgatctcaggtatagcaagcagacggatgttggtgtcacacattttcgaagtggtatgagtcatgaagaggaccagcttatccctaacttgtaccgctacatccaaccatgggagagtgagttcattgattcgcagcgtgtttgggctgagtatgccttgaagaggcaggaagctcaatcacagaacaggcgcttaacacttgaggacctggaagattcatgggatagaggtatccctcgtatcaacactctattccaaaaggaccgtcacactttggcatacgacaaaggatggcgggtgagaacagactttaagcagtatcaggtgctgaagcaaaacccattctggtggacgcatcagcggcatgatggaaagctatggaacttgaacaactatagaactgatgtcatccaagcactaggtggtgtagagggtatcctggagcataccttatttaaaggaacatatttccctacctgggagggtctgttttgggaaaaggcatcaggttttgaggagtccatgaaatacaaaaagctgacaaatgcacagcgttctgggctcaatcaaattcccaatagaagatttaccctttggtggtctccaaccatcaatcgtgcaaacgtttatgttggtttccaggttcagcttgatctgacagggatattcatgcatggtaaaatcccaaccctgaaaatctctctgatccagattttccgtgcacatctttggcagaagatccatgaaagtgttgtgatggatctttgccaagttttggatcaagagttggatgctttggagattgagacagtgcagaaagagacaatacatcccaggaagagttacaagatgaacagttcctgtgcagatgtcctcctttttgctgcacataggtggcaaatgtccaaaccaagccttgtttctgagtcaaaggacgtctttgatcagaaagcaagtaacaagtattggattgatgtgcaactacgctggggagactatgattcacacgacatagaacgttacacaagggctaagtttatggactatacgacagataatatgtccatctacccttctccaactggggtgatgattggacttgatctagcatataatttgcactctgcttttggcaactggttccctggttcgaagcctctcctccagcaagcaatgaacaagatcatgaagtcaaatcctgctctatatgtgctgagggagagaataaggaaaggtctccagttgtattcatctgaacctactgagccatatctgtcttcacagaactatggagagatattcagcaatcaaatcatatggtttgtggatgacacaaatgtttatcgagttaccattcataaaacctttgagggtaatctgaccaccaaaccaatcaatggtgctatttttattttcaatccaagaaccggtcaactatttctgaaggtcatccatacaagtgtatgggcagggcaaaagcgtctcggtcagctggccaagtggaaaacagctgaggaagttgctgcattggttcgatctcttcctgtggaggagcagccaaagcaaattattgtgacaaggaagggtatgttggatccgttggaagtccatctgcttgactttccgaacattgttatcaagggtagtgagttgcagttgccattccaagcttgcttgaagattgagaagtttggggatcttattctcaaggctacagaaccacagatggttctttacaacatatacgatgattggttgaaaagtatctcatcatacactgcattctctcgtcttgtacttatattgagggcactacatgtcaataatgagaaggctaagatgttgctgaagcctgacaagacaattgttacggaaccacatcatatctggccaacattgaatgatgagcagtggttgaaggttgaatgtgcgctccgggatctcattctctctgattatgcaaagaaaaacaacgttaatacttctgcgcttacacaatctgagattcgtgatataatacttggtgctgaaattgctccaccatcacagcagaggcaacaaatagctgagattgaaaaacagtcccgggagactactcagttaactgcggttacaacaaggacaactaatgtgcatggagatgagctcatcataacaacaaccagcccctatgagcaggcagcatttgcatcaaagacagattggcgcgtcagggctatctctgctacaaacttatatctccgtgtcaaccacatttatgttaactcagatgatataaaggagactggctacacttacattatgccaaagaatatattgaagaagttcatatgtatagctgatctacggacacaggttgcaggtttcctgtatggactgagcccgcaggataatccccaagtcaaggagatcagatgcatatcgatccccccgcaacatgggactcaccagatggttactttgccagctaatcttcctgagcatgagttccttgccgacttggagcccttgggatggatgcatacccaaccaaatgaagctccccaactatcacctcaggatttgacatcacatgcaaagattttggagaacaacaagcagtgggatggtgagaagtgcatcattttgacatgcagtttcaccccaggatcgtgctcgctgaccgcatacaaattgacgccaagcggttacgaatggggccgtagcaacaaggacaatgggagcaacccccatggatatctcccaacacactacgagaaggtccagatgcttctcagcgaccgcttccttggtttctacatggttccggataatgctccttggaactacaacttcatgggagtcaagcatgacccgctgatgaagtacagcatgaagctggggacgccccgtgacttctaccacgaggaccacagaccgacacacttcctggagttcagcaacatcgacgagggtgaggttgccgagggggacagggaggacaccttctcgtaggctcgtagccacagtagcacgccctctgccctacgttaacatactgaaacttgcaatgatctcccctccattttgaatagggacctgtaacctcgacgcgagacgcagtatgatgtttgcctgtctcttaatatctgtataaacctggagtcgacgtggcacacacaccttctgttgtagccttgcccttcatgtggggtactgtataagtacacaagattttgctttgcagctatgctactcggctactgtagtttgtacaatgatatctggtaatttttgctagaatagtccaatttatgctctttcagtatgtagtttgcatctgacagcagag

SEQ ID NO: 910 - DNA, 4558 bp, Hordeum vulgare
tgatcccggtatatgaaattgagcctcttgagaaaattactgatgcataccttgaccaatacttgtggtatgaaggggacaaacgccacctcttcccaaattgggtaaagcctgctgattcagaaccacctcctctacttgtttacaagtggtgccaaggtataaataatttgcaggacatatgggacactagcgatgggcagtgtgttgtgatgctgcagacaaaatttgagaagttctttgaaaaaattgatctgactctgttgaacaggcttctacggttggtcctggaccataacattgctgattatgtcactgcaaagaataatgttgtgctgtcttacaaggatatgagtcacacaaattcttatgggcttattcggggtcttcagtttgcatcttttattgtgcagtactatgggctggtgctggatctcctacttcttggtttaacacgagctagtgagattgcagggccgcctcagatgccaaatgagttccttacatatactgacactaaagttgagacaaggcatcccatcaggctgtattctcgatatatcgataaggtgcatataatgttccgtttcactcatgaagaggcaagggatttgattcagcgttacttgacagagcatcctgatcctaataatgagaacatggttggttacaacaacaagaaatgttggcctagagatgcaagaatgaggctcatgaagcatgatgttaatctgggaagaagtgtattttgggatatgaagaaccgcctgccaaggagtattactacattagaatgggagaatggctttgtctctgtatacagcaaggataacccaaacctgctctttagcatgtctgggtttgaggtccgtatactgccgaagatacgtatgactcaggaggcattcagcaacacaaaagatggagtatggaacttgcagaatgagcagacaaaagaaaggacagctattgcatttttgagggttgatgatgaacacatgaaggtgtttgagaaccgtgttaggcaaatccttatgtcatcagggtcaacgacatttaccaagatagtcaacaagtggaacactgctctcattggcctcatgacatatttccgtgaagcaactgttcatacacaggaactactggatctgcttgtaaaatgtgaaaacaagatccagactcgcataaagattggcctgaactcaaagatgcctagcaggtttccaccagttatcttctatacacccaaggaaattggaggcttgggtatgttgtcaatgggtcacattttgataccacagagtgatcttaggtacagcaaacagacagatgttggtgtgacacattttagaagtggtatgagtcatgaagaggatcagcttatccccaacttgtatcgctacatccaaccatgggagagcgagtttattgattctcagcgtgtttgggctgagtatgctttgaagaggcaggaagcacaatcgcagaataggcgcttaacacttgaagatctggaagattcatgggatagaggcataccccgtatcaacactttattccaaaaagaccgccacactttggcctacgacaaagggtggagggtgcggacagactttaagcagtatcaagtgctgaaacagaacccattctggtggacacatcagcggcatgatgggaagttatggaacctgaataactacagaactgatgtcatccaagcacttggtggtgtggaaggtatcctggaacataccttatttaaagggacatatttccccacttgggagggtttgttttgggagaaggcttcaggtttcgaggaatcaatgaagtacaaaaagctgacaaatgcacagcgttctgggcttaatcaaatccccaacagaagatttaccctctggtggtcgccaaccattaatcgtgcaaacgtatatgttggtttccaggttcagctagatctgactgggatattcatgcatggtaaaattccaaccctgaagatctctctgattcagattttccgtgcacatctttggcagaaggtccatgaaagtgttgttatggatctttgccaagttctggatcaggagttggatgcactggagattgagacagtacagaaagagacgatacatcccaggaagagttacaagatgaacagttcatgtgcagatgtcctcctttttgctgcacataggtggcagatgtccaaaccaagcttagtttccgagtcaaaggatgtttttgatcagaaagcgagtaacaagtactggattgatgtgcaactacgatggggagactatgattcacatgacatagaacgttatacaagagcaaaatttatggactacacgacagataatatgtccatctacccttctccgactggagtgatgattggacttgatctagcttataatttgcactcggcctttggcaactggttccctgggtcaaagcccctcctccagcaagcaatgaacaagatcatgaagtcaaatcctgctctgtatgtgctgagagagagaataagaaagggtcttcagctgtattcatctgaacccaccgagccatatctgtcttcacagaactatggagagatattcagcaatcaaatcatatggtttgtggatgacacgaatgtctatcgagttaccattcacaaaaccttcgagggtaacctgaccaccaaaccaatcaatggtgctatctttattttcaatccaagaactgggcaactatttctgaaggttatccacacaagtgtatgggcaggacaaaagcgtctagggcagctggccaagtggaaaactgccgaggaggttgctgcattagttcggtctcttcctgtagaagagcagccaaagcaaattattgtgacaaggaagggtatgttggatccattggaagtccatttgcttgatttccctaacattgttatcaagggtagtgagttgcagctgccattccaagcttgcttgaagattgagaagtttggtgatcttattctcaaggctacggaaccacagatggttctttataacatatacgatgactggctgaaaagtatctcgtcctacaccgcattctctcgtcttgtgcttatattacgagcattacatgtcaataatgagaaggctaagatgttgctgaagcctgacaagacaattgttacggaaccacatcatatctggccatctttgactgacgagcagtggctgaaggtcgaatgtgcgctcagggatctcattctttctgattatgcgaagaaaaacaacgttaatacttctgcacttacgcaatctgagattcgtgatataatactgggtgctgaaatagctccaccgtcacagcagaggcaacagatagctgagattgagaaacagtcccgagagacaaatcaggtaactgcacagacaacaaggacagttaatgtgcatggagatgagctcattgtcacaacaaccagtccgtatgagcaagcagcatttgcatcgaagacagattggcgtgtcagggccatctctgctacaaacttatatctccgtgtcaaccacatttatgttaactcagatgatataaaggagactggctatacttacatcatgccaaagaatatattgaagaagttcatatgcatagcagatctacggacacaggttgcaggttttctgtatgggctgagtccacaggataatccccaagtcaaggagatcagatgcatatccattccgccacagcatggaactcaccagatggtcactttgccagcgaatctcccagagcatgagttccttgctgacttggagccgttgggatggatgcatacccagccaaatgaagctcctcagctatcacctcaggatttgacatcacatgctaaaattttggagaacaacaagcagtgggatggtgagaagtgcatcattttgacctgcagcttcaccccaggatcgtgctcgttgactgcatacaaattgacaccaagtggttatgagtgggcccgtggcaacaaggacaacgggagcaacccacaaggttatcttccaactcactacgagaaggtccagatgcttctcagcgaccgcttccttggattctacatggttccggacaacgctccgtggaactacaacttcatgggagtcaagcacgacccgctgatgaagtacagcatgaagctgggcacaccccgcgacttctaccacgaggaccacaggccaacacacttcctggagttcagcaacattgaggagggcgaggttgctgagggggacagggaggacaccttctcgtagtcgtagccaccttagcacgcccactccgccctatgttagcgtatcgaaacctgcaatgagctctgctcagttttgaatagagagctctgtgacgtgtgtaactttgacgtgacatgttgtatgatgttttccgtctcttgagactaataccttgtattgtaagcctgcccttcaagcacggtgctgtacaagtgcatcatgataacagttgaaacattttgcttggtggcctgtagatgccatcgtgtaactttgtcccc

SEQ ID NO: 911 - DNA, 4567 bp, Hordeum vulgare
tgatcccggtatatgaaattgagcctcttgagaaaattactgatgcataccttgaccaatacttgtggtatgaaggggacaaacgccacctcttcccaaattgggtaaagcctgctgattcagaaccacctcctctacttgtttacaagtggtgccaaggtataaataatttgcaggacatatgggacactagcgatgggcagtgtgttgtgatgctgcagacaaaatttgagaagttctttgaaaaaattgatctgactctgttgaacaggcttctacggttggtcttggaccataacattgctgattatgtcactgcaaagaataatgttgtgctgtcttacaaggatatgagtcacacaaattcttatgggcttattcggggtcttcagtttgcatcttttattgtgcagtactatgggctggtgctggatctcctacttcttggtttaacacgagctagtgagattgcagggccgcctcagatgccaaatgagttccttacatatactgacactaaagttgagacaaggcatcccatcaggctgtattctcgatatatcgataaggtgcatataatgttccgtttcactcatgaagaggcaagggatttgattcagcgttacttgacagagcatcctgatcctaataatgagaacatggttggttacaacaacaagaaatgttggcctagagatgcaagaatgaggctcatgaagcatgatgttaatctgggaagaagtgtattttgggatatgaagaaccgcctgccaaggagtattactacattagaatgggagaatggctttgtctctgtatacagcaaggataacccaaacctgctctttagcatgtctgggtttgaggtccgtatactgccgaagatacgtatgactcaggaggcattcagcaacacaaaagatggagtatggaacttgcagaatgagcagacaaaagaaaggacagctattgcatttttgagggttgatgatgaacacatgaaggtgtttgagaaccgtgttaggcaaatccttatgtcatcagggtcaacgacatttaccaagatagtcaacaagtggaacactgctctcattggcctcatgacatatttccgtgaagcaactgttcatacacaggaactactggatctgcttgtaaaatgtgaaaacaagatccagactcgcataaagattggcctgaactcaaagatgcctagtaggtttccaccagttatcttctatacacccaaggaaattggaggcttgggtatgttgtcaatgggtcacattttgataccacagagtgatcttaggtacagcaaacagacagatgttggtgtgacacatttagaagtggtatgagtcatgaagaggatcagcttatccccaacttgtatcgctacatccaaccatgggagagcgagtttattgattctcagcgtgtttgggctgagtatgctttgaagaggcaggaagcacaatcgcagaataggcgcttaacacttgaagatctggaagattcatgggatagaggcataccccgtatcaacactttattccaaaaagaccgccacactttggcctacgacaaagggtggagggtgcggacagactttaagcagtatcaagtgctgaaacagaacccattctggtggacacatcagcggcatgatgggaagttatggaacctgaataactacagaactgatgtcatccaagcacttggtggtgtggaaggtatcctggaacataccttatttaaagggacatatttccccacttgggagggtttgttttgggagaaggcttcaggtttcgaggaatcaatgaagtacaaaaagctgacaaatgcacagcgttctgggcttaatcaaatccccaacagaagatttaccctctggtggtcgccaaccattaatcgtgcaaacgtatatgttggtttccaggttcagctagatctgactgggatattcatgcatggtaaaattccaaccctgaagatctctctgattcagattttccgtgcacatctttggcagaaggtccatgaaagtgttgttatggatctttgccaagttctggatcaggagttggatgcactggagattgagacagtacagaaagagacgatacatcccaggaagagttacaagatgaacagttcatgtgcagatgtcctcctttttgctgcacataggtggcagatgtccaaaccaagcttagtttccgagtcaaaggatgtttttgatcagaaagcgagtaacaagtactggattgatgtgcaactacgatggggagactatgattcacatgacatagaacgttatacaagagcaaaatttatggactacacgacagataatatgtccatctacccttctccgactggagtgatgattggacttgatctagcttataatttgcactcggcctttggcaactggttccctgggtcaaagcccctcctccagcaagcaatgaacaagatcatgaagtcaaatcctgctctgtatgtgctgagagagagaataagaaagggtcttcagctgtattcatctgaacccaccgagccatatctgtcttcacagaactatggagagatattcagcaatcaaatcatatggtttgtggatgacacgaatgtctatcgagttaccattcacaaaaccttcgagggtaacctgaccaccaaaccaatcaatggtgctatctttattttcaatccaagaactgggcaactatttctgaaggttatccacacaagtgtatgggcaggacaaaagcgtctagggcagctggccaagtggaaaactgccgaggaggttgctgcattagttcggtctcttcctgtagaagagcagccaaagcaaattattgtgacaaggaagggtatgttggatccattggaagtccatttgcttgatttccctaacattgttatcaagggtagtgagttgcagctgccattccaagcttgcttgaagattgagaagtttggtgatcttattctcaaggctacggaaccacagatggttctttataacatatacgatgactggctgaaaagtatctcgtcctacaccgcattctctcgtcttgtgcttatattacgagcattacatgtcaataatgagaaggctaagatgttgctgaagcctgacaagacaattgttacggaaccacatcatatctggccatctttgactgacgagcagtggctgaaggtcgaatgtgcgctcagggatctcattctttctgattatgcgaagaaaaacaacgttaatacttctgcacttacgcaatctgagattcgtgatataatactgggtgctgaaatagctccaccgtcacagcagaggcaacagatagctgagattgagaaacagtcccgagagacaaatcaggtaactgcacagacaacaaggacagttaatgtgcatggagatgagctcattgtcacaacaaccagtccgtatgagcaagcagcatttgcatcgaagacagattggcgtgtcagggccatctctgctacgaacctgtatctccgtgtcaaccacatttatgttaactcagatgatataaaggagactggctatacttacatcatgccaaagaatatattgaagaagttcatatgcatagcagatctacggacacaggttgcaggttttctgtatgggctgagtccacaggataatccccaagtcaaggagatcagatgcatatccattccgccacagcatggaactcaccagatggtcactttgccagcgaatctcccagagcatgagttccttgctgacttggagccgttgggatggatgcatacccagccaaatgaagctcctcagctatcacctcaggatttgacatcacatgctaaaattttggagaacaacaagcagtgggatggtgagaagtgcatcattttgacctgcagcttcaccccaggatcgtgctcgttgactgcatacaaattgacaccaagtggttatgagtgggcccgtggcaacaaggacaacgggagcaacccacaaggttatcttccaactcactacgagaaggtccagatgcttctcagcgaccgcttccttggattctacatggttccggacaacgctccgtggaactacaacttcatgggagtcaagcacgacccgctgatgaagtacagcatgaagctgggcacaccccgcgacttctaccacgaggaccacaggccaacacacttcctggagttcagcaacattgaggagggcgaggttgctgagggggacagggaggacaccttctcgtagtcgtagccaccttagcacgcccactccgccctatgttagcgtatcgaaacctgcaatgagctctgctcagttttgaatagagagctctgtgacgtgtgtaactttgacgtgacatgttgtatgatgttttccgtctcttgagactaataccttgtattgtaagcctgcccttcaagcacggtgctgtacaagtgcatcatgataacagttgaaacattttgcttggtggcctgtagatgccatcgtgtaactttgtccccagttttttcc

SEQ ID NO: 912 - DNA, 2376 bp, Triticum aestivum
gtgcagatgtcctcctttttgctgcacataggtggcagatgtccaaaccaagcttagtttccgagtcaaaggatgtctttgatcagaaagcgagtaacaagtactggattgatgtgcaactacgatggggagactatgattcacatgacatagaacgttatacaagagcaaaatttatggactacacgacagataatatgtccatctacccttctccgactggagtgatgattggacttgatctagcttataatttgcactctgcttttggcaattggttccctgggtcaaaacccctcctccagcaagcaatgaacaagatcatgaagtcaaatcctgctctgtatgtgctgagggagagaataagaaagggtcttcagttgtattcatctgaacccaccgagccatatctgtcttcgcagaactatggagagatattcagcaatcaaatcatatggtttgtggatgacacgaatgtctatcgagttaccattcacaaaaccttcgagggtaacctgaccaccaaacctatcaacggtgctatctttattttcaatccaagaactgggcaactatttctgaaggtcatccacacaagtgtatgggcaggacaaaagcgtctagggcagctggccaagtggaaaactgctgaggaggttgctgcgttagttcggtctcttcctgtagaagagcagccaaagcaaattattgtgacaaggaagggtatgttggatccattggaagtccatctgcttgatttccctaacattgttatcaagggcagtgagttgcagctgccattccaagcttgcttgaagattgagaagtttggtgatcttattctcaaggctacggaaccgcagatggttctttataacatatacgatgactggctgaaaagtatctcgtcctacaccgcattctctcgtcttgtgcttatattacgagcattacatgtcaataatgagaaggccaagatgttgctgaagcctgacaagacaattgttacggaaccacatcatatctggccatctttgactgacgagcagtggctgaaggtcgaatgtgcactcagggatctcattctttctgattatgcaaagaaaaacaacgttaatacttctgcacttacgcaatctgagattcgtgatataatacttggtgctgaaatagctccaccgtcacagcagaggcaacagatagctgagattgagaaacagtcccgagagacaaatcaggtaactgcacagacaacaaggacagttaatgtgcatggagatgagctcatcgtcacaacaaccagtccgtatgagcaagcagcgtttgcatcgaagacagattggcgtgtcagggccatctctgctacgaacctgtatctccgtgtcaaccacatttatgttaactcggatgatataaaggagactggctatacttacatcatgccaaagaatatattgaagaagttcatatgcatagcagatctgcggacacaggttgcaggtttcctgtatgggctgagtccacaggataatccccaagtcaaggagatcagatgcatatccattccgccacagcatggaactcaccagatggtgactttgccagcgaatctcccagagcatgagttccttgctgacttggagccgttgggatggatgcatacccagccaaatgaagctcctcagctatcacctcaggatttgacatcacatgctaaaattttggagaacaacaagcagtgggatggtgagaagtgcatcattttgacctgcagcttcaccccaggatcgtgctcgttgactgcatacaaactgacaccaagtggttatgagtgggcccgtggcaacaaggacaacgggagcaacccacaagggtacctcccaactcactacgaaaaggtccagatgcttctcagcgaccgcttccttggattctacatggttcctgacaacgctccatggaactacaacttcatgggagtcaagcacgacccactgatgaagtacagcatgaagctgggcacaccccgcgacttctatcatgaggaccacaggccgacgcacttcctggagttcagcaacattgaggagggcgaggtcgcggagggggacagggaggacaccttctcgtagttgtagccaccttagcacgcccctccgccctatgctagcatatcaaaacctgcaatgagatcggctcaattttggatggagatctctgtaacctgtaaactttgacgtgacatgttgtatgatgttttccgtctctcaagaccaataccatgtgttgtaagcctccttcaatcacggtgctgtataagtgcataatgataacagttgaaacattttacttggtggcctagatctcatcatgtaa

SEQ ID NO: 913 - DNA, 4376 bp, Triticum aestivum
tgatacgtctaataatttgcaggacatatgggacactagtgatgggcagtgtgttgtgatgctgcagacaaaatttgagaagttctttgaaaaaattgatctgactctgttgaacaggcttctacggttggtcttggaccacaacattgctgattatgtcactgcaaagaataatgttgtgctgtcttacaaggatatgagtcacacaaattcttatgggcttattcgaggtcttcagtttgcatcttttattgtgcagtactacgggctggtgctggatctcctacttcttggtttaacacgagctagtgagattgcagggccgcctcagatgccaaatgagttccttacatatactgacactaaagttgagacaaggcatcccatcaggctgtattctcgatatatcgataaggtgcatataatgttccggttcactcatgaagaggcaagggatttgattcagcggtacctgacagagcatcctgatcctaataatgagaacatggtcggttacaacaacaagaaatgttggcctagagatgcaagaatgaggctcatgaagcatgatgttaatctgggaagaagtgtattttgggatatgaagaatcgcctgccaaggagcattactacattagaatgggagaatggctttgtctctgtatacagcaaggataacccaaacctgctctttagcatgtctgggtttgaggtccgtatactgccgaagatacgtatgactcaggaggcattcagcaacacaaaagatggagtatggaacttgcagaatgagcagacaaaagaaaggacagctattgcatttttgagggttgatgatgaacacatgaaggtgtttgagaaccgtgtcaggcaaatccttatgtcatcagggtcaacgacatttaccaagatagtcaacaagtggaacactgctctcattggcctcatgacatatttccgtgaagcaactgttcatacacaggaactactggatctgcttgtaaaatgtgaaaacaagattcagactcgcataaagattggcctgaactcaaagatgcctagcaggtttccaccagttatcttctatacacccaaggaaattggaggtttgggtatgttgtcaatgggtcacattttgataccacagagtgatcttaggtatagcaaacagacagatgttggtgtgacacattttcgaagtggtatgagtcatgaagaggaccagcttatccccaacttgtatcgctacatccaaccatgggagagcgagttcattgattctcagcgtgtttgggctgagtatgctttgaagaggcaggaagcacaatcgcagaataggcgcttaacacttgaagatctggaagattcatgggatagaggcataccccgtatcaacactttattccaaaaagaccgccacactttggcctatgacaaagggtggagggtgcggacagactttaagcagtatcaagtgctgaaacagaacccattctggtggacacatcagcgacatgatggaaagctgtggaatctgaataactacagaactgatgtcatccaagcacttggtggtgtggaaggtatcctggaacataccttatttaaaggaacatatttccctacttgggagggtttgttttgggagaaggcttcaggtttcgaggaatcgatgaagtacaaaaagctgacaaatgcacagcgttctgggcttaatcaaatccccaacagaagatttaccctctggtggtcgccaaccattaatcgtgcaaacgtatatgttggtttccaggttcagctagatctgacagggatattcatgcatggtaaaattccaaccctgaagatctctctgattcagattttccgtgcacatctttggcagaaggtccatgaaagtgttgttatggatctttgccaagttctggatcaggagttggatgcgctggagattgagacagtacaaaaggagacaatacatcccaggaagagttacaagatgaacagttcatgtgcagatgtcctcctttttgctgcacataggtggcagatgtccaaaccaagcttagtttccgagtcaaaggatgtctttgatcagaaagcgagtaacaagtactggattgatgtgcaactacgatggggagactacgattcacatgacatagaacgttatacaagagcaaaatttatggactacacgacagataatatgtccatctacccttctccgactggagtgatgattggacttgatctagcttataatttgcactctgcttttggcaattggttccctgggtcaaaacccctcctccagcaagcaatgaacaagatcatgaagtcaaatcctgctctgtatgtgctgagggagagaataagaaagggtcttcagttgtattcatctgaacccaccgagccatatctgtcttcgcagaactatggagagatattcagcaatcaaatcatatggtttgtggatgacacgaatgtctatcgagttaccattcacaaaaccttcgagggtaacctgaccaccaaacctatcaacggtgctatctttattttcaatccaagaactgggcaactatttctgaaggtcatccacacaagtgtatgggcaggacaaaagcgtctagggcagctggccaagtggaaaactgctgaggaggttgctgcgttagttcggtctcttcctgtagaagagcagccaaagcaaattattgtgacaaggaagggtatgttggatccattggaagtccatctgcttgatttccctaacattgttatcaagggcagtgagttgcagctgccattccaagcttgcttgaagattgagaagtttggtgatcttattctcaaggctacggaaccgcagatggttctttataacatatacgatgactggctgaaaagtatctcgtcctacaccgcattctctcgtcttgtgcttatattacgagcattacatgtcaataatgagaaggccaagatgttgctgaagcctgacaagacaattgttacggaaccacatcatatctggccatctttgactgacgagcagtggctgaaggtcgaatgtgcactcagggatctcattctttctgattatgcaaagaaaaacaacgttaatacttctgcacttacgcaatctgagattcgtgatataatacttggtgctgaaatagctccaccgtcacagcagaggcaacagatagctgagattgagaaacagtcccgagagacaaatcaggtaactgcacagacaacaaggacagttaatgtgcatggagatgagctcatcgtcacaacaaccagtccgtatgagcaagcagcgtttgcatcgaagacagattggcgtgtcagggccatctctgctacgaacctgtatctccgtgtcaaccacatttatgttaactcggatgatataaaggagactggctatacttacatcatgccaaagaacatattgaagaagttcatatgcatagcagatctacggacacaggttgcaggtttcctgtatgggctgagtccacaggataatccccaagtcaaggagatcagatgcatatccattccgccacagcatggaactcaccagatggtgactttgccatcgaatctcccagagcatgagttccttgctgacttggagccgttgggatggatgcatacccagccgaatgaagctcctcagctatcacctcaggatttgacatcacatgctaaaattttggagaacaacaagcagtgggatggtgagaagtgcatcattttgacctgcagcttcaccccaggatcgtgctcgttgactgcgtacaaattgacaccaagtggttatgagtgggcccgtggcaacaaggacaacgggagcaacccacaagggtacctcccaactcactacgagaaggtccagatgcttctcagcgaccgcttccttggattctacatggttccggacaacgctccgtggaactacaacttcatgggagtcaagcacgacccgctgatgaagtacagcatgaagctgggcacaccccgcgacttctaccatgaggaccacaggccgacgcacttcctggagttcagcaacattgaggagggcgaggtcgccgagggggacagggaggacaccttctcgtagtcgtagccaccgtagcacgccccttcgcccctatgctagcatatcgaaacctgcaatgagatccgctcagttttggatggagatctctgtgatctgtaaactttgacgtgacatgttgtatgttgttctccgtctctcaagactagtaatactttgtgttgtaagcctccttcaaacacggtgctgtacaagtgcatcatgataacagttcaaacattttgcttggtggcat

SEQ ID NO: 914 - DNA, 1743 bp, Avena sativa
gctgcattagttcgttctcttcctgtagaagaacagccaaagcaaattattgtgacaaggaagggtatgttagatccgttggaagtccatcttcttgactttccaaacattgttatcaagggtagtgagttgcagctgccattccaagcttgcttaaagattgagaagttcggtgatcttattctcaaggctacagaaccgcagatggttctttataacatttatgatgattggttgaaaagtatctcatcctacactgcattctctcgtcttgtgcttatattacgagcactacatgtcaataatgagaaggctaagatgttgttgaagcctgacaagacaattgttacggaaccacatcatatctggccaactttgactgatgagcagtggctgaaggtcgaatgtgcgctcagggatctcatcctttctgattatgcaaagaaaaacaatgttaatacgtctgcacttacgcaatctgagattcgtgatataatacttggtgctgaaatagcaccaccgtcacagcagaggcagcagatagctgagattgagaaacagtccagggagacaactcagttaactgcagttacaacaaggacaactaatgtgcatggagatgagctcatcatcacgacaaccagtccgtatgagcaagcagcatttgcgtcaaagacagattggcgtgtcagggccatctctgctacaaacttatatctccgtgtcaaccacatttatgtcaactcagatgatattaaggagactggctatacttacatcatgccgaagaatatattgaagaagttcatatgcatagcagatctacggacacaggttgcgggtttcctgtatgggctgagcccacaggataatccccaagtcaaggagatcagatgcatatccattcccccgcagcatggaactcaccagatggtgactctgccatcgaatcttccggagcatgagttccttgctgacttggaaccgttgggatggatgcatacgcagccgaatgaagctcctcagctatcgcctcaggatttgacatcgcatgccaagattttggagaacaacaagcagtgggatggtgagaagtgcataattttgacatgcagcttcaccccaggatcgtgctcgttgactgcatacaaattgacaccaagcggttatgagtggggccgtagcaacaaggacaacgggagcaacccacatggttatctcccaactcactacgagaaggtccagatgcttctcagcgaccgcttccttggattctacatggttccggacaatgctccctggaactacaacttcatgggagtcaagcacgacccgcagatgaagtacagcatgaagctggggacgcccagagacttctaccatgaggaccacaggccgacacacttcctcgagttcagcaacatcgatgagggtgaggtcgctgagggggacagggaggacaccttctcgtagacaccatactgtagcacgccctccgccctatgtcattagcacatcgagacctgcaatgaactcttgtcagttttgaatagaggcatctctgtaactcgttactttgactttgagctgcaatgaagtattcacagctttgaatgcgattgtatactttctgttgtaagtctgcccttcaagcggcatgctgtacatacaagtgcacgcatgataacggtgaatattttgcttagtggctatgctactgaatgccatctctactgtacttac

SEQ ID NO: 915 - DNA, 3609 bp, Panicum virgatum
accgtgtccgacagattctaatgtcatcagggtcaacaacattcaccaagatagtcaacaagtggaatactgctctcattggccttatgacatatttccgtgaagcaacagtccatacgcaggagcttttggatttacttgtcaaatgtgaaaacaagatccagactcgtattaagattggtctgaattcaaagatgcctagtaggtttcctcctgttatcttctatacacctaaagaaattggaggtcttggtatgttgtcgatgggtcatattcttataccacaaagtgatcttaggtacagtaagcagacagatgttggtgtaacacatttccgaagtggtatgagccatgaagaggaccagcttattcccaacttgtatcgctacatccagccatgggagagtgagtttattgattcacagcgtgtttgggctgaatatgctttgaagaggcaggaagcacagtcacagaacagaagattaactcttgaggatcttgaggactcatgggatagaggtatacctcgtatcaacactcttttccaaaaggaccgccatacgctagcatatgacaaaggatggagagtgagaactgattttaagcaatatcaagtgctgaaacagaatccattctggtggacacatcagcgacatgatgggaagctttggaacctaaataactacagaactgatgtcattcaagcacttggtggtgtagaaggtattctggagcatacactatttaaaggaacttatttccctacttgggagggtctcttttgggagaaggcatcaggtttcgaagagtctatgaaatacaagaaacttacaaatgcacagcgttctgggctcaaccaaatccccaatagaagatttaccctgtggtggtcaccaaccatcaatcgtgcaaacgtgtatgttggtttccaggtccagctagatcttacagggatattcatgcatggcaaaatcccgacattaaagatttctctaatccagatcttccgtgcgcatctgtggcagaagatccatgaaagtgttgttatggatctttgccaagttttggatcaagagttggatgccctggagatagagactgtacagaaagagacgatacatcccaggaagagttacaagatgaacagttcctgtgcagatgtcctcctttttgctgcacacagatggcagatgtcaaagcctagcttagtttctgagtcgaaggatctctttgatcagaaagcaagtaacaagtattggattgatgtgcaactgcgttggggagattatgattcacatgacatagaacgttatacaagagccaagttcatggattacacaacagacaatatgtccatctacccgtcaccaactggggtgatgattggaattgatctagcatataatctgcactccgcttttggcaactggttccctgggtcaaagcccctacttcagcaagcaatgaacaagatcatgaagtcaaatcctgctctgtatgtgctgagggagagaataaggaagggtctgcagttgtactcatctgaacccactgaaccatacctgtcctcacagaactatggagagatcttcagcaatcaaatcatatggtttgtggatgatacaaatgtgtatcgagtcaccattcacaaaacatttgagggtaacttgaccacaaaaccaatcaatggtgctattttcattttcaatccaagaactggtcagctctttcttaaggttatccacacaagtgtatgggcggggcaaaagcgtcttggacagctggccaagtggaaaacagctgaggaagttgctgcattagttcgatctcttcctgtagaagagcagccaaagcaaattattgtgacaaggaagggtatgttggatcctttggaggtccatctacttgatttccctaacattgttatcaagggcagcgaactgcagcttcctttccaggcttgcttaaagattgagaagtttggtgaccttattctgaaggcaactgaaccacagatggtcctttataatatatatgatgattggttgaaaagtatctcttcatacacagcattctctcgtatcgtacttattctacgggctctacatgtgaacaacgagaaggcaaagatgttactcaaacctgacaaaacaattgttaccgaaccacatcacatatggccaactttaaatgatgaacagtggttgaaggttgaatgtgcactaagggacctcattctttctgattatgccaagaaaaacaatgttaatacttctgcactgacacaatctgaaatccgagatatcatacttggtgcggaaattgctccaccatcacagcagaggcaacagattgctgagattgagaaacagtctagagagacgactcagttaaccgctgttaccacaaggacgacgaatgtacatggagatgagctcattatcacgacaacaagtccatacgagcaacaagcatttgcatcaaagactgattggcgtgtcagagcaatctctgccacaaacttgtatcttcgtgtcaatcacatttatgtcaattctgatgatataaaggagactggctacacttacattatgccgaagaacatattgaagaagttcatatgcatagcagatctgcggacgcagattgctggattcttgtatgggctgagtccacaggacaatcctcaagttaaagagatcaggtgtatagccattcctccacagcatggtactcaccagatggtgactctgccagcaaatcttcctgagcatgagttccttaatgacctggaaccattgggatggatgcatacacagccgaatgaagctccacagctatcaccacaggatctgacatcacatgcaaaaattctggagagcaacaaacaatgggatggtgagaagtgcatcattctgacatgcagcttcacgccaggatcttgctccttgactgcatacaagctgacaccaagcggttacgagtggggacgcagcaacaaggacaatgggagcaacccacatggatacctcccaactcattacgagaaggtccagatgcttctgagtgaccgcttccttggcttctacatggttccagataacaccccttggaacttcaacttcatgggtgtgaagcatgacccgctgatgaagtacaatatgaagctgggcatgccccgggacttctaccacgaggaccaccggccaacacacttcttggagttcagcaacatcgaggagggtgaggtcgcggaaggggatagggaggacaccttctcatagtcgccaggctgatactcccccaccccatgtttagctctgtatctgaaacgcacttggctttattttgaacagcgatgtgtgaacctgtaaggtttgtaacctcgcgacgggtatcgtctgctatttacctgttgctttagcctgtattatacctttttgttgtaagacggcccctgagaagatggggtagaattgtaagtgctagcgcacgccatggtaacagtgaagattttggttcgtatagctatgctgatggttcagaacgtcacacgcaaactgataaatgctttcgcttgtgttgaatttatctcacagtcgcgaactg

SEQ ID NO: 916 - DNA, 5698 bp, Setaria italica
atgttgatgctttccagttggcagatggtctgcaatacatattctctcatgttggccagctaactggtatgtataggtacaagtaccgattgatgaggcagattaggatgtgcaaggatctgaagcacttgatatattaccgtttcaacactggccctgttggaaaaggacctggctgtgggttttgggctccaatgtggagagtgtggctcttcttccttcgcggtattgtcccattattggagcgctggttgggtaatttgttggcaaggcagtttgagggtcggcattcgaagggagtagccaaaaccgtaacaaagcaacgtgttgagtctcattttgatttggagcttcgtgctgcagttatgcacgatgttctagatgctatgccagagggcatcaaacaaaacaaggcccggactatattacagcatcttagtgaggcatggcgatgctggaaggcaaatatcccatggaaagtccctggcctacctgtgcctattgagaacatgattcttcgttatgtgaagtcaaaggcagattggtggacgaatgttgctcattacaaccgtgagcgtatcaggcgtggtgctacagttgacaagactgtttgtcggaaaaatcttggaaggttaactcgtctatggctgaaggcagaacaagagaggcaacacaattacctgaaagatgggccatatgtaactcctgaggaagctgttgctatttatacaacaacagttcactggctggaatcaaggaagttctcaccaattccttttccgccactatcatacaagcatgacaccaaacttcttattcttgcactggaaaggctgaaggagtcatacagtgtagcagttaggttgaaccaactgcaacgggaggagcttgggttgattgaacaggcttacgataatccacacgaagcactgtcaaggattaaaaggcatcttcttactcagcgggcgttcaaagaagttggcatagaattcatggacttatacagctacttgatcccagtatatgaaatcgaacctcttgaaaaaatcactgatgcataccttgaccagtacttgtggtacgagggggacaaacgccatctcttcccaaattgggtgaagcctgctgattctgaaccaccacctctacttgtttataaatggtgccagggcataaacaatttacaggatgtatgggacacaagtgatggacagtgtgttgtgatgctccagacaaaatttgagaagttctttgaaaaaattgatctgacactgttgaacaggcttcttcggttggtcttagatcataacatagctgattatgttactgcaaagaacaatgttgtgttgtcttacaaggacatgagccacacaaattcttatggtctcattcgagggcttcagtttgcatcttttgttgttcagtattatggccttgtgctggatctcctgattctcggtctaacacgtgcaagtgagcttgctgggccacctcagatgccaaatgagttccttacatatgctgacacaaaaattgagacaaggcatcccatcagattgtattctcgatatattgacaaggtgcacatattgttccgcttcactcatgaggaagcgcgagatctaattcagcggtacttgacagaacatcctgatcctaacaatgagaacatggttggctacaataacaagaaatgttggcctagagatgcaagaatgaggctgatgaaacatgatgtaaatcttggaagaagtgtgttctgggatatgaagaaccgccttccaaggagtattacaaccttagaatgggagaatagctttgtctctgtttacagcaaggacaatccaaacctgctttttagcatgtgtgggtttgaagtccgtatactgccaaagatacgaatgactcaggaggcattcagcaacacaaaggatggagtatggaatttgcagaatgaacagacaaaagaaaggacagcaattgcctttctgagagtcgatgatgagcatatgaaggtgtttgagaaccgtgttaggcagattctaatgtcatcagggtcaacaacattcaccaagatagtcaacaagtggaatacagctctcattggccttatgacatatttccgcgaagcaacagtccatacgcaggagcttttggatttacttgtcaaatgtgaaaacaagatccagactcgtataaagattggcctgaattcaaagatgcctagtaggtttcctcctgtcatcttctatacacctaaggaaattggaggtctaggaatgctgtcgatgggtcatattcttataccacaaagcgatcttaggtacagtaagcagacagatgttggtgtaacacatttccgaagtggtatgagccatgaagaggaccagcttattcctaacttgtatcgctacatccagccatgggagagtgagtttattgattcacagcgtgtttgggctgagtatgctttgaagaggcaggaagcacaatctcaaaacagacggttgacccttgaggatcttgaagactcatgggatagaggtatacctcgtatcaacactcttttccaaaaggaccgccatacgctagcctatgataaaggatggagagtgagaacagattttaagcaatatcaagtgctgaaacagaacccattctggtggacacatcagcggcatgatgggaagctttggaacctaaataactacagaactgatgtcattcaagcgcttggtggtgtagaaggtatcctggaacatacattatttaaaggaacttatttccctacctgggagggtctgttttgggagaaggcatcaggtttcgaagagtctatgaaatacaagaaactgacaaatgcacagcgttctgggctcaatcaaatccccaatcgaagatttaccctgtggtggtcaccaaccatcaatcgtgcaaacgtgtatgttggtttccaggtccagctagatcttacggggatattcaagcacgggaaaattcccacattgaagatttctctgatccagatcttccgtgcacatttgtggcagaagatacatgaaagtgttgttatggatctttgccaagttttggaccaagagttggatgcactggagatcgagactgtacagaaagagacaatacatcccaggaagagttacaagatgaacagttcatgcgcagatatcctcctctttgctgcacacagatggcagatgtcaaaaccaagcttagtttctgagtcgaaggatctcttcgatcagaaagcaagtaacaagtattggattgatgttcaactgcgttggggagattatgattcgcatgacatagaacgttatacaagagccaagttcatggattacacaacagacaatatgtccatctacccatcacctactggggtgatgattggaattgatctagcgtataatttgcactctgcttttggcaactggttccctgggtcaaagcccctacttcagcaagcaatgaacaagatcatgaagtcaaatcctgctctgtatgtgctgagggagaggataaggaagggtctgcagttgtactcatctgaacccactgaaccatatctgtcttcacaaaactatggagagatcttcagcaatcaaatcatatggtttgtggatgatacaaatgtgtatcgagtcactattcacaaaacctttgagggtaacttgaccacaaaaccaatcaacggtgctattttcattttcaatccaagaactggtcaacttttccttaaggttatccacacaagtgtatgggcggggcaaaagcgtcttggacagctggccaagtggaaaacagctgaggaggttgctgcattggttcgatctctgcctgtagaagagcagccaaagcaaattattgtgacaaggaagggcatgttggatccattggaggtccatctactcgacttccctaacattgttatcaagggcagtgagctgcaacttcctttccaggcttgcttaaagattgagaagtttggtgatcttattctgaaggcaactgaaccacagatggttctttataatatatatgatgattggttgaaaagtatctcttcatacacagcattctctcgtatcgtacttattctacgggctctacatgtgaataacgagaaggcaaagatgttgctcaaacctgacaaaacaattgttactgaaccacatcatatatggccaactttgaatgatgaacagtggttgaaggttgaatgtgcactaagggacctcattctttctgattatgcaaagaaaaacaatgtcaatacttctgcactgacgcaatctgaaattcgagatatcatacttggtgctgaaattgctccaccatcacagcagcggcaacagatagctgagattgagaaacagtctagagagacgactcagttaactgctgttaccacaaggacaacgaatgtacatggagatgagctcattatcacgacaacaagtccatacgagcaacaagcgttcgcatcgaagactgattggcgtgtcagggccatctctgccacaaacttgtatcttcgtgtcaatcacatttatgtcaattctgacgatataaaggagactggctacacttatattatgccaaagaacatactgaagaagttcatatgcgtagcagatctgcggacacaaatcgctggattcttgtatgggctgagtccacaggacaatcctcaagttaaagagatcaggtgtatagccattccaccgcagcatggaactcaccagatggtgaccctgccagcaaatcttcctgagcatgagttccttaatgacctggaaccattgggatggatgcatacccagccaaatgaagctccacagctatcaccacaggacctgacatcacacgctaagattctggagggcaacaaacaatgggatggtgagaagtgcatcattctgacatgcagcttcacgccaggatcttgctcgttgactgcatacaagctgacaccaagcggttacgagtggggacgcagcaacaaggacaatgggagcaacccgcatggatacctcccaactcattatgagaaggtccagatgcttcttagtgaccgcttccttggcttctatatggttccagataacgtcccttggaacttcaacttcatgggagtgaagcatgacccgctgatgaagtacaatatgaagctgggcatgccccgggacttctaccacgaggaccaccggccaacacacttcctggagtttagcaacatcgaggagggtgaggtcgcagaaggggatagggaggacaccttctcgtaggcgctgggacgcccccaccccaaatgtttagctctgtatctgaaacgcactgagctttgttttggacagcgatgtgtgaacctgtaaggctgtaagctgacgcaacgggttgtacccatagcaacgggctgtaagcccccaccccaaatgttgctctagcttgtattatacctttttgttgtaagccaacccttgagagacggggtaaaaatgtacaagtgcacgccatggtaacagtaagattttggttcgtagctatgctgatagttctgaacttgacacgcaggctgatagtgatttcccattgttttctgtttctgtacttgctttataggacccggctcaagaggttgcaggttcggtcccggataaattttggtggatatttt

SEQ ID NO: 917 - DNA, 7419 bp, Oryza sativa
tcaatctcgaacccgaactcaccactccactcgagacttgaaccctagcggcagcagcgggaggccgggccgccgcgcttgcctgcttccccccgtcgccgccgacgatgtggagcggcgggccgccgccgcctccccctccgccgatgggggccgcgccgcctcccccgggcacgggcgctccgcctccgccgctgccggcggcggcggcggccgcgggtccccccggcggcggcaagccgctgacgccggcggagctcgaggcgcagctggtggagaaggcgaggaagtggcaccagctcaactcgaagcggtacggcgacaagcgcaagttcgggttcgtcgaggcgcagaaggaggacatgccccccgagcacgtccgcaaaatcatcagggaccatggtgacatgtcttcaaagaagtacaggcacgataagcgtgtatatcttggagcactcaaatttgtgcctcatgctgtttacaagctactggaaaatatgccaatgccctgggaacaggtccggcatgtaaagattctgtaccatatcactggtgcaataacctttgtaaatgagatcccatgggtagttgagcccatttaccttgcacagtggggcacgatgtggatcatgatgaggagggagaagagagataggcgacatttcaagagaatgcgctttcctccatttgatgatgaggaacctccattagactatgctgataatttgctggatgttgaaccactggaggctatacagttggaattggatgaggaggaagattcagctgtgcatgaatggttttatgatcataagccgcttgttaagacaaagcttataaatggccccagctacaggaaatggcatctatcgcttcccataatggcaacactctatcgtcttgctggccaacttttgtcagatttgattgatcgaaattatttctatttgtttgatatggagtctttctttaccgccaaagcactcaacatgtgtatcccaggaggtccgaagtttgagccactgtaccgtgatatggagaagggggatgaggactggaatgagtttaatgacatcaacaaactcatcatccgccaaccacttaggacagagtatagaattgcttttccacacttgtacaataacaggccaaggaaagtgaggcttggggtatatcatactccaatgataatgtatatcaagacagatgatccagacttgcctgcattttactatgatcctttgataaatcctataacttcgacaagcaaggttgatcgtcgggagaggaggacaattgaagaggatgaagatgaggacttctgtctcccggatggtgtggagcccctcttgaaaggaacagaactttacactgatacaacagcagctggcatttcattactctttgctccaaagccttttaatatgaggtctggtagaacacgtcgtgctgaagatatccctcttgtatctgaatggtacaaggagcactgcccaccagcttatccagtgaaggtgcgtgtcagctatcagaagctactgaagtgttatgtgctcaatgagctacatcataggcctcccaaggcgcagaagaagaagcatctgttccgttcactccaagcgacaaagttttttcaaacaacggagcttgactgggcagaagcaggtttgcaagtttgcaaacagggttacaatatgttgaacttgttgatccacagaaagaaccttaactaccttcacttagactacaacttcaatttgaaacctgtgaagactctcacaacaaaggaaaggaaaaaatctcggtttggaaatgcatttcatttatgccgtgagatattacgacttactaagttagtagttgatgcaaacatccagttccgcttgggaaatgttgatgctttccagttagcagatggcttgcaatatatattctctcatgttggccagctgactggtatgtaccgctacaagtatcgtctgatgcggcaaatcaggatgtgcaaagatctgaagcacttgatatactaccggttcaatactggtcctgtaggaaaaggacctggctgtggattctgggctccaatgtggagggtgtggctgttttttctgcggggtattgtaccactgcttgaaagatggttaggtaatctactggccaggcagtttgagggtcgtcattcaaaaggagttgctaaaactgtaaccaagcaacgtgttgagtctcactttgatcttgaacttcgagctgctgttatgcatgatgtccttgatgctatgcctgagggtatcaagcaaaacaaggcacggactatactacagcatcttagtgaggcatggcggtgctggaaggcaaatatcccatggaaggtcccaggcctaccggttcctattgagaacatgatacttcgttatgtaaagtccaaggctgattggtggaccaatgttgctcactacaatcgtgagcgtatcaggcgtggtgctacagtcgacaagactgtgtgccgcaagaatcttggaagattaacccgtttgtggctgaaggcagaacaggagaggcagcacaactacctgaaagatgggccatatgtgacacctgaagaggcagttgctatctacacaacaacagttcattggctagaatcaaggaagttctcacctattccttttcctcctctttcttacaagcatgacaccaaacttcttatactagctctggaaaggctaaaggaatcttacagcgtggcagtaaggttaaatcaactgcagcgggaggaacttggattgattgagcaagcatatgataatcctcatgaggcactgtcaaggataaagcggcatcttcttactcagcgtgcttttaaagaagttggcattgagtttatggacctgtacagctaccttattccggtatatgaaattgagcctcttgagaaaatcaccgatgcttaccttgaccagtacttgtggtatgagggggacaagcgacacctattcccgaactgggtcaagcctgctgattcagaaccacctcctctgcttgtttacaaatggtgccaaggtataaataatctacaggatgtatgggacactagtgacgggcagtgtgttgtgatgctgcagacaaaatttgaaaagttcttcgaaaaaattgatctgacactgttgaacaggcttctgcggttggtcttggaccacaatattgctgattatgtcactgcaaagaacaatgttgtattatcttacaaggatatgagtcatactaattcttatggtctcattcggggtctacagtttgcatcatttgttgtgcaatactatgggcttgtgctggatctccttctgctcggtttaacacgtgcaagcgagattgcggggccacctacgatgcctaatgagttccttacatatgctgataccaaagttgagacaaggcatcctattcggctgtattctcggtatgtcgacaaggtgcatataatgttccgctttactcacgaggaagcacgcgatttaattcagcgttatttgactgagcatcctgatcctaataatgagaacatggtcggttacaacaacaagaaatgttggcctagagacgcaagaatgaggctcatgaagcatgacgtaaatcttggaagaagtgttttttgggacatgaagaaccgcctcccaaggagcatcacaacgttagagtgggagaacagctttgtctctgtttacagcaaggacaaccctaatctgctttttagcatgtgcgggtttgaggttcgtatactaccaaagatacggatgactcaagaagcgtttagtaacaccaaagatggagtctggaatttgcagaatgaacagacaaaagaaaggacagctattgcctttctaagagttgatgatgaacatatgaaagtgtttgagaaccgtgtcaggcaaatccttatgtcctcagggtcgactacattcactaagattgttaacaagtggaataccgctctcattggtcttatgacatatttccgggaagcaactgtccatacccaggagctcttggatttacttgtcaaatgtgaaaacaagatccagactcgcataaagattggcctgaactcaaaaatgcctagcaggtttccgcctgttatcttctatacacccaaggaaattggaggtctgggaatgttatcgatgggtcacattctgataccacagagtgacctcaggtacagtaaacagacagatgttggtgtgacacattttcggagtggtatgagccatgaagaggaccagcttatccctaacttatatcgctacattcagccctgggagagtgagtttattgattcacagcgggtttgggctgagtatgctttgaagaggcaggaagcacaatcacagaacagacggttgacacttgaggatcttgaagattcatgggatagaggtattcctcgtatcaacactcttttccaaaaagaccgtcatactttggcatatgataagggatggagagtgagaacagatttcaagcagtaccaagtgctcaaacaaaacccattctggtggacacatcagagacatgatggaaagctatggaacctaaacaactataggactgatgtcatccaagctcttggtggtgttgagggtattttggaacacaccttgtttaaaggaacatatttccctacttgggagggtctgttttgggagaaagcgtcaggttttgaggagtccatgaaatacaagaagctgactaatgcacaacgttctggtctcaatcagatacccaaccgaagatttaccctgtggtggtcaccaaccatcaatcgtgcaaatgtgtatgttggtttccaggttcagctagatcttaccgggattttcatgcatgggaaaattccaaccctgaagatttctttaatccagatcttccgtgcgcatctgtggcagaagatccatgaaagtgttgttatggatctttgccaagttttggatcaagagctggatgcactggagattgagacagtgcagaaagagacaatacatccgagaaagagctacaagatgaacagctcctgtgcagatatcctcctttttgcggcacataggtggcagatgtccaaaccaagcttagtctctgagtcaaaggatgtctttgatcagaaagctagtaacaagtattggattgatgtgcaactacgctggggagactatgattcacatgacattgagcgttatacaagggccaagttcatggactacactactgacaatatgtctatctatccatctccaactggggtgatgattggaattgatctagcatataatttgcactctgcttttggcaattggttccctgggtcaaagcccctccttcagcaagcaatgaacaagataatgaagtcaaatcctgctctgtacgtgctgagggagagaataaggaagggtctacaactgtattcttcggaacccactgagccatatttgtcttcacagaactatggagagatattcagcaatcagatcatatggtttgtggatgacacaaatgtctatcgagttaccattcacaaaacattcgagggtaacttgaccactaaaccaatcaatggtgctatttttatttttaatccaagaactggtcaattatttctgaaggtcatccacacaagtgtatgggctggacaaaagcgtcttggacagctggccaagtggaaaacagctgaagaggttgctgcattagttcggtcgcttcctgtagaagagcagccaaagcaaatcattgtgacaaggaagggcatgttggatcctttggaggtccatctgcttgacttccctaacatcgttatcaagggcagtgagttgcagctgccattccaagcttgtttgaagattgagaagtttggtgatcttattctcaaggctacagaaccccagatggttctgtacaacatatatgatgattggttgaagagtatctcatcattcactgctttctctcggattgtgcttatattgcgtgcacttcatgtcaataatgagaaggcaaagatgctgctcaagcctgacaagaccattgttacggaaccacatcatatttggccaaccttgactgatgagcaatggctgaaggttgaatgtgcactcagggaccttattctgtctgattatgcgaagaaaaacaatgttaatacttctgcattgacacaatctgaaattcgtgatatcatacttggtgctgaaatagctccaccatcacagcagaggcaacagatagctgaaattgagaaacagtctagagagacgactcagctgactgcagttactacaaggacaaccaatgtgcatggagatgagctcatcatcacgacgaccagtccgtatgagcaacaagcatttgcatcaaagactgattggcgtgtcagggccatctctgccacgaacttgtatcttcgtgttaatcacatttatgttaattcagatgatataaaggagactggctacacttacattatgccgaagaatatattaaagaagttcatatgcatagcagatttaaggacacagattgcaggttttctatatgggctgagtccacaggataacccccaagttaaagagatcagatgcatagctattcctccacagcacggaactcatcagatggtgacactgcctgcaaaccttcctgagcacgagttccttaatgatttggagccactgggctggatgcatacccagcctaatgaagctccccagctatcaccacaggatttgacatcgcacgccaagatcttggagaacaacaagcaatgggatggtgagaagtgcatcattttgacatgcagctttaccccaggatcttgttcattgaccgcgtacaagttgacgccaagtggttacgagtggggccgtagcaacaaggacagtggaagcaacccacatggatatctcccgactcactacgagaaggtccagatgcttctcagtgacagattcctaggattctacatggtgccggataacaccccttggaacttcaacttcatgggagtgaagcacgacccgctgatgaagtacaacatgaagcttggcacgcccagggacttctatcacgaggaccatcggccgacacatttcctcgagttcagcaacatcgacgagggcgaggtcgcggaaggtgatagggaggacaccttcacgtagcctgtctgctatgaacttcacgccgtcttgagtagagagttcaataacctgtgacttgacgcgacctgtagtagcatatgatcagtttgtttcgagaggttgtattccctgatgtagtctgcccttcaaagaactgggtgtgacatgatatgtactaaaatgacatgcagttcttgcagctgagatcacagagagtaaatgtaagcagagatcacatcac

SEQ ID NO: 918 - DNA, 3710 bp, Oryza sativa
gtttagtaacaccaaagatggagtctggaacttgcagaatgaacagacaaaagaaaggacagctattgcctttctaagagttgatgatgagcatatgaaagtgtttgagaaccgtgtcaggcaaatccttatgtcctcagggtcaactacattcactaagattgttaacaagtggaatactgctcttattggtcttatgacatatttccgtgaagcaactgttcatacccaggagctcttggatttacttgtcaaatgtgaaaacaagattcagactcgcataaagattggactgaactcaaaaatgcctagcaggtttccgcctgttatcttctatacacccaaggaaattggaggtctgggaatgttatcgatgggtcacattctgataccacagagtgatctcaggtacagcaaacagacagatgttggtgtgacacattttcggagtggtatgagccatgaagaggaccagcttatccctaacttatatcgctacattcagccctgggagagtgagtttattgattcacagcgggtttgggctgagtatgctttgaagaggcaggaagcacaatcacagaacagacggttaacacttgaggatcttgaagattcatgggatagaggtattcctcgtatcaacactcttttccaaaaagaccgtcatactttggcatatgataaaggatggagagtgagaacagactttaagcagtaccaagtgctcaaacaaaatccattctggtggacacatcagagacatgatggaaaactatggaacctaaacaactataggactgatgtcatccaagctcttggtggtgttgagggtattttggaacacaccttgtttaaaggaacgtatttccctacttgggagggtctgttttgggagaaagcgtcaggttttgaggagtccatgaaatacaagaagctgacgaatgcacaacgttctggtctcaatcagatacccaaccgaagatttaccctgtggtggtcaccaaccatcaatcgtgcaaatgtgtatgttggtttccaggttcagctagatcttacgggcattttcatgcatgggaaaattccgaccctgaagatttctttaatccagatcttccgtgcgcatctgtggcagaagatccatgaaagtgttgttatggatctttgccaagttttggatcaagagctggatgcactggagattgagacagtgcagaaagagacaatacatccgaggaagagttacaagatgaacagctcctgtgcagatatcctcctttttgctgcacataggtggcagatgtctaaaccgagcttagtctctgagtcaaaggatgtctttgatcagaaagctagcaacaagtattggattgatgtgcaacttcgatggggagactatgattcacatgacattgagcgttatacaagggccaagttcatggactacactactgacaatatgtcgatatatccatctccaacaggggtgatgattggaattgatctagcatataatttgcactctgcttttggcaattggttccctgggtcaaagccccttcttcagcaagcaatgaacaagataatgaagtcaaatcctgctctgtacgtgctgagggagagaataaggaagggtctacagctgtattcttcagaacccactgagccgtatttgtcttcacagaactatggagagatattcagcaatcagatcatatggtttgtggatgacacaaatgtctatcgagttaccattcacaaaacatttgagggtaacttgaccactaaaccaatcaatggtgctatttttattttcaatccaagaactggtcaactatttctgaaggtcatccacacaagtgtatgggctggacaaaagcgtcttggacaactggccaagtggaaaacagctgaagaggttgctgcattagttcggtcgcttcctgtagaagagcagccaaagcaaatcattgtgacaaggaagggtatgttggatcctttggaggtccatctgcttgacttccctaacattgtgatcaagggcagtgagctgcagctgccattccaagcttgtttgaagattgagaagttcggtgatcttattctcaaggccacagaaccccagatggttctttacaacatatatgatgattggttgaaaagtatctcatcattcactgctttctctcggattgtgcttatattgcgtgcacttcatgtcaataatgagaaggcaaagatgctgctcaagcctgacaaaactattgttacggaaccacatcatatttggccaaccttgactgatgagcaatggctgaaggttgaatgtgcactcagggacctcatcctgtctgattatgcaaagaaaaacaatgttaatacgtctgcgctgacacaatctgaaattcgtgacattatacttggtgctgaaatagctccaccatcacagcagaggcaacagattgctgaaattgagaaacagtctagagagacgactcagctgaccgcagttactacaaggacgaccaatgtgcatggagatgagctcatcatcacaacgaccagtccatacgagcaacaagcatttgcatcaaagactgattggcgtgttagggctatctctgccacaaacttgtatcttcgtgtcaatcacatttatgttaactcagatgatataaaggagactggctacacttacattatgccaaagaatatattaaagaagttcatatgcatagcagatttaaggacacagattgcagggtttctgtatgggctgagcccacaggataatccccaagttaaagagatcagatgcatagctattcctccgcagcacggaactcatcagatggtgacactgcctgcaaaccttcccgagcacgagttccttaatgatttggagccactgggatggatgcatacccaaccaaatgaagctcctcagctatcaccacaggatttgacatcacatgccaagatcttggagaacaacaagcaatgggacggtgagaagtgcatcattttgacatgcagctttaccccaggatcttgttcattgaccgcgtacaagctgacgccaagcggttacgagtggggccgtagcaacaaggacaccggaagcaacccacatggatatctcccgactcactacgagaaggtccagatgcttctcagcgacagattcctgggattctacatggtgccggataacaccccttggaacttcaacttcatgggagtcaagcacgacccgctgatgaagtacaacatgaagcttggcacgccccgggacttctatcacgaggaccatcggccgacgcatttcctcgagttcagcaacatcgacgagggcgaggtcgcagaaggtgatagggaggacaccttcacgtaagcaggcgccacgaacgcctatgctaccatagcctttctgctacgaacttcgcgctgtttcgagtagagatccgtaacctgtaacttgacgcaaccggtagtagcatatgatgcttgttttgaggagattgtataccctgatgtagtctgcccttgaaagaacagggtgtttgtagtttgtacaagtgcacgccatgataacagtgaagattttgcttactctcgatattgtattatgtagatctcggctaagatatattattgcatcctactaatcataaagcaatgctggtagtcggccgagtgtttcttggcaa

SEQ ID NO: 919 - DNA, 5575 bp, Sorghum bicolor
gtctgcaatatatattatctcatgttgggcagttaactggtatgtataggtacaagtaccgattgatgaggcagagtaggatgtgcaaagatctgaagcacttgatatattaccgtttcaacactggtcctgttggtaaaggacctggttgtgggttttgggctccaatgtggagagtgtggctcttcttccttcgaggtattgtcccactattggagcgctggttgggtaatcttttggcacggcagtttgagggtcgtcattccaagggtgtggacaaaacagtaacaaagcaacgtgttgagtctcactttgatttagaactccgtgctgcagttatgcatgatgttctagatgctatgcctgaaggcatcaagcaaaacaaggctcgaactatattacagcatctcagtgaggcatggcgatgctggaaggcaaatatcccatggaaagtccctggtctgcctgtgcctattgagaacatgattcttcgttatgtgaagtcgaaagcagactggtggacaaatgttgcccactacaatcgtgagcgcatcaggcgtggtgctacagttgacaaaactgtttgtcggaaaaatctaggaaggttaactcgtctgtggctgaaggcagagcaagagaggcagcacaattacttgaaagatgggccatatgtaactcctgaagaagctgttgctatctatacaacaactgttcattggctggaatcaagaaagttctcaccaattccttttccgccgttgtcatacaagcatgacactaaacttcttatacttgcactggaaaggctgaaggagtcatacagtgtagcagttagattgaaccaactgcaacgagaggagcttgggttgattgaacaagcgtatgataatccacatgaagcactgtcaaggataaaaaggcatctccttactcagcgagctttcaaagaagtcggtatagaattcatggacctgtacagctacttgattccggtatatgaaattgaacctcttgaaaagatcactgatgcataccttgaccaatacctgtggtacgagggggacaaacggcacctcttcccaaattgggttaagcctgctgattcagaaccaccacctcttcttgtttataaatggtgccagggcataaataatttactggatatatgggacacaagtgatggacaggtgttgtgatgctccagacaaaatttgagaagttcttcgaaaaaattgatctgactctgttgaacaggcttctgcggttagtcttggatcataacatagctgactatgtcactgcaaagaacaatgtagtgttgtcttacaaggacatgagtcacacaaattcgtatggtctcattcgagggcttcaatttgcatcttttgttgttcagtattatggccttgtgctggatctcctgattcttggtctaactcgtgcaagtgagattgctgggccacctcaaatgccaaatgagttccttacatacgctgacacaaaagttgagacaaggcatcccatcagattgtattctcgatatattgacaaggtgcacatattgttccggttcacccatgaggaagcacgagatctaattcagcgttacttgacagaacatcctgatcctaacaatgagaacatgttggttacaataacaagaaatgttggcccagagatgcaagaatgaggcttatgaaacatgatgtgaatcttggaagaagtgtgttctgggatatgaagaaccgccttccaaggagcattacaactttagaatgggagaatagctttgtctctgtttacagcaaggacaatccaaacctgctttttagcatgtgtggctttgaagtccggatactgccaaagatacggatgactcaggaggcgttcagcaacacaaaagatggagtatggaatttgcagaatgaacagacaaaagaaaggacagcaattgccttcctgagggttgatgatgaacatatgaaagtgttcgagaaccgtgtccggcagattctaatgtcatcagggtcaacaacattcacgaagatagtcaataagtggaatacggctctcattggccttatgacatattttcgtgaagcaactgtccatacccaggagcttttggatttgctagtcaaatgtgaaaacaagattcagactcgtataaagattggcctgaactcaaagatgcctagcaggtttcctccagttatcttctacactcccaaggagattggaggtcttggaatgttatcaatgggccatattcttataccgcagagcgatcttaggtatagcaagcagacagatgttggtgtaacacattttagaagtggtatgagccatgaagaggaccagcttattccaaacttgtaccgctacatccagccatgggagagtgagttcattgattcacagcgtgtttgggctgagtatgctttgaagaggcaggaagcgcaatcacagaacagacgattaactcttgaggatcttgaggattcatgggatcgaggtatacctcgtatcaacactcttttccaaaaagaccgccatacgctggcctatgacaaaggatggagagtgagaacggactttaagcaatatcaagtgctgaaacagaacccattctggtggacacatcagcggcatgatgggaagctttggaatctaaataactacagaactgatgtcattcaagcacttggtggtgtagaaggcatcctggagcatacattgtttaaagggacttatttccctacttgggagggtctgttttgggagaaggcatcaggtttcgaggagtcaatgaaatacaagaagctgacaaatgcacagcgttctggtctcaatcaaatccctaatcgaagatttaccttgtggtggtcaccaaccatcaatcgtgcaaatgtgtatgttggtttccaggtccagctagatcttacggggatattcatgcatgggaaaatcccgacattgaagatttctctgatccagatcttccgcgcacatctgtggcaaaagatccatgaaagtgttgttatggatctttgccaagttttagaccaggagttggatgcacttgagattgagactgtgcagaaggagacaatacatcccaggaagagttacaagatgaacagctcctgtgcagatatccttctgtttgctgcacacagatggacgatgtccaaaccaagcttagtttctgagtcgaaggatctctttgatcagaaagcaagtaataagtactggattgatgtgcaactgcgttggggagactatgattcacatgacatagaacgttatacaagagccaagttcatggattacacaacagacaatatgtccatatacccatcgccaactggtgtgatgattggaatcgatctagcttataatttgcactctgcttttggcaactggtttcccggatcaaagccactacttcagcaggcaatgaacaagatcatgaagtcaaatcctgctctgtatgtcctgagggagagaataaggaagggtctgcagttgtactcttctgaacccactgaaccatacctgtcttcacagaactatggagagatattcagcaatcagatcatatggtttgtggatgatacaaatgtgtatcgagtcactattcacaaaacatttgagggtaacttgaccaccaaaccaatcaatggtgctattttcattttcaatccaagaacgggtcaactttttcttaaggttatccacacaagtgtatgggcggggcaaaaacgtcttgggcagctggccaagtggaaaacagctgaggaggttgctgcattagttcgatctcttcctgtcgaagagcagccaaagcaaattattgtgacaaggaagggcatgttggatcccttggaggtccatctacttgacttccctaacattgttatcaagggcagcgagctgcagctccctttccaggcttgcttgaagattgagaagtttggtgatcttatactgaaggcaactgaaccacagatggttctttataatatatatgatgattggttgaaaagtatctcatcatacacagcattctctcgcattgtgcttattctacgtgcacttcatgtgaataatgagaaggcaaagatgttgctcaaacctgacaaaacaattgttactgaaccacatcatatatggccaagtctgaatgatgaacagtggttgaaggttgagtgtgcactaagggacctcattctttctgattatgcaaagaaaaacaatgttaatacttctgcactcacacaatctgaaatgcgagatatcatccttggtgctgaaattgctccaccatcacagcagaggcaacagattgctgaaattgagaaacagtcaagagagacaactcagttaactgctgtaaccacaaggacgacaaatgtccacggagatgaactcattatcacaaccacaagtccatacgagcaacaagcattcgcatcaaagactgattggcgtgtcagagccatctccgccacaaacttgtatcttcgtgtaaatcacatttatgtcaattctgatgatataaaggagactggctacacttacattatgccaaagaacatattgaagaaattcatatgcatagcagatctccggacacaaattgctggattcttgtatgggctgagtccacaggacaatcctcaagttaaagagattaggtgtatagccattcctccgcagcatggaacacaccagatggtgactctgccaacaaatcttcctgagcatgagttccttaatgatctcgaacccttgggatggatgcacacacagccaaatgaagctccacagctatcgccacaggacctgacatcacatgccaagattctggagaacaacaaacaatgggatggtgagaagtgcatcattctgacatgcagcttcaccccaggatcttgctcgttgactgcatacaagttgacaccaagcggttatgagtggggacgcagcaacaaggacaacggaagcaacccgcatgggtacctcccaactcattacgagaaggtccagatgcttctgagcgatcgcttccttggtttctacatgattccggataacgccccttggaacttcaacttcatgggagtgaagcacgacccacagatgaagtacaacatgaagctgggcatgccccgggacttctatcacgaggaccacaggccgacacacttccttgagttcagcaacatcgaggagggagaggtcgctgaaggtgatagggaggacacgttcacgtaggcgcctgttagaaactgtatctcaaacgcacttagctctgttttgaacggcaatgtgtgaagctgtaacctgactcgacgggtgtcatctgttgttcacctgtattatactaccttttttgttgtaagacagccctggagaaaggggttaaaattgtacaagtgcacgccatggtaacagtaaaatttttgcttagtagctatgttattccatgactgttcaatcgcaaactacaacgttcaagcggaattgattgatagtttgcattaatggctcgagctttgtgctttctatg

SEQ ID NO: 920 - DNA, 4101 bp, Saccharum officinarum
cctgatacttggtctaactcgtgcaagtgagattgctgggccacctcaaatgccaaatgagttccttacatacgctgacacaaaagttgagacaaggcatcccatcagattgtattctcgatatattgacaaggtgcatatattgttccggttcacccatgaggaagcacgagatctaattcagcgttacttgacagaacatcctgatcctaacaatgagaacatggttggttacaataacaagaaatgttggcccagagatgcaagaatgaggcttatgaaacatgatgtgaatcttggaagaagtgtgttctgggatatgaagaaccgccttccgaggagcattacaactttagaatgggagaacagctctgtctctgtttacagcaaggacaatccacacctgctttctagcatgtgtggctttgaagtccggatactgccaaagatacggatgactcacgaggcgttcagcaacacacaagatggagtatgggatttgcagaatgaacagacaaaagaaaggacagcaattgccttcctgagggttgatgatgaacatatgaaagtgttcgagaaccgtgtccggcagattctaatgtcatcagggtcaacaacattcacgaagatagtcaataagtggaatacggctctcattggccttatgacatattttcgtgaagcaactgtccatacccaggagcttttggatttgctagtcaaatgtgaaaacaagatccagactcgtataaagattggcctgaattcaaagatgcctagcaggtttcctccagttatcttctatactcccaaggagattggaggtcttggaatgttatcaatgggccatattcttataccacagagcgatcttaggtatagcaaacagacagatgttggtgtaacacattttagaagtggtatgagccatgaagaggaccagcttattccaaacttgtaccgctacatccagccatgggagagtgagtttattgattcacagcgtgtttgggctgagtatgctttgaagaggcaggaagcacaatcacagaacagacgattaactcttgaggatcttgaagattcatgggatcgaggtatacctcgtatcaacactcttttccaaaaagaccgccatacgctggcctatgacaaaggatggagagtgagaacggattttaagcaatatcaagtgctgaaacagaacccattctggtggacacatcagcggcatgatgggaagctttggaatctaaataactacagaactgatgtcattcaagcacttggtggtgtagaaggcatcctggagcatacattatttaaagggacttatttccctacttgggagggtctgttttgggagaaggcatcaggtttcgaagagtcaatgaaatacaagaaactgacaaatgcacagcgttctggtctcaatcaaatccctaatcgaagatttaccctgtggtggtcaccaaccatcaatcgtgcaaatgtgtacgttggtttccaggtccagctagatcttacggggatattcatgcatgggaaaatcccgacattgaagatttctctgatccagatcttccgtgcacatctgtggcaaaagatccatgaaagtgttgttatggatctttgccaagttttagaccaggagttggatgcacttgagattgagactgtgcagaaggagacaatacatcccaggaagagttacaagatgaacagctcctgtgcagatatccttctctttgctgcacacagatggacgatgtccaaaccaagcttagtttctgagtcgaaggatctctttgatcagaaagcaagtaacaagtactggattgatgtgcaactgcgttggggtgactatgattcacatgacatagaacgttatacaagagccaagttcatggattacacaacagacaatatgtccatatacccatcgccaactggtgtgatgattggaatcgatctagcgtataatttgcactctgcttttggcaactggtttcccggatcaaaaccactaattcagcaggcaattaacaagatcatgaagtcaaatcctgctctgtatgtcctgagggagagaataaggaagggtctgcagttgtactcttctgaacccactgaaccatacctgtcttcacaaaactatggagagatattcagcaatcaaatcatatggtttgtggatgatacaaatgtgtatcgagtcactattcacaaaacatttgagggtaacttgaccaccaaaccaatcaatggtgctattttcattttcaatccaagaacgggtcaactttttcttaaggttatccacacaagtgtatgggcggggcaaaaacgtcttgggcagctggccaagtggaaaacagctgaggaggttgctgcattagtgcgatctcttcctgttgaagagcagccaaagcaaattattgtgacaaggaagggcatgttggatcccttggaggtccatctacttgacttccctaacattgttatcaagggcagcgagctgcagcttcctttccaggcttgcttgaagattgagaagtttggtgatcttatactgaaggcaactgaaccacagatggttctttataatatatatgatgattggttgaaaagtatctcatcatacacagcattctctcgcattgtgcttattctacgtgcgcttcatgtgaataatgagaaggcaaagatgttgctcaaacctgacaaaacaattgttactgaaccacatcatatatggccaactctgaatgatgaacagtggttgaaggttgagtgtgcactaagggacctcattctttctgattatgcaaagaaaaacaatgttaatacttctgcactcacacaatctgaaatgcgagatatcatccttggtgctgaaattgctccaccatcacagcagaggcaacagattgctgaaattgagaaacagtcaagagagacgactcagttaactgctgtaaccacaaggacgacaaatgttcatggagatgaactcattatcacaaccacaagtccatacgagcaacaagcattcgcatcaaagactgattggcgcgtcagagccatctctgccacaaacttgtatcttcgtgtaaatcacatttatgtcaattctgatgatataaaggagactggctacacttacattatgccaaagaacatattgaagaaattcatatgcatagcagatctgcggacacaaattgctggattcttgtatgggctgagtccacaggacaatcctcaagtcaaagagattaggtgtatagccattcctccgcagcatggaacacaccagatggtgactctgccagcaaatcttcctgagcatgagttccttaatgatctcgaacccttgggatggatgcatacacagccaaatgaagctccacagctatcgccacaggacctgacatcacatgccaagattctggagaacaacaaacaatgggatggtgagaagtgcatcattctgacatgcagcttcaccccaggatcttgctcgttgactgcatacaagttgacaccaagcggttacgagtggggacgcagcaacaaggacaacggaagcaacccgcatggataccttccaactcattacgagaaggtccagatgcttctgagcgaccgcttccttggtttctacatgattccggataacgccccttggaacttcaacttcatgggagtgaagcatgacccacagatgaagtacaacatgaagctgggcatgccccgggacttctatcacgaggaccacaggccgacgcacttccttgagttcagcaacatcgaggagggagaggtcgctgaaggtgatagggaggacacattcacgtaggcgtctgttagaaactgtatctcaaacgcacttagctctgttttgaacggccatgtgtgaagctgtaacctgactcgacgggtgtcacctgttgttcgcctgtggcttaaacatatattatactacctttttgttgtaagacagccctggagagaggggttaaaattgtacaagtgcacgccatggtaacagtaaagattttgcttagtagctatgttattctaagactgtttcatccc

SEQ ID NO: 921 - DNA, 7458 bp, Zea mays
tccatttccccttcccttttcactccgaagtccgacctctctcgaacacacaccacaccaccccgcttgacgacgcttaaaccctagcggcagttgcgggaggccgccgcgccgcgccgcgccgccccgtcgccgatgtggaacggcgcgccgcctccgccgccgccgcagatggcggcggccccgcctccccctggcacgacggtgcccggggcaggccaacctccgcccccgccgccgccggccggggcgccgttgggcggcaagccgctgacgccggccgagctcgaggctcagctggtggagaaggcccgcaagtggcaccagctcaactccaaacgctacggcgacaagcgcaagttcgggttcgtcgaggcacagaaggaggacatgcctcctgagcacgtccgcaaaatcatcagagaccacggagacatgtcttccaagaagtacaggcatgacaagcgtgtttatcttggtgcactcaaatttgtgccccacgctgtgtacaaacttctagagaacatgccgatgccttgggagcaggttcgccatgtgaaaatcttgtatcacatcactggggctatcacttttataaatgaaatcccatgggttgttgaaccaatatacctcgcacagtggggtacaatgtggattatgatgcggcgagagaaaagggataggcggcattttaaacgaatgcgctttcctccatttgatgatgaggagcccccactggactatgctgataatttgttggatgttgaaccacttgaagctatacagttggagttggatgaggaggaagatgcagctgtctatgaatggttctatgatcacaaacctctaatgaagacaaaacttataaatggtcccagttacaggaaatggcatctatctcttcccataatggcaacactatatcgccttgctggccagctgctgtcagatctgatcgataggaattatttctacttatttgatatggagtccttctttacagccaaggcccttaatatgtgcattccagggggtccaaagtttgagccattgtaccgtgatatggagaagggtgatgaggactggaatgagtttaatgacataaataagctcatcatacgtcagccacttcgaactgagtacaggattgctttccctcacctgtacaacaacaggccaaggaaagtgaaacttggtatctatcatacccccatgataatgtacatcaagactgaagatccagacttgccagcgttctactatgatcctctgataaatcctatcacttcaaccaacaaggttgatcgtcgggagaggaaagcagctgaagaggaagatgatgaagatttttgtctcccagaagatgtagagcctctcttgaaacagactgaactctacactgatacaacagctgctggtatatcgttactttttgctccaaagccttttaacatgagatctggtcggacacgtcgtgcagaggatattcctcttgtatctgagtggttcaaggaacattgccctccagcttatcctgtgaaagttcgtgtgagttatcagaagctattgaagtgttatgtgctcaatgagctacatcataggcctcccaaggcccagaagaagaagcatctgttccgttcactccaagcaactaagttcttccaaactactgagcttgactgggcagaagcaggcttgcaagtttgcaagcaggggtacaacatgctaaatttgttgattcacaggaaaaatcttaactatcttcatttagattacaatttcaatttgaagcctgtaaagactcttacaacaaaggaaaggaagaaatctcgttttggaaatgcattccatttgtgtcgtgagattttacgacttacaaagttggttgttgatgctaacatccagttccgtctgggaaatgttgatgccttccagttggcagatggtctgcaatacatattttctcatgttgggcagttaactggtatgtataggtacaagtaccgattgatgagacagattaggatgtgcaaagatctgaagcacttgatatattatcgtttcaacactggccctgttggtaaagggcctggttgtgggttttgggctccaatgtggagagtgtggctcttcttccttcgaggtattgtcccactattggagcgctggttgggcaatcttctggcacgtcagtttgagggccgtcattccaagggtgtggccaaaactgtaacaaagcaacgtgttgagtctcactttgatttagaacttcgtgctgcagttatgcacgacgtcctagatgctatgccagaaggcatcaaacaaaacaaggctcgaactatattacaacatcttagcgaggcatggcgatgctggaaggcaaatatcccatggaaagtccctggtctacctgtgcctattgaaaacatgattcttcgttatgtgaaatccaaggcagattggtggacaaatgttgctcactacaatcgtgagcgtatcaggcgtggtgctacagttgacaaaactgtttgtcggaaaaatctaggaaggttaactcgtctgtggctgaaggcagagcaagagaggcaacacaattacctgaaagatgggccatatgttactcctgaagaagctgttgctatttatacaacaactgttcattggctggaatcaagaaagttctccccaattcctttcccgccattgtcatacaagcatgacactaaacttcttatacttgctctagaaaggctgaaggagtcatacagcgtagcagttagattgaaccaattgcaacgagaggagcttgggttgattgaacaagcttatgataatccacatgaagcactgtcaaggataaaaaggcatctccttactcagcgtgcttttaaagaagttggtatagaattcatggacttgtacagctacttgattccggtatatgaaattgaacctcttgaaaagatcactgatgcataccttgaccagtacctgtggtacgagggggacaaacggcacctcttcccaaattgggttaagcctgctgattcagaaccaccacctcttcttgtttataaatggtgccagggtataaataatttactggatatatgggacacaagtgatggacagtgtgttgtgatgctccagacaaaatttgagaagttctttgagaaaattgatctgactctgttgaacaggcttctgcgcttggtcttggatcataacatagctgactatgtcactgcaaagaacaatgtagtgttgtcttacaaggacatgagtcacacaaattcttatggtctcattcgagggcttcaatttgcatcttttgttgttcagtattatggccttgtgctggatctcctgattcttggtctaactcgtgcaagtgagattgctgggccacctcaaatgccaaatgagttccttacatatgctgacacaaaagttgagacaaggcatcccataagattatattctcggtatattgacaaggtgcatatattgttccggttcacccatgaggaagcacgagatctaattcagcgttacttgacagaacatcctgatcctaacaatgagaacatggttggttacaataacaagaaatgttggcccagagatgcaagaatgaggcttatgaaacatgacgtgaatcttggaagaagtgtgttctgggatatgaagaaccgccttccaaggagcattacaactttagaatgggagaatagctttgtctctgtttacagcaaggacaatccaaacctgctttttagcatgtctggctttgaagtccggatactgccaaagatacggatgacccaggaggcattcagcaacacaaaagatggagtatggaatttgcagaatgaacagacaaaagaaagaacggcaattgccttcctgagggttgacgatgaacatatgaaagtgttcgagaaccgtgtccggcagattctaatgtcatcagggtcaacaacattcaccaagatagtcaataagtggaatacagctctcattggccttatgacatatttccgcgaagcaactgtccatacccaggagcttttggatttactggtcaaatgtgaaaacaagatccagactcgtataaagattggcctgaattcaaagatgcctagtaggtttcctccagttatcttctatactcccaaggagattggaggtcttggaatgttatcaatgggccatattcttataccgcagagtgatcttaggtatagcaaacagacagatgttggtgtaacacattttagaagtggtatgagccatgaagaggatcagcttattccaaacttgtatcgctacatccagccatgggagagcgagtttattgattcacagcgtgtttgggctgagtatgctttgaagaggcaggaagcacaatcacagaacagacgattaactcttgaggatcttgaagattcatgggatagaggtatacctcgtatcaacactcttttccaaaaagaccgtcatacactagcctatgacaaaggatggagagtgagaacagattttaagcaatatcaagtgctgaaacagaacccattctggtggacacatcagcggcatgatgggaagctttggaatctaaataactacagaacagatgtcatccaagcacttggtggtgtagaaggcatcttggagcatactttatttaaagggacttacttccccacttgggagggtctgttttgggagaaggcatcaggtttcgaagagtcaatgaaatacaagaaactgacaaatgcacagcggtctggtctcaatcaaatccccaatcgaagatttaccctgtggtggtcaccaaccatcaatcgtgcaaatgtctatgttggtttccaggtccagctagatcttacgggcatattcatgcatggtaaaatcccgacattgaagatttctctgatccagatcttccgtgcacatctgtggcagaagatccatgaaagtgttgttatggatctttgccaagttttagaccaggagttggatgcacttgagattgagactgtgcagaaggagacaatacatcccaggaagagttacaagatgaacagttcctgtgctgatatccttctctttgctgctcatagatggcagatgtccaaaccaagcttagtttctgagtcgaaggatgtatttgatcagaaagcaagtaacaagtattggattgatgtgcaactgcgttggggagactatgattcacatgacatagaacgttatacaagagccaagttcatggattacacaacagacaatatgtccatatacccatcgccaactggtgtgatgattggaatcgatctagcgtataatttgcactctgcttttggcaactggtttcctggatcaaagccactacttcagcaggcaatgaacaagatcatgaagtcaaatcctgctctgtatgtcctgagggagagaataaggaagggtctgcagttgtactcttctgaacccactgaaccatacctgtcttcacagaactatggagagatattcagcaatcaaatcatatggttcgtggatgatacaaatgtgtatcgagtcactattcacaaaacatttgagggtaacttgaccaccaaaccaattaatggtgctattttcattttcaatccaagaacgggtcaacttttccttaaggttatccacacaagtgtatgggcggggcaaaagcgtcttgggcagctggccaagtggaaaaccgctgaggaggttgctgcattggttcgatctcttcctgtagaagagcagccaaagcaaattattgtgacaaggaagggcatgttggatcccttggaggtccatctacttgacttccctaacattgttattaagggcagcgagctgcagcttcctttccaggcttgcttgaagattgagaagtttggtgatcttatactgaaggcaactgaaccacagatggttctttataatatatatgatgattggttgaaaagtatatcatcatacacagcattctcccgcattgtgcttattctacgtgcacttcatgtgaataatgagaaggcaaagatgttgctcaaacctgacaaaacaattgttactgaaccacatcatatatggccatctctgaatgatgaacagtggttgaaggttgagtgtgcactaagggacctcatcctttctgattatgcaaagaaaaacaatgttaatacttctgcactgacacaatctgaaatgcgagatatcattcttggcgctgaaattgctccaccatcacagcagaggcaacagattgctgaaattgagaaacagtcaagagagactactcagttaactgctgtaaccacaaggacgacgaatgtgcacggagatgaactcattatcacaaccacaagtccatatgagcaacaagcattcgcatcgaagactgattggcgtgtcagagccatctctgccacaaacttgtatctacgtgtaaatcacatttatgtcaattctgatgatataaaggaaactggctacacttacattatgccaaagaacatattgaagaaattcatatgcatagcagatctgcgtacacaaatcgctggattcttatatgggctgagtccacaggacaatcctcaagtcaaagagattaggtgtatagccatccctccgcagcatggaacacaccagatggtgactctgccatcaaatcttcctgaacatgagttccttaatgatcttgaacccttgggatggatgcatacacagccaaatgaagctccacagctatcaccacaggacctgacatcacatgccaagattctggagaacaacaaacaatgggatggtgagaagtgcatcattctgacatgcagcttcaccccaggatcttgctcgttgactgcttacaagctgacaccaagtggttatgagtggggacgcagcaacaaggacaacggaagcaacccacatggatacctcccaactcattacgagaaggtccagatgcttctgagcgaccgcttccttggtttctacatgattccggataacaccccttggaacttcaacttcatgggagtgaagcacgacccacagatgaagtacaacatgaagctgggcatgccccgggacttctatcacgaggaccacaggccgacacacttccttgagttcagcaacatcgaggagggagaggtcgctgaaggtgatagggaggacacattcacgtagggcgctgggcgcctgttttagaaactgtatctcaaacgcactttagctctgttttgaatggcaatgtgtgaaaggctgaaagctgtaacctgactcgacgggtgtcatctgtttttttggcttaatcctgtatcataccttgttgtaagacagccctggagaggggtaaaaattgtacaagtgcacgccatggcaacagtaaagattttacttagtagctatgctattcta

SEQ ID NO: 922 - DNA, 7393 bp, Zea mays
ccgcgcccgccccgtcgccgatgtggaacggcgtgccgcctccgcctccgcctccgttgcagatggcggcggcccctcctccccctggcacgacggtgcccggggcaggccagcccccgcccccgcccccgccgcctgccggggcgtcgcagggcggcaagccgctgacaccgatggagctggaggcgcagctggtggagaaggcccgcaaatggcaccagctcaactccaagcgctacggcgacaaacgcaagttcgggttcgtcgaggcacagaaggaggacatgccccctgagcacgtccgcaaaatcaccagagtgtatcctatttttggtgcactaaatttatcattattttatttaacagagaccatggagacatgacttccaagaagtacagacatgataagcgtgtttatcttggagcactcaaatttgtgccccacgctgtgtacaaactgctggagaacatgccgatgccttgggagcaggttcgccatgtgaaaatcttgtatcatatcactggggctatcacttttgtaaatgaaatcccatgggttgttgaacccatatacctcgcacagtggggtacaatgtggattatgatgcgacgagagaagagggataggcgtcattttaaacgaatgcggtttcctccatttgatgatgaggaacccccactggactatgctgataatttgttggatgttgaaccacttgaagctatacagttggagttggatgaggaggaagatgcagctgtctatgaatggttctatgatcacaaacctctgatgaagacgaagctcataaatggccctagttacaggaaatggcatctatctcttcccataatggcaacactatatcgccttgctggccagctgttgtcagatctgatcgataggaattatttctacctatttgatatggagtctttctttactgccaaggcccttaatatgtgcattccagggggtccgaagtttgagccattataccgtgatatggagaagggtgatgaggactggaatgagttcaatgatataaataagctcatcatacgtcagccacttcgaactgagtacaggattgctttccctcacctgtacaacaacaggccaaggaaagtgaaacttggtatatatcatacccccatgataatgtatatcaagactgaagatccagacctgccagcgttctactatgatcctctgataaaccctatcacttcaaccaacaaggttgatcgtagggagaggaaagcagctgaagaggaagatgatgaagatttttgtctcccagaagatgtagagcctctcttgaaacagactgaactctacactgatacaacagctgctggtatatcgttactttttgctccaaagccttttaacatgagatctggtcggacacgtcgtgcagaggatattcctcttgtatctgagtggtacaaggaacattgccctccagcttatcctgtgaaagttcgggtgagctatcagaagctattgaagtgttatgtgctcaatgagctacatcataggcctcccaaggctcagaaaaagaagcatctgttccgttcactccaagcaactaagtttttccaaactactgagcttgactgggcagaagcaggcttgcaagtttgcaagcaggggtacaacatgttaaacttgttgattcacaggaagaatcttaattatctccatttagattacaatttcaatttgaagcctgtgaagactcttacaacaaaggaaaggaagaaatctcgttttggaaatgcatttcatctgtgtcgtgagattttacgacttacgaagttggttgttgatgctaacatccagttccgtctgggaaatgtggatgccttccagttggctgatggtctgcaatatatattttctcatgttggacagttaactggtatgtataggtacaagtaccgattgatgaggcagattaggatgtgcaaagatctgaagcacttgatatattaccgtttcaacactggtcctgttggcaaaggacctggttgtgggttttgggctccaatgtggagagtgtggctctttttccttcgaggtattgtcccactattggagcgttggttgggtaatcttttggcacggcagtttgagggtcgtcattccaagggtgtggccaaaactgtaacaaagcaacgtgttgagtctcacttcgatttagaacttcgcgctgcagttatgcacgatgttttagatgctatgccagaaggcatcaagcaaaataaggctcgaactatattacagcatcttagtgaggcatggcgttgctggaaggcaaatatcccatggaaagtccctggtctacctgtgcctattgagaacatgattcttcgttatgtgaagtcgaaggcagactggtggactaatgtcgctcattacaatcgtgagcgtatcaggcgtggtgctacagttgacaaaactgtttgtcggaaaaatctaggaaggttaactcgtctgtggcttaaggcagagcaagagaggcaacacaattacttgaaagatgggccatatgtaactcctgaagaggctgttgctatctatacaacaactgttcattggctggaatcaagaaagttctcgccaattccttttccgccgttgtcatacaagcatgacactaaacttcttatacttgcactggaaagactgaaggagtcctacagtgtagcagttagattgaaccaattgcaacgggaggagcttgggttgatcgaacaagcgtatgataatccacatgaagcactgtcaaggataaaaaggcacctccttactcagcgagctttcaaagaagttggtatagaattcatggacttgtacagctacttgattccagtatatgaaattgaacctcttgaaaagatcactgatgcataccttgaccagtacctgtggtacgagggggacaaacgacacctctttccaaattgggttaagcctgctgattcagaaccaccacctcttcttgtttataaatggtgccagggcataaataatttactggatatatgggacacaagtgatgggcagtgtgttgtgatgctccagacaaaatttgagaagttctttgaaaaaattgatctgactctgttgaacaggcttctgcggttggtcttggatcataacatagctgactatgtcactgcaaagaacaatgtagtgctgtcttacaaggacatgagtcacacaaattcttatggtctcattcgagggcttcaatttgcatcttttgttgttcagtactatggccttgtgctggatctcctgattcttggccttactcgtgcaagtgagattgctgggccacctcaaatgccaaatgaatttcttacatatgctgacacaaaagttgagacaaggcatcccatcagattgtattctcgatatattgacaaggtgcatatattgttccggttcacccatgaggaagcacgggatctcattcagcgttacttgacagaacatcctgatcctaacaatgagaacatggttggttacaataacaagaaatgttggcccagagatgcaagaatgaggcttatgaaacatgatgtgaatcttggaagaagtgtgttctgggatatgaagaaccgccttccgaggagcattacaactttagaatgggagaataactttgtctctgtttacagcaaggacaatccaaacctgctttttagcatgtgtggctttgaagtccggatactgccaaagatacggatgactcaggaggcgttcagcaacacaaaggatggggtatggaatttgcagaatgaacagacaaaagaaaggacagcaattgccttcctgagggttgatgatgaacatatgaaagtgttcgagaaccgtgtcaggcagattctaatgtcatctgggtcaacaacgttcacgaagatagtcaataagtggaatacggctcttattggccttatgacatattttcgtgaagcaactgtccatacccaggagcttttggatttactagtcaaatgtgaaaacaagatccagacccgtataaagattggcctgaattcaaagatgcctagcaggtttcctccagttatcttctatactcccaaggagattggaggtcttggaatgttatcaatgggccatattcttataccacagagcgatcttaggtatagcaagcagacagatgttggtgtaacacattttagaagtggcatgagccatgaagaggaccagctcattccaaacttgtatcgttacattcagccatgggagagtgagtttattgattcacagcgtgtttgggctgagtatgctttgaagaggcaggaagcacaatcacagaacagacgattaactcttgaggatctcgaagattcatgggatagaggtatacctcgtatcaacactcttttccaaaaagaccgccatacactagcctatgacaaaggatggagagtgagaacggattttaagcaatatcaagtgctgaaacagaacccattctggtggacacatcagcggcatgatgggaagctttggaatctaaataactacagaactgatgtcattcaagcacttggtggtgtagaaggcatcctggagcatacattatttaaagggacttacttccctacttgggagggtctgttttgggagaaggcatcaggtttcgaagagtcaatgaaatacaagaagctgacaaatgcacaacgttctggtctcaatcaaatccccaatcgaagatttaccctgtggtggtcaccaaccatcaatcgtgcaaacgtgtatgttggtttccaggtccagctagatcttacggggatattcatgcatgggaaaatcccgacgttgaagatttctctgatccagatcttccgtgcacatctgtggcaaaagatccatgaaagtgttgttatggatctttgccaagttttggaccaggagttggatgcacttgagattgagactgtgcagaaggagacaatacatcccaggaagagttacaagatgaacagctcctgtgcagatatccttctctttgctgcacacagatggacgatgtccaaaccaagcttagtttctgagtccaaggatgtctttgatcagaaagcaagtaacaagtattggattgatgtgcaactgcgttggggagactatgattcacatgacgtagaacgatatacaagagccaagttcatggattacacaacagacaatatgtccatatacccatcgccaactggtgtgatgattggaatcgatctagcatataatttgcactctgctttcggtaactggtttcctggatcaaagccactacttcagcaggcaatgaacaagatcatgaagtcaaatcctgccctgtatgtcctgagggagagaataaggaagggtctgcagttgtactcttctgaacccacagaaccgtacctgtcttcacaaaactatggagagatattcagcaatcaaatcatatggtttgtggatgatacaaatgtgtatcgagtcactattcacaaaacatttgagggtaacttgaccaccaaaccaatcaatggtgctattttcattttcaatccaagaacgggtcaactttttcttaaggttatccacacaagtgtatgggcagggcaaaaacgtcttgggcagctggccaagtggaaaacagctgaggaggttgctgcattagttcgatctcttcctgtagaagagcagccaaagcaaattattgtgacaaggaagggcatgttagatcccttggaggtccatctacttgacttccctaacattgttatcaaaggcagcgagctgcagcttcctttccaggcttgcttgaagattgagaagtttggtgatctgatactgaaggcaactgaaccacaaatggttctttataatatatatgatgattggttgaaaagtatctcatcatacacagcattctctcgcattgtgcttatcctacgtgcacttcatgtgaataatgagaaggcaaagatgttgctcaaacctgacaaaacaattgttactgaaccacatcatatatggccaactctgaatgatgaacagtggttgaaggttgaatgtgcactaagggacctcattctttccgattatgcaaagaaaaacaatgttaatacttctgcactcacacaatctgaaatgcgagatatcatccttggtgctgaaattgctccaccatcacagcagaggcaacagattgctgaaattgagaaacagtcaagagagacgactcagttaactgctgtaaccacaaggacaacaaatgtgcatggagatgaactcattatcacaaccacaagtccatacgagcaacaagcattcgcatccaagactgattggcgtgtcagagccatctctgccacaaacttgtatcttcgtgtaaatcacatttatgtcaattctgatgatataaaggagactggctacacttacattatgccaaagaacatattgaagaaattcatatgcatagcagatctgcggacacaaattgctggatttttgtatgggctgagtccacaggacaatcctcaagtcaaagagattaggtgtatagccatgcctccacagcatggaacacaccagatggtgactcttccagcaaatcttcctgagcacgagttccttaatgatctagaacccttgggatggatgcatacacagccaaatgaagctccacagctatcgccacaggacctgacatcacatgccaagattctggagaacaacaaacaatgggatggtgagaagtgcatcattctgacatgcagcttcaccccaggatcttgctcgttgactgcatacaagctgacaccaagcggttacgagtggggacgcagcaacaaggacaacggaagcaatccacatggataccttccaactcactacgagaaggtccagatgcttctgagcgaccgcttccttggattctacatggttccggataacgctccttggaacttcaacttcatgggagtgaagcacgacccacagatgaagtacaacatgaagctgggcatgccccgggacttctatcacgaggaccacaggccaacacacttcctcgagttcagcaacatcgaggagggtgaggccgctgaaggcgatagggaggacacattcacgtaggcgcctgttagaaactgctctgttttaacggcagtgtgtgtagctgtaacctgacttgacgggtgtcatctgttcgcctgttgcttaagcctgtattatactacctctttgttgtaagaagccctggtgagggattaaaattgtacaagtgcgcgccatggtaacagtaaaggttttgcttcctcccaagcttccaccttcaatccttccaggcttcataaa

SEQ ID NO: 923 - DNA, 4481 bp, Pennisetum glaucum
cttaggtatagtaagcagacagatgttggtgtcacacatttccgaagtggtatgagccatgaagaggaccaacttattcctaacttgtatcgctacattcaaccatgggagagtgagtttattgattcacagcgtgtttgggctgagtatgctttgaagaggcaggaggcacaatctcaaaacagacggttgactcttgaggatcttgaagactcttgggatagaggtatacctcgtatcaacactcttttccagaaggaccgccatacgctagcctatgataaaggatggagagtgagaacagattttaagcaatatcaagtgctgaaacagaacccattctggtggacacatcagcggcatgatgggaagctttggaacctaaataactacagaactgatgtcattcaagcgcttggtggtgtagagggtatcctggaacatacattatttaaaggaacttatttccctacctgggagggtctgttctgggagaaggcatcaggttttgaagagtctatgaaatacaagaaactgacaaatgcacagcgttctgggctcaatcaaatccccaatcgaagatttaccctatggtggtcaccaactatcaatcgtgcaaacgtgtatgttggtttccaggtccaactagatcttacggggatattcatgcatgggaaaattcccacattgaagatttctctgatccagatcttccgtgcacatctgtggcagaagatacatgaaagtgttgttatggatctttgccaagttttggaccaagagttggatgcattggagattgagactgtacagaaagagacgatccatcccaggaagagttacaagatgaacagttcatgcgcagatatcctcctctttgctgcacacagatggcagatgtcaaaaccaagcttagtttctgaatcgaaggatgtctttgatcagaaagcaagtaacaagtactgggttgatgttcagctgcgttggggagattatgattcgcatgacatagaacgctatacaagagccaagttcatggattacacaacagataacatgtccatctacccgtcaccaactggagtgatgattggacttgatctagcatataatttgcactccgcctttggcaactggttccctggatcaaaaccactacttcagcaagcaatgaacaagatcatgaagtcaaatcctgctctgtatgtgctgagggagaggataaggaagggtctgcagttgtactcatctgaacccactgaaccatatctgtcttcacagaactatggagagatcttcagcaatcaaatcatatggtttgtggatgatacaaatgtgtatcgagtcactattcacaaaacatttgagggtaacttgaccacaaaaccaatcaacggtgctattttcattttcaatccaagaactggtcaacttttccttaaggttatccacacaagtgtatgggcggggcaaaagcgtcttggacagctggccaagtggaaaacagctgaggaggttgctgcattggttcgatctcttcctgtagaagagcagccaaagcaaattattgtgacaaggaagggaatgttggatccattggaggtccatcttcttgacttccctaacattgttatcaagggcagtgagcttcagcttcctttccaggcttgcttaaagattgagaagttcttattctgaaggcaactgaaccgcagatggttctttataatatatatgatgattggttgaaaagtatctcttcatacacagcattctctcgtattgtacttattctacgggctctacatgtgaataacgagaaggctaagatgttgctcaaacctgacaaaacaattgttactgaaccacatcatatatggccaactttgaatgatgaacagtggttgaaggttgaatgtgcactcagggacctcattctatctgattatgcaaagaaaaacaatgtcaacacttctgcactgacacaatccgaaatgcgagatatcatacttggtgctgaacacagcagcggcaacagatagctgagattgagaaacagtctagagagacgacacagttaactgctgtcaccacaaggaccacaaatgtacatggagatgagctcattatcacgacaacaagtccatacgagcaagcagcattcgcgtcgaagactgattggcgtgtcagggccatctctgccacaaacttgtatcttcgtgtcaatcacatttatgtcaattctgatgatataaaggagactggctacacttacattatgccaaagaacatattgaagaagttcatatgcatagctgatctgcggacacaaattgctggatttctgtacgggctgagtccacaggacaatcctcaagttaaagagatcaggtgcatagccattcctccgcagcatggaactcaccagatggtaaccctgccagcaaatcttcctgagcatgagttccttaacgacctggaaccattgggatggatgcatacacagccaaatgaagctccacagctatccccacaggacctgacttcacatgcaaagattctggagggcaacaaacaatgggatggtgagaagtgcatcattctgacatgcagcttcacgccaggatcttgctcgttgactgcatataagctgacaccaagcggttatgagtggggacgcagcaacaaggacaacgggagcaaccctcatggatacctccctactcattatgagaaggtccagatgcttctgagtgaccgcttccttgggttctatatggttccagataacacaccttggaacttcaacttcatgggggtgaagcatgacccactgatgaagtataatatgaagctgggcatgccccgggacttctaccatgaggaccaccggccgacacatttcctggagttcagtaacatcgaggagggtgaggttgcggaaggtgatagggaagacaccttctcataggcctggctgagattctacccggctaccccatgtttatctgaaacgcacttagccttgttttgaacagcgatgtgtgaacctgtaggctgtaaagctgtaacctgatgtgacgggtatcgtcttcggctgttgctctagcttgtattatacctttttgttgtaagacagccctcggggtaaagttgtacaagtgcacgacatggtaacagtaaaagattttttttcgaacaaagaattgactctcattttccttttgttatctcaacatttttacaattgtgcgactaggtcagccccgcaaagggaatcacaaattcttcgtataaccaaccaaccggcgtgtatccaattcaagaccatggaccaaaagaatagtaacaaagaaagaaacaaccaattgttttgtgttatgcccccaacaaccatgatatgatgatcacgagggacatctgtcttcacgacgggtgctaaggacacattcctccaagaagttgctcagctgagaggtgtacagcccagggttgctccggtagtggtccacatggggcgacgacacaaagtcgcaggccctcacctcacgcccggctctccgctgcccctcgatgaatgactccactgatttcgctgggatcaccctgtcggcagagctgtatatatacagctgggggcactttggttgcttcaacgacaaaagctccatgacatcagataacctcctgttgatccttggagtgttcaaaaccacgtcaaaaaatgtctccaatgctgacagtagaactgcctctgttgctgccggtttaagctccatgttagactccacaactaggacatcggacctcgaatcatttgatcctagtccttttgtggtcacactgtgttttttcatgagggcagccgagaagcctgaggcccatacctgaggatcaggtgcagcaacaggtgcagagtctactacgcaagctttaattttctccactgctgaaggatcctgctgttgcaggttctccagaattacaccatagcaaagccaaccggtattactgaaggtgtggaaaataatcttcttcccactctcctccctgacccagccagcaagatgctcagatagcatctctacattcttctcagccttcccgccaaggttataactgaggatgtcagacattgggagggtgaaagtgacagcatggaagcccctggaggtgtaccattcagcatatctcttgagatgcttctgccttgagcccagccacccaagaagaaccaccactgtctgagacttgtcagggaagttggcacaggccctggggtctggcagatgccagcggtacagcacatcggacgacgaggaaggaattgcaggaactgcgccgtcttgttctgaggtcttggcaaactttgcatactggtaagcggtctggatgactggcaaagacgcaaacggagccttcatctgatgcaaattgtggagattgcgcggcaatagctgcatgccagacagggtagaggc

SEQ ID NO: 924 - DNA, 3367 bp, Tabernaemontana elegans
cagacagatgtgggtgtgacacaacttcaggagtggaatgagtcacgaagaggaccagttgattccaaatctttatcgttacatacagccatgggaaagcgagttcattgactcccagcgagtttgggcagaatatgcattaaaaaggcaggaagcacaggcacagaataggcgtttaacacttgaagatcttgaggattcttgggatcgtgggataccccgaatcaacactttgttccagaaggatcgacacactcttgcatatgataaaggatggagggtgagaacagatttcaagcagtatcaagttctcaaacagaatccattctggtggacacaccagaggcatgatgggaagctgtggaacttgaataactataggactgatgttatccaagctttgggaggtgtcgaaggaattttggagcatacattattcaaaggaacatactttcctacttgggagggtcttttctgggagaaggcttcaggttttgaggagtccatgaagtacaagaaattgacaaatgcacaaagatctggtctcaaccaaatccctaatcgtaggtttacactttggtggtcacctactataaatcgagccaatgtctatgtcggcttccaagtgcagctggatttaactgggatatttatgcacggaaaaataccaactctcaagatatctttaatccagatattccgagcacacttgtggcagaagatacatgagagtgttgtcatggatctttgccaggtcctagatcaggaacttgatgctttggaaattgagactgtgcagaaagaaacaattcatccaagaaagagttacaaaatgaacagctcctgtgctgacattcttctgtttgcagcccataaatgccctatgtcaaaacctagtctagttgctgagtctaaagatgtttttgatcaaaaggctagcaacaagtactggattgatgtgcagcttcgatggggtgattatgactctcatgacatagaacggtatacgagggcaaaattcatggattatacaacagacaacatgtcgatttatccgtcgccaactggggtgatgattagcattgatcttgcttacaacttgcattctgcctttggaaattggttccctgggtcaaaaccattgcttgctcaggctatgaacaagattatgaagtcaaacccagcattgtatgttttgagagagcggataagaaaagggttgcagttgtattcttcagaacccacggaaccctatttgtcttctcagaactatggtgaaattttcagtaatcagattatttggtttgttgatgatacaaatgtgtatcgcgtcactatacacaagactttcgaaggaaatcttacaacaaaacccatcaatggtgctatatttattttcaatcccaggacagggcagctctttcttaaggtgattcacacaagcgtctgggctgggcaaaagcgtcttggtcagctagccaagtggaaaactgctgaagaggtcgctgctttggttcgatcattacctgttgaagaacaacctaaacaaatcattgttactcgtaaaggcatgttggatcccttggaggttcacttgcttgattttcctaacatagtcatcaaaggaagtgaactccaactgcctttccaagcatgcttgaagattgagaaatttggcgatctgattctgaaagccacagagccacaaatggttttattcaacatttatgatgattggttgaagagtatatcatcgtacactgccttctcgaggctcattttgattttacgtgcactgcatgtgaataatgagaaggcaaaaatgttgctaaagcctgacaagaccattgtcactgaaccccaccatatttggccctctctcacagatgaccagtggatgaaggttgaggtgtctttgagagatctgattttatctgattatgcaaagaagaacaatgtcaatacatcggcactgacacagtcagaaattcgtgatatcatccttggagctgaaattacccccccttcacagcagcggcagcaaatcgcagagatagagaaacaggctaaggaagcaagtcagctgacagcagtcactacaagaacaacaaatgtacatggtgatgaactgattgtcactaccacaagtccatacgagcagtctacatatgcgtctaaaactgactggcgtgtgagagcaatttctgccacaaatctctatctccgagtcaatcacatatacgtcaattcagaggatataaaggagactggctatacttacatcatgcccaagaatattttgaagaagttcatatgcattgcagacttgagaactcaaattgcaggatatttgtatggcataagccctccagataatcctcaggtcaaggagattcgatgtattgccatgccaccacagtggggaacacatcagcatgtgaatctcccatcagctcttcctgagcatgactttctaaatgatttggagcctctgggatggatgcatacccaaccgaatgaacttcctcaattgtcacctcaggatttgacaagccatgctcgaatcttagaaaacaacaaacagtgggatggagagaagtgcataattctgacttgcagctttacgccagggtcatgctctttgacagcatataagctgacaccatcaggatatgaatggggacgagccaacaaggatacaggaagcaatccacatggttacttgccaacacattatgagaaggtgcagatgctcctgagtgatcgtttccttggtttttacatgatcccagataatggtccatggaattataattttatgggagtaaaacatacagtaagcatgaggtacagtgtcaagctaggaacacctagggagttctatcacgaggatcaccggccaacgcatttcctcgagttcagcaacttggaagagggtgagaccgcagaaggggaccgcgaggatacattctcgtaaattccaatatccaaaccttctctggcagaaattagcatttggaagatctctctgtttcaagatccaggtttccttttgcactaactgtatgttccgatattagatggctctgacattgtaaatatgtacttcaaaaactgtggatctctgattctcctgtatatgcggttcgctacagttacatgcatatcctccaaagcaaactgaaagttgggaggagttaggagcttactttttgtggtgaattcaaatcttccttcgtgtacctcttgttgtgaatgattctacatttttctattagacgaatgatttcggtattctcttttagtgaaatgtcatgcaagtgcagtataggtagtggtagcttactgggatcgaaacttgattggt

SEQ ID NO: 925 - DNA, 4083 bp, Castanea mollissima
aatgttgtgttgtcttacaaggatatgagtcacacaaactcatatggtcttatccgtggtctccagtttgcttcttttgttgtacagtattacggacttgtgctggatctcttgctccttggattgactcgagctagtgagattgctgggcccccacagatgcctaatgagttcattacttattgggacacgaaagttgagacacgtcaccctattcggctttattctcgatacatagacagggtccacatattgttccgcttcacccacgaagaggctcgagaccttatccagcggtatcttaccgagcatcctgatcctaacaatgaaaatatggttggatataacaacaagaagtgctggcctagagatgcaagaatgaggctcatgaaacacgatgtaaatcttgggaggagtgttttctgggatatgaagaaccgtcttcctcgaagcatcactacattggagtgggagaacagttttgtttctgtatacagcaaggacaatccaaacttgcttttcagcatgtgtgggtttgaagttcggatacttcctaaaataaggatgacccaagaagctttcagtaatacaagagatggtgtttggaatctgcagaatgaacagaccaaagaacggactgcagttgctttcttgcgggttgatgatgagcacatgaaggtgtttgagaatcgtgtgaggcagattcttatgtcttcaggatccacaacatttacaaaaattgtcaataaatggaatacagccttgataggtctcatgacttatttccgtgaagccactgtgcatactcaagagctgttggatttgctggttaaatgtgaaaataaaatccaaacccgtattaagattgggttgaactcaaagatgcctagcaggttccctcctgtcattttctacactccaaaggaaattggaggacttggcatgctttctatgggtcatatattgattccacaaagtgacctccgttacagccagcagacagacgttggtgtaactcactttaggagtggaatgagccatgaagaggaccagctgattccaaatctttatcgatatatacagccatgggagagtgagttcatagattcacaacgtgtttgggcagaatatgcattgaagaggcaggaagctcaggctcaaaataggcgtttgacccttgaagatttggaagattcatgggacaggggcatacctcgcataaacactttgtttcagaaggaccgacacacattggcatatgacaaaggatggagggtgcgtactgacttcaaacagtaccaagttttaaaacagaaccctttctggtggacacaccagaggcatgacgggaaactttggaacttgaacaactatcgaactgatgtcattcaagctttgggtggtgttgagggaattcttgagcataccttattcaaaggaacatactttccaacttgggaaggtctcttctgggaaaaggcatctggttttgaggaatcaatgaagtataagaagctgacaaatgctcagagatctggtctcaaccaaatccctaaccgtaggtttacgctttggtggtcacctacaataaatagagcaaatgtgtatgtgggttttcaagtccaattggatctaactggaatcttcatgcatgggaagatccctaccttgaagatatcactgattcaaattttccgtgctcatttgtggcaaaaaatccatgagagtgttgtcatggatctttgtcaagttttggatcaggagttggatgctttggaaattgaaactgtgcagaaggaaacaatccatccaagaaagagttacaaaatgaacagctcttgtgcagacattcttctctttgctgcacatagatggccgatgtcaaaacctagtcttgtagctgaaccaaaggatgtgtttgatcagaaagcaagcaataagtactggatagacgtgcagctccgctggggagattatgactctcatgatattgagcgttacactcgggccaaatttatggattatacaacagacaatatgtctatatatccatctcctactggtgtgatgattggaattgatttggcatacaacttgcattctgcatttggtaattggtttcctgggtcaaagcctctgcttcagcaggccatgaataagatcatgaagtcaaatccagctttatatgtcttgagggagcggataaggaaaggtttacagttgtattcttctgagcccactgaaccatatttgtcatctcagaattatggagagatcttcagcaatcaaataatttggtttgttgatgacacaaatgtctatcgtgttactatccataagacgtttgagggaaatcttacaacaaaacccatcaatggtgccatctttatattcaatccaaggactggacaactgttcctgaaggtcatccacacaagtgtgtgggctggacaaaagcgtcttggtcagttggccaagtggaaaacagcagaagaagttgctgctctagttcggtctttgcctgttgaagaacagccaaaacaaattattgtgactcgtaagggaatgctggatccattggaggttcacttgctggatttcccgaacatagttatcaaaggaagtgagctgcagcttccgttccaagcatgcttgaagattgagaaatttggtgatctgattttgaaggctacagagccgcaaatggtccttttcaacatttatgatgattggttgaaaagtatttcctcatacactgcattttcccgactcattctgatcctgcgtgcgctacatgttaacaatgagaaggcaaagatgttactaaagcctgacaaaacaatcattactgagccacaccacatctggccatctctcactgatgatcaatggatgaaggttgaggttgctcttagagatctcatactgtcggattatgccaagaagaacaatgtgaatacgtcagctctgacacagtctgagatccgtgatattatacttggagctgagattactcctccttctcaacagagacaacagattgctgagattgagaaacaggcgaaagaagcaagtcagctgacagcagttacaacaaagactacaaatgtgcatggtgatgagcttattgtaaccaccacaagtccatatgagcaagctgcgtttgggtctaaaactgattggcgtgtgagagcaatatctgcaacaaacctctatcttcgtgtcaatcatatttacgtgaattcagaggatataaaggaaacaggatatacctatatcatgccaaagaacattttgaagaagtttatctgcatggcagatctgcggacacaaattgctggttacttgtatggtataagtccccctgacaaccctcaggttaaggagatccgctgtattgccatgccaccacagtggggaacccatcaacaagtcaatcttccatcagctctcccagagcatgatttcctgaatgatttggaacctttgggatggatgcatacacagcctaatgaacttccccagttatcaccacaggatctcacaagtcatgctaagatcctggaaaataacaagcaatgggatggggagaagtgcattattttgacctgcagtttcactccaggttcctgctccctaactgcatataagttgacaccatcagggtatgagtggggccgtgtcaacaaggacactggaagcaatcctcatggttaccttcccactcattatgagaaggtccaaatgcttcttagtgaccgtttccttggtttctacatgatgccggataatggtccatggaattacaacttcatgggggtgaaacatgcacctagtatgaagtatggggtcaagctcgggacaccacgtgagtattatcatgaagaccacaggccaactcatttcctggagttcagcaacttggaagagggagagacttttgctgagggagatcgtgaggatacctttacataggagtcgagattattaacaaatattgttagttacaacttacaacgagaagtaattgtagttcatttgcagacttgggactgaaatcgtagagcccgttgttgtaataat

SEQ ID NO: 926 - DNA, 7496 bp, Citrus clementina
ctctctcgtctcggcactgagtggggtaagagagaagagaaactaaaccccaaaaacctaataacattttcttttttccattttgtcatttctcatcaactcaaaaccccaatactcaaatttgcggagaacgtctttagcatcactattagggtttatttcgacgcagatcttatcgggagagttagttggaatcagaagcgatgtacaacaacaacggtaacaacggagggccgccgttggcaccgccagggacgagcggggcggtgccgataccgcctccgccgtcacagccttcgtacactgtgttgaccacgacgccgtccccgcaggaggcggaggccaggctggaggagaaagctcgaaaatggatgcaattgaactcgaagagatatggagacaaaaggaagttcgggttcgtcgaggctcagaaagaagacatgcctccggagcacgtgaggaagattattcgagaccatggggatatgtcttcgaagaaatatcgtcacgataaacgtgtgtatctaggagcgcttaaatttatcccacatgcagtttacaagctcctcgagaatatgccaatgccttgggaacaagttcgtgatgtgaaggttttatatcatattaccggagccatcacatttgtgaatgaaataccatgggttgttgagcctatatacctcgctcagtggggtaccatgtggatcatgatgaggagagagaagagggatcgtcgtcatttcaagagaatgcgatttccaccatttgatgacgaggaaccaccattagattatgcagataatctgttagatgttgatccactggagccaattcaactagagttagatgaagaagaagattctgctgtatatacttggttttatgaccataagcctcttgttaaaacaaagcttataaatggtccaagctaccggaaatggcacctttcccttccaatcatggcgactcttcatcggcttgctgggcagctcctttctgatttaattgaccgcaactatttctacttgtttgacatggagtcattttttacagccaaggcattgaatatgtgcatacctggtggtcctaagtttgagcctttgtaccgtgacatggagaaaggtgatgaggattggaatgaattcaatgacatcaataaactcattattcggtcacccttgaggaccgagtacaggatcgctttccctcacctatataacaacaggcctcgcaaagtgaggcttggtatataccacactcccatggttatgtacataaaaactgaggatcctgatttgcctgcattttattatgatcctttgatacaccccataccttccacaaacaaggagaggcgtgaaaagaaagcttatgatgatgaggatgaagatgatgacttctttttgccggagcaggtggaacctttgcttaaagatactcagctttatactgataccacagctgctggtatttccctattatttgctccgcgcccttttaacatgagatctggtcgaatgcgacgagcagaagatatacccctagtgtctgactggtataaggagcactgccctccatcatatccagtaaaagttcgggtcagctatcagaaattgttgaaatgttttgtgctgaatgagctgcatcacagaccaccaaaggctcagaagaaaaagcacttgttccggtctctccaggcgacaaaattcttccaaaccactgaacttgactgggctgaagcaggtctgcaagtttgtaagcagggttacaacatgctgaacctattgatacatagaaaaaatttgaattaccttcaccttgattataactttaacttgaagcctgtgaaaactctcactacaaaagaacgcaaaaaatcgcggtttggcaatgcttttcatctttgtcgtgaaattctgcgtttaacaaagcttgtagttgatgccaatatccagttccgcctgggtaacgtagatgctttccagttggctgatggtctgcagtatacgttttcccatgttggccagttgactggtatgtaccgttacaagtacaggctgatgcggcagattaggatgtgtaaggacttaaaacacttgatctattaccgtttcaatactggtccagtggggaaggggcccggttgtggattctgggctccaatgtggagggtgtggctgtttttccttcgcggtatagtgccacttctggaaagatggttaggaaatctactggctcgacagtttgaagggcgccattccaaaggagtggccaagactgttaccaagcaacgtgttgaaagccactttgatttggagcttcgagctgctgtcatgcatgatgttcttgatgccatgccagagggcattaagcaaaacaaggcgagaactatactgcagcatctgagtgaggcatggcgctgttggaaggcaaatataccatggaaagttcctggtctgccagttcccattgagaacatgattcttcggtatgtcaagtcaaaagctgactggtggacaaatgttgctcactacaatcgtgaacgtataagaagaggagcaacagttgataagacagtctgtcggaagaaccttggaagattgactcgcctttggctgaaggcagaacaggaacgacagcacaactatttgaaagacggtccatatgtcaccccagaagaagctgttgccatttatacaacaactgtccactggttggaatcgagaaagtttgctcccattccatttcctccattgtcatacaagcatgatacaaagttacttatccttgctctggagagactgaaagagtcgtatagtgtggctgttagattaaaccaattgcaaagagaagagttgggtcttattgaacaggcttatgataatccacatgaggcattgtcaaggattaagcgtcacctgcttacccagcgtgcatttaaagaagttggtattgagttcatggatttatacagctatctgattccagtttatgaaattgagccacttgagaagataacagatgcctatcttgaccaatatttatggtatgaaggtgacaagcgtcacctctttccaaactggattaaacctgcagattcagaaccaccaccgcttttggtgtataaatggtgtcaaggtataaataatttgcaagggatatgggacacaagtgacggccagtgtgttgtgatgcttcaaaccaagtttgaaaagttctttgaaaaaattgacttgacgatgttaaataggcttttgcgattggtccttgaccacaacatagcagattatgtcaccgcaaagaacaacgttgtcttgtcttacaaagacatgagtcatacgaactcttatggccttatacgtggtcttcagtttgcttcttttgtggtccagtattatggacttgtgttggatctcttgcttcttggtttgacacgagccagtgagattgctggaccgccccatatgccaaatgagttcatcacatactgggacacgaaagttgagaccaggcatcccatacggctgtattctaggtacattgataaggtgcatattttgttccgattcactcatgaggaggctcgagatcttatccaacgttatctcactgagcaccctgatcccaacaatgaaaatatggttggatacaacaacaagaagtgctggcctagagacgcgagaatgaggctcatgaaacacgatgtcaatcttggtaggagtgttttctgggatatgaagaaccgtcttcctagaagcattacaactttggagtgggagaacagttttgtttcagtttacagcaaggacaaccccaatttgcttttcagcatgtgtgggtttgaagttcgaatacttccaaaaatcagaatgactcaagaagcatttagcaatacaagggatggggtctggaatttgcagaatgaacagaccaaagagcggactgcagttgctttcttacgggttgacgatgagcacatgaaggtgtttgagaatcgtgttaggcaaattcttatgtcttcagggtcaacaacttttacaaaaattgttaacaaatggaatacagcactgataggtctcatgacttacttccgtgaagcaactgttcatacccaagagcttttagatttgcttgtcaaatgtgaaaataaaattcaaacccgcatcaagattgggctgaactcaaaaatgcctagcagatttcctcctgtcattttctatacgccgaaagaaattggagggcttggcatgttatcaatgggtcatatcttgattcctcagagtgaccttcgatacagtcagcagacagatgttggtgtgacccactttagaagtggaatgagccatgaggaggatcagctgattccaaatctttatcgttatatacagccatgggagagtgagtttatagattcacagcgtgtctgggcggagtatgcactgaagaggcaggaagctcaggcgcagaacaggcgtttaacacttgaggatctagaagattcatgggatagaggaataccacgtataaatactttgtttcaaaaggacaggcacactttagcctatgacaaagggtggagagtgcgcacagactttaagcagtaccaagtactgaaacagaaccctttctggtggacacatcagagacatgatgggaaattgtggaatctgaacaactatcgaactgatgtcatccaagctcttggaggtgtggagggtattctcgagcacacccttttcaaaggaacatactttccaacttgggaaggtctgttttgggaaaaggcgtcaggttttgaagagtctatgaaatacaagaagctgactaatgcacagagatctggtctcaaccagattcctaaccgtcgatttactctttggtggtcgcctaccataaatcgggccaatgtctatgtgggtttccaggtgcagttggatctgacaggaattttcatgcatgggaagattcctaccttgaagatatcgttgattcagatctttcgtgctcatttgtggcaaaaaattcatgagagtgttgtcatggatctttgtcaagtcttagatcaggagttggatgctttggaaattgaaactgtgcagaaggaaacaattcatccaagaaagagttacaaaatgaacagctcttgtgcagatatcctcctctttgctgctcatcgatggccaatgtcaaagcctagtcttgtggctgagtcaaaggatatgtttgaccagaaagcaagcaataaatactgggtagatgtacaactccgttggggagattatgattctcatgatattgagcgttatactagggccaaatttatggattatacgacagacaacatgtccatatatccttctcctactggggtgatgattgggcttgacctggcctataatttgcattctgcatttggtaactggttcccgggatcaaaaccgttgcttgctcaggcaatgaataagataatgaagtcgaatccagctttgtatgttctgagggagcgtataaggaaaggtctgcagttgtattcttcggagcctactgaaccatatctatcttctcaaaactatggagagattttcagcaatcaaataatatggtttgttgatgataccaatgtgtatcgtgtcacaatccacaagacatttgaaggaaatctaacgactaagcccattaatggtgctatctttatattcaacccaaggactggccagctgttccttaaggtgatccacacaagtgtatgggcaggtcaaaagcgtcttggtcagctagccaaatggaaaacagcggaagaagttgctgctcttgtgcggtctctgcctgttgaagaacaacccaagcaaatcattgtgacccgtaaaggaatgcttgatccattggaggttcacttgctggatttcccgaacatagttattaaaggaagtgagttgcagctccctttccaggcctgcttgaagatcgagaaatttggagatttaattctgaaagctacagagcctcaaatggttttgttcaatatatatgatgactggttgaagagtatctcatcgtatactgcattctcccgacttattttgatccttcgtgcacttcatgtgaataatgagaaggcaaagatgttgctaaagccagacaaaacaatcatcacagagccacatcacatatggccttctctttctgatgatcaatggatgaaggttgaagttgccctaagagatctcatactttcagattatgccaagaagaacaatgtcaatacatctgctttgacacagtctgagatccgtgatattatacttggagctgagattacacctccttcccaacagaggcaacagatagctgagattgagaaacaggccaaagaagcaagtcaattgacagctgtaactacaaagactacaaatgtccatggtgatgaactcattgttacaaccactagtccttatgagcaagctgcatttggttccaaaacagattggcgtgtgagagcaatatcagctaccaatctctatcttcgagttaatcatatatatgtcaactcagaggacataaaggagactggctacacttacattatgccaaagaatattttaaagaaattcatctgcatagcagatcttcgaactcaaatttctgggtacttatatggtataagcccgccagataacccgcaggtcaaggaaattcgttgtattgccatgccaccacaatggggcactcatcagcaagttcatcttccttcggcactccctgagcatgatttcctgaatgatctggagcctttgggatggatgcacactcaaccaaatgagcttccacagctatcgcctcaggatctcacttctcatgcgcggattctagaaaacaataaacaatgggatggagagaaatgcattatcttgacttgtagtttcaccccaggttcctgctcgttaactgcatacaagcttactccaagtggttatgagtggggaagagttaacaaggacacaggaagcaatccccatggatatcttccaactcactatgagaaggtccaaatgcttctgagtgaccggttccttggtttctacatggttcccgacaacggtccatggaactataacttcatgggagtgaagcatacagtgagcatgaaatatggtgtcaagcttgggactcctcgagaatactaccatgaggaccataggccaactcatttcttggagttcagcaacttggaggagggtgaaatggcagagggagatcgtgaggatacattctcataagcctattgatgctattttgaggtcgtaatctttcttgtgaattaaattgtagcatttgcttggaaactgctagactggagtagatttactttaccaacatggggatgaagcagtgccccatttttggtcgttataaaaacgtgtttacttatgggacagttgtaattctctgtagaatgatagtttgaggtgtaaatatatacggtaacgaggtttcat

SEQ ID NO: 927 - DNA, 7495 bp, Citrus sinensis
ctctctcgtctcggcactgagtggggtaagagagaagagaaactaaaccccaaaaacctaataacattttcttttttccattttgtcatttctcatcaactcaaaaccccaatactcaaatttgcggagaacgtctttagcatcactattagggtttatttcgacgcagatcttatcgggagagttagttggaatcagaagcgatgtacaacaacaacggtaacaacggagggccgccgttggcaccgccagggacgagcggggcggtgccgataccgcctccgccgtcgcagccttcgtacactgtgttgaccacgacgccgtccccgcaggaggcggaggccaggctggaggagaaagctcgaaaatggatgcaattgaactcgaagagatatggagacaaaaggaagttcgggttcgtcgaggctcagaaagaagacatgcctccggagcacgtgaggaagattattcgagaccatggggatatgtcttcgaagaaatatcgtcacgataaacgtgtgtatctaggagcgcttaaatttatcccacatgcagtttacaagctcctcgagaatatgccaatgccttgggaacaagttcgtgatgtgaaggttttatatcatattaccggagccatcacatttgtgaatgaaataccatgggttgttgagcctatatacctcgctcagtggggtaccatgtggatcatgatgaggagagagaagagggatcgtcgtcatttcaagagaatgcgatttccaccatttgatgacgaggaaccaccattagattatgcagataatctgttagatgttgatccactggagccaattcaactagagttagatgaagaagaagattctgctgtatatacttggttttatgaccataagcctcttgttaaaacaaagcttataaatggtccaagctaccggaaatggcacctttcccttccaatcatggcgactcttcatcggcttgctgggcagctcctttctgatttaattgaccgcaactatttctacttgtttgacatggagtcattttttacagccaaggcattgaatatgtgcatacctggtggtcctaagtttgagcctttgtaccgtgacatggaaaaaggtgatgaggattggaatgaattcaatgacatcaataaactcattattcggtcacccttgaggactgagtacaggatcgctttccctcacctatataacaacaggcctcgcaaagtgaggcttggtatataccacactcccatggttatgtacataaaaactgaggatcctgatttgcctgcattttactatgatcctttgatacaccccataccttccacaaacaaggagaggcgtgaaaagaaagttatgatgatgaggatgaagatgatgacttctttttgccggagcaggtggaacctttgcttaaagatactcagctttatactgataccacagctgctggtatttccctattatttgctccgcgcccttttaacatgagatctggtcgaatgcgacgagcagaagatatacccctagtgtctgactggtataaggagcactgccctccatcatatccagtaaaagttcgggtcagctatcagaaattgttgaaatgttttgtgctgaatgagctgcatcacagaccaccaaaggctcagaagaaaaagcacttgttccggtctctccaggcgacaaaattcttccaaaccactgaacttgactgggctgaagcaggtctgcaagtttgtaagcagggttacaacatgctgaacctattgatacatagaaaaaatttgaattaccttcaccttgattataactttaacttgaagcctgtgaaaactctcactacaaaagaacgcaaaaaatcgcggtttggcaatgcttttcatctttgtcgtgaaattctgcgtttaacaaagcttgtagttgatgccaatatccagttccgcctgggtaacgtagatgctttccagttggctgatggtctgcagtatacgttttcccatgttggccagttgactggtatgtaccgttacaagtacaggctgatgcggcagattaggatgtgtaaggacttaaaacacttgatctattaccgtttcaatactggtccagtggggaaggggcccggttgtggattctgggctccaatgtggagggtgtggctgtttttccttcgcggtatagtgccacttctggaaagatggttaggaaatctactggctcgacagtttgaagggcgccattccaaaggagtggccaagactgttaccaagcaacgtgttgaaagccactttgatttggagcttcgagctgctgtcatgcatgatgttcttgatgccatgccagagggcattaagcaaaacaaggcgagaactatactgcagcatctgagtgaggcatggcgctgttggaaggcaaatataccatggaaagttcctggtctgccagttcccattgagaacatgattcttcggtatgtcaagtcaaaagctgactggtggacaaatgttgctcactacaatcgtgaacgtataagaagaggagcaacagttgataagacagtctgtcggaagaaccttggaagattgactcgcctttggctgaaggcagaacaggaacgacagcacaactatttgaaagacggtccgtatgtcaccccagaagaagctgttgccatttatacaacaactgtccactggttggaatcgagaaagtttgctcccattccatttcctccattgtcatacaagcatgatacaaagttacttatccttgctctggagagactgaaagagtcgtatagtgtggctgttagattaaaccaattgcaaagagaagagttgggtcttattgaacaggcttatgataatccacatgaggcattgtcaaggattaagcgtcacctgcttacccagcgtgcatttaaagaagttggtattgagttcatggatttatacagctatctgattccagtttatgaaattgagccacttgagaagataacagatgcctatcttgaccaatatttatggtatgaaggtgacaagcgtcacctctttccaaactggattaaacctgcagattcagaaccaccaccgcttttggtgtataaatggtgtcaaggtataaataatttgcaagggatatgggacacaagtgacggccagtgtgttgtgatgcttcaaaccaagtttgaaaagttctttgaaaaaattgacttgacgatgttaaataggcttttgcgattggtccttgaccacaacatagcagattatgtcaccgcaaagaacaacgttgtcttgtcttacaaagacatgagtcatacgaactcttatggccttatacgtggtcttcagtttgcttcttttgtggtccagtattatggacttgtgttggatctcttgcttcttggtttgacacgagccagtgagattgctggaccgccccatatgccaaatgagttcatcacatactgggacacgaaagttgagaccaggcatcccatacggctgtattctaggtacattgataaggtgcatattttgttccgattcactcatgaggaggctcgagatcttatccaacgttatctcactgagcaccctgatcccaacaatgaaaatatggttggatacaacaacaagaagtgctggcctagagacgcgagaatgaggctcatgaaacacgatgtcaatcttggtaggagtgttttctgggatatgaagaaccgtcttcctagaagcattacaactttggagtgggagaacagttttgtttcagtttacagcaaggacaaccccaatttgcttttcagcatgtgtgggtttgaagttcgaatacttccaaaaatcagaatgactcaagaagcatttagcaatacaagggatggggtctggaatttgcagaatgaacagaccaaagagcggactgcagttgctttcttacgggttgacgatgagcacatgaaggtgtttgagaatcgtgttaggcaaattcttatgtcttcagggtcaacaacttttacaaaaattgttaacaaatggaatacagcactgataggtctcatgacttacttccgtgaagcaactgttcatacccaagagcttttagatttgcttgtcaaatgtgaaaataaaattcaaacccgcatcaagattgggctgaactcaaaaatgcctagcagatttcctcctgtcattttctatacgcccaaagaaattggagggcttggcatgttatcaatgggtcatatcttgattcctcagagtgaccttcgatacagtcagcagacagatgttggtgtgacccactttagaagtggaatgagccatgaggaggatcagctgattccaaatctttatcgttatatacagccatgggagagtgagtttatagattcacagcgtgtctgggcggagtatgcactgaagaggcaggaagctcaggcgcagaacaggcgtttaacacttgaggatctagaagattcatgggatagaggaataccacgtataaatactttgtttcaaaaggacaggcacactttagcctatgacaaagggtggagagtgcgcacagactttaagcagtaccaagtactgaaacagaaccctttctggtggacacatcagagacatgatgggaaattgtggaatctgaacaactatcgaactgatgtcatccaagctcttggaggtgtggagggtattctcgagcacacccttttcaaaggaacatactttccaacttgggaaggtctgttttgggaaaaggcgtcaggttttgaagagtctatgaaatacaagaagctgactaatgcacagagatctggtctcaaccagattcctaaccgtcgatttactctttggtggtcgcctaccataaatcgggccaatgtctatgtgggtttccaggtgcagttggatctgacaggaattttcatgcatgggaagattcctaccttgaagatatcgttgattcagatctttcgtgctcatttgtggcaaaaaattcatgagagtgttgtcatggatctttgtcaagtcttagatcaggagttggatgctttggaaattgaaactgtgcagaaggaaacaattcatccaagaaagagttacaaaatgaacagctcttgtgcagatatcctcctctttgctgctcatcgatggccaatgtcaaagcctagtcttgtggctgagtcaaaggatatgtttgaccagaaagcaagcaataaatactgggtagatgtacaactccgttggggagattatgattctcatgatattgagcgttatactagggccaaatttatggattatacgacagacaacatgtccatatatccttctcctactggggtgatgattgggcttgacctggcctataatttgcattctgcatttggtaactggttcccgggatcaaaaccgttgcttgctcaggcaatgaataagataatgaagtcgaatccagctttgtatgttctgagggagcgtataaggaaaggtctgcagttgtattcttcggagcctactgaaccatatctatcttctcaaaactatggagagattttcagcaatcaaataatatggtttgttgatgataccaatgtgtatcgtgtcacaatccacaagacatttgaaggaaatctaacgactaagcccattaatggtgctatctttatattcaacccaaggactggccagttgttccttaaggtgatccacacaagtgtatgggcaggtcaaaagcgtcttggtcagctagccaaatggaaaacagcggaagaagttgctgctcttgtgcggtctctgcctgttgaagaacaacccaagcaaatcattgtgacccgtaaaggaatgcttgatccattggaggttcacttgctggatttcccgaacatagttattaaaggaagtgagttgcagctccctttccaggcctgcttgaagatcgagaaatttggagatttaattctgaaagctacagagcctcaaatggttttgttcaatatatatgatgactggttgaagagtatctcatcgtatactgcattctcccgacttattttgatccttcgtgcacttcatgtgaataatgagaaggcaaagatgttgctaaagccagacaaaacaatcatcacagagccacatcacatatggccttctctttctgatgatcaatggatgaaggttgaagttgccctaagagatctcatactttcagattatgccaagaagaacaatgtcaatacatctgctttgacacagtctgagatccgtgatattatacttggagctgagattacacctccttcccaacagaggcaacagatagctgagattgagaaacaggccaaagaagcaagtcaattgacagctgtaactacaaagactacaaatgtccatggtgatgaactcattgttacaaccactagtccttatgagcaagctgcatttggttccaaaacagattggcgtgtgagagcaatatcagctaccaatctctatcttcgagttaatcatatatatgtcaactcagaggacataaaggagactggctacacttacattatgccaaagaatattttaaagaaattcatctgcatagcagatcttcgaactcaaatttctgggtacttatatggtataagcccgccagataacccgcaggtcaaggaaattcgttgtattgccatgccaccacaatggggcactcatcagcaagttcatcttccttcggcactccctgagcatgatttcctgaatgatctggagcctttgggatggatgcacactcaaccaaatgagcttccacagctatcgcctcaggatctcacttctcatgcgcggattctagaaaacaataagcaatgggatggagagaaatgcattatcttgacttgtagtttcaccccaggttcctgctcgttaactgcatacaagcttactccaagtggttatgagtggggaagagttaacaaggacacaggaagcaatccccatggatatcttccaactcactatgagaaggtccaaatgcttctgagtgaccggttccttggtttctacatggttcccgacaacggtccatggaactataacttcatgggagtgaagcatacagtgagcatgaaatatggtgtcaagcttgggactcctcgagaatactaccatgaggaccataggccaactcatttcttggagttcagcaacttggaggagggtgaaatggcagagggagatcgtgaggatacattctcataagcctattgatgctattttgaggtcgtaatctttcttgtgaattaaattgtagcatttgcttggaaactgctagactggagtagatttactttaccaacatggggatgaagcagtgccccatttttggtcgttataaaaacgtgtttacttatgggacagttgtaattctctgtagaattatagtttgaggtgtaaatagatacggtaacgaggtttcat

SEQ ID NO: 928 - DNA, 7030 bp, Manihot esculenta
ctaaactaccatgtggaacaataatggagaggcgcatatcgcgccgccggggactggtggtccgccggtacctccaccacctgtcccggcacagccttcatatactgtgcttgcaccgcaaacacctccaacgccggccgaggcggaggccaagctggaagaaaaggcacgtaaatggcagcagcttaatacgaagaggtacagcgataagaggaagtttggattcgttgagacgcagaaagaagacatgccgccggagcatgtcaggaaaattatcagagatcatggggacatgtcctccaagaaatatcgtcacgataaacgtgtgtatcttggagcacttaaattcataccacatgcggtttacaagcttcttgagaatatgccgatgccctgggagcaggttcgtgatgtgaaggttctataccatatcactggggcaatcacttttgtgaatgaaattccatgggttgttgaacctatttatttagctcagtggggtacaatgtggatcatgatgagaagagagaagagggatcgacgccactttaagagaatgcggtttccaccatttgatgatgaggaacctccattggactatgctgataatttgttagacgttgatcctctagagcctattcaattggagatggatgaagaagaagattctgcagtatacacttggttttatgaccataagccccttgtcaaaacaaagcttatcaatggtccaagttacaggaagtggcatctctcccttcctatcatggcaactcttcatcggctggcaggacagctcctatcagatctaattgatcgcaattatttctacttgtttgacatggagtcattctttacagctaaagccttaaacatgtgcatacctggtggtcctaaatttgagcctttgtatcgtgacatggagaagggggatgaagattggaatgagttcaatgacattaacaagctcattattcggtcacctctcaggacagagtacagaattgcattccctcatctttataacaataggcccaggaaagttaagctttgtgtgtatcacactcccatggtcatgttcattaaagctgaggatcctgatttacctgctttctattatgatccattgatacatcctataacctccaccaacaaggaacggcgagaaaagaaggcttatgatgatgatgaggatgatgatttccttttgccggaaggagttgaaccttttctgcatgacactcagctttatacagacaccacagctgctggtatttccctgttatttgcaccacgaccatttaacatgagatctggtcgtatgcgacgagcagaagatataccccttgtgtctgagtggtacaaggagcactgtcctccttcatatccagtgaaagttagggttagctatcagaaactgttgaaatgctttgttttgaatgagttgcatcataggccacccaaagcgcagaagaagaagcacttgttccggtctctagctgcaaccaaattcttccaaacaacagaacttgattgggctgaagcaggtttacaagtttgtaagcaggggtacaacatgctgaacctgttgatacacaggaaaaatttgaattaccttcatcttgattacaattttaacttaaagcctgtgaaaacccttactacgaaagaacgtaagaaatctcggtttggtaatgcttttcatctctgccgtgaaatcctgcgtttgacaaagcttgttgttgatgccaatatccagttccggctgggtaatgtcgatgcattccagctggctgatggtctgcaatatacattttcccatgttggtcagttgactggcatgtatcgctacaagtataggctgatgcgacagattagaatgtgcaaagacttgaagcatttgatatattaccgcttcaatactggtccagtagggaaaggacctggctgtgggttctgggcaccgatgtggagagtatggttgtttttccttcgtggcattgtgcctcttctagaaaggtggttaggaaatctccttgcacgacaatttgaaggccgccattcaaaaggcacggctaagactgttacaaagcaacgtgttgagagtcactttgatttggagcttcgtgctgctgtcatgcatgatgtgcttgatgccatgccagagggcattaagcaaaataaagctagaaccatactacagcacctaagtgaggcctggcgttgttggaaagccaacattccctggaaggttcctggcttgccagttcctattgaaaacatgattcttcgatatgttaagtcaaaggcagactggtggacaaatgttgctcactataatcgtgagcgtataagaagaggtgcgactgttgataagacagtttgtcgaaaaaatctaggaagattgactcgcctttggctaaaggcagaacaggaacggcaacacaattatttgaaagatggtccatatgtcacaccagaagaagcagttgccatttatacgacaactgtgcattggctggagtccagaaagttttctcccattcctttccctccactatcttacaagcatgacaccaagctacttatccttgctttggaaaggttgaaggagtcatatagcgtggctgtcagattaaaccaactgcagagagaagaactgggtctcattgaacaggcgtatgataatccgcatgaggctttgtcaaggattaaacggcacctgcttactcagcgtgccttcaaagaagttggcatagagttcatggatttgtatagtgctttgattccggtttatgaaattgagcctcttgaaaaaataacagatgcatatcttgaccaatatctttggtatgaaggtgacaagcgccacctctttccaaactggattaagcctgcagattccgagcctccaccattgcttgtttataaatggtgtcagggtataaacaatttgcagggtatctgggacacaggtgaggggcagtgtgtagttatgctacaaacaaagtttgagaagttctttgaaaagattgacttgaccatgttaaacaggcttcttcgtttggtgcttgatcacaatattgcggattatgtcactgcaaagaacaatgttgtgttgtcctacaaagatatgagccacacaaactcatatggtttgatacgtgggttgcagtttgcttcctttgttgtacaatattatggacttgtgctagatctcttacttcttggattgactcgagccagtgagattgctggtccaccacaaatgccaaatgaattcatcacttattgggatacaaaagttgagacaaggcacccaattcgattatattctaggtatatagacaggttgcatatattattccgcttcactcatgaagaggctcgagatctcatccagcgatatcttactgagcatcccgatcctaacaatgaaaacatggttgggtatcaaaacaagaaatgctggcccagagatgcaagaatgaggcttatgaaacatgatgtaaatctcgggagaagtgtattttgggatatgaagaacctgcatgtgttttgtcaggcaattgaacctatacatatgtgtgggtttgaagttcggatacttcctaaaataaggatgactcaggaagcattcagcaataccagagatggtgtttggaatttgcaaaatgagcagactaaggagcgaacagctgttgctttcctacgagttgatgatgagcacatgaaggtgtttgagaatcgtgtgaggcagatccttatgtcttcagggtcaactactttcacaaaaattgtcaacaaatggaatacggctctgataggtttgatgacttacttccgcgaagctactgtgcatactcaagagttactagatttgctggttaaatgtgaaaacaaaatccaaactcgtattaagattggtttaaactcaaagatgccgagccgatttcctcctgtcattttctacacgccaaaagaaattggaggacttggcatgctatcgatgggccacatattgatcccacaaagtgatctgcgatatagccagcagacagatgttggtgtaactcacttcaggagtggaatgagtcatgaagaagaccaactgattccaaatctttatcgctatattcagccatgggagagtgagttcatcgattcgcagcgtgtctgggcggaatatgcccttaagaggcaggaagcacaggcacaaaataggcgtcttaccctagaagatttggaagattcttgggataggggaattccgcgtattaataccttatttcagaaggaccgtcatactcttgcatatgacaaaggatggagagtgcgcactgatttcaagcaataccaagttctgaagcagaatcctttctggtggactcaccagaggcatgatgggaaactctggaacttgaacaattaccgaactgatgttatacaagctctgggtggtgttgagggaattcttgagcatactttgttcaaaggaacatatttcccaacttgggaaggtctcttttgggagaaggcatctgggtttgaagaatcaatgaagtacaagaagcttacaaatgctcaaagatctggtctcaatcaaattcccaatcgaagatttaccctttggtggtcacccacaataaatagggccaatgtctatgtgggttttcaagtgcaattagatctaaccggcatcttcatgcatggaaagatcccaaccttgaagatttcattgattcagatattccgagctcatctgtggcaaaagattcatgagagtgttgtgatggatctgtgccaagtcttagatcaggagttggatgctctggaaattgaaaccgtgcaaaaggaaacaattcatccaaggaagagttacaagatgaacagctcctgtgctgacgttctcctatttgcggctcacaggtggcctatgtcaaagccaagtcttgtggcagagtcaaaagatgtgtttgatcagaaagccagcaataaatattggatagatgtacagctcaggtggggtgactatgactctcatgatattgagcgttatacccgggccaaatttatggattacacaacggataacatgtctatatatccatctccaactggggttatgattgggcttgatctggcatacaacttgcattctgcatttggtaactggtttcctggatcaaaaccactgctagctcaggccatgaataaaataatgaagtcaaacccagctttgtatgtcttgagggagcggataaggaaaggtttgcagttgtattcttctgagcctacagaaccttatttgtcatcccaaaactacggtgagatcttcagcaatcagattatatggtttgttgatgacaccaatgtgtatcgtgttacaattcacaagacatttgagggaaaccttacaacaaaacccataaatggtgcaatatttatattcaatccaagaactggccagctgtttctgaaggtcatccacactagtgtatgggcaggacagaagcgtcttgggcaacttgctaagtggaaaactgctgaagaagttgcagctcttgtacggtctctgcctgttgaagaacaaccaaaacaaattattgtgactcgtaaagggatgcttgatccattggaggttcacttgcttgatttcccaaatatagttattaaaggaagtgagttgcagttgccattccaagcatgcttgaagatagagaaatttggtgatctgattttgaaggcaacagagccacaaatggttctgttcaatatttacgatgattggctgaagagcatctcatcatacactgcattttcccgacttattttgatccttcgtgcacttcatgtgaataatgagaaggcaaagatgctactcaagcctgataaaaccatcattactgagccgcaccatatatggccttctctcactgatgatcaatggatgaaggttgaggttgctttaagggatctcatactttcagactatgccaagaaaaacaatgtaaacacctcagcgctgacacagtctgagatccgtgatattattcttggtgctgagattactcctccttctcaacaaaggcaacagatagcagagatagagaaacaggccaaagaagccagtcagttaacagcagtcacaacaaggacaacaaatgtgcatggtgatgaactcatcgtcaccacaactagtccctatgagcaggctgcatttggttccaaaaccgattggcgtgtccgagcaatatcagctacaaatctctaccttcgggtcaatcacatatatgtcaattcggaagatattaaggaaacgggatatacttatatcatgcccaagaacattttgaagaaatttatctgcatagcagatttgcgtactcaaatagctgggtacctttatggtattagtcccccagataaccctcaggtgaaggagatccggtgtattgccatgccaccacagtggggtactcatcaacaagttcatctcccgtcagcactccctgagcatgatttcctcaatgatctggagcccttgggatggatgcacacccaaccaaatgagcttcctcagttatcaccacaggatctgacaaatcatgctcggattttagagaacaacaagcaatgggatggggagaagtgcatcatcttgacttgcagttttactcctggatcatgctcattaactgcatataagcttaccccgagtgggtatgagtggggtcgtgtcaacaaggacactggaagcaatcctcatggttacttgccaactcattatgagaaggtccagatgctattgagtgatcgtttccttggtttctatatggttcctgataatgggccatggaattacaatttcatgggggtgaagcatacagtgagcatgaaatacggaatcaagctggggacaccaagggagtattaccacgaggaccatagaccaacccactacctggagttcagcaacttggaggagggtgacgttgctgagggtgaccgggaagataccttcacttaa

SEQ ID NO: 929 - DNA, 4396 bp, Quercus alba
cctcccccacttttggtttataaatggtgtcagggtataaacaatttacaaggtgtatgggacacaagtgatggccaatgtgtggtgatgcttcaaacaaagtttgaaaagttctttgagaagattgacttgacaatgttaaacaggctcttgcgattggttcttgaccacaacattgctgattatgtcaccgcaaagaacaatgttgtgttgtcttacaaggatatgagtcacacaaactcatacggtctaatccgtggtctccagtttgcttcttttgttgtacagtattacggacttgtgctggatctcttgctccttggattgactcgagctagtgagattgctgggcccccacagatgcctaatgagttcattacttattgggacacgaaagttgagacacggcacccgattcggctttattctcgatacatagacagggtccacatattgttccgcttcacccacgaagaggctcgagaccttatccagcggtatcttactgagcatcctgatcctaacaatgaaaatatggttggatataacaacaagaagtgctggcctagagatgcaagaatgaggctcatgaaacacgatgtaaatcttgggaggagtgttttctgggatatgaagaaccgtcttcctcgaagcatcactacattggagtgggagaacagttttgtttctgtatacagcaaggacaatccaaacttgcttttcagcatgtgtgggtttgaagttcggatacttcctaaaataaggatgacccaagaagcattcagtaatacaagagatggtgtttggaatctgcagaatgaacagaccaaagaacggactgcagttgctttcttgcgggttgatgatgaacacatgaaggtgtttgagaatcgtgtgaggcagattcttatgtcttcaggatccacaacatttacaaaaattgtcaataaatggaatacagccttgataggtctcatgacttatttccgtgaagccactgtgcatactcaagagctgttagatttgctggttaaatgtgaaaataaaatccaaacccgtattaagattgggttgaactcaaagatgcctagcaggttccctcctgtcattttctacactccaaaggaaatcggaggacttggcatgctttctatgggtcatatattgattccacaaagtgacctccgttacagccagcagacagacgttggtgtaacccactttaggagtggaatgagccatgaagaggaccagctgattccaaatctttatcgatatatacagccatgggagagcgagttcatagattcacagcgtgtttgggcagaatatgcattgaagaggcaggaagctcaggctcaaaataggcgtttgacccttgaagatttggaagattcatgggacaggggcatacctcgtataaacactttgtttcagaaggaccgacacacattggcatatgacaaaggatggagggtgcgtactgacttcaaacagtaccaagttttaaaacagaaccctttctggtggacacaccagaggcatgatgggaaactttggaacttgaacaattatcgaactgatgtcattcaagctttgggtggtgttgagggaattcttgagcataccttattcaaaggaacatactttccaacttgggaaggtctcttctgggaaaaggcatctggttttgaggaatcaatgaagtataagaagctgacaaatgctcagagatctggtctcaaccaaatccctaaccgtaggtttacgctttggtggtcacctacgataaatagagcaaatgtgtacgtgggttttcaagtccaattggatctaactggaatcttcatgcatgggaagatccctaccttgaagatatcactgattcaaatattccgtgctcatttgtggcaaaaaatccatgagagtgttgtcatggatctttgtcaagttttggatcaggagttggatgctttggaaattgaaactgtgcagaaggaaacaatccatccaagaaagagttacaaaatgaacagctcttgtgcagacattcttctctttgctgcacatagatggccgatgtcaaaacctagtcttgtagctgaaccaaaggacgtgtttgatcagaaagcaagcaataagtactggatagacgtgcagctccgctggggagattatgactctcatgatattgagcgttacactcgggccaaatttatggattatacaacagacaatatgtctatatatccatctcctactggtgtaatgattggaattgatttggcatacaacttgcattctgcatttggtaattggtttcctgggtcaaagcctctgcttcagcaggctatgaataagatcatgaagtcaaatccagctttatacgtcttgagggagcggataaggaaaggtttacagttgtattcttctgagcccactgaaccatatttgtcatctcagaattatggagagatcttcagcaatcaaataatttggtttgttgatgacacaaatgtgtatcgtgttactatccataagacatttgagggaaatcttacaactaaacccatcaatggtgccatctttatattcaatccaaggactggacagctgttcctgaaggtcatccacacaagtgtgtgggcaggacaaaagcgtcttggtcagttggccaagtggaaaacagcagaagaagttgctgctctagttcggtctttgcctgttgaggaacagccaaaacaaattattgtgactcgtaagggaatgctggatccattggaggttcacttgctggatttcccgaacatagttatcaaaggaagtgagctgcagcttccattccaagcatgcttgaagattgagaaatttggtgatctgattttgaaggccacagagccgcaaatggtccttttcaacatttatgatgattggttgaaaagtatttcctcatacactgcattctcccgactcattctgatcctgcgtgcgctacatgtgaacaatgagaaggcaaagatgttactaaagcctgacaaaacaatcattactgagccacaccacatctggccatctctcactgatgatcaatggatgaaggttgaggttgctcttagagatctcatactgtcggattatgccaagaagaacaatgtgaatacgtcagctctgacacagtctgagatccgtgatattatacttggagctgagattactcctccttctcaacagagacaacagattgctgagattgagaaacaggcgaaagaagcaagtcagctgaccgcagttacaacaaagactacaaatgtgcatggtgatgagcttattgtaaccaccacaagtccatatgagcaagctgcgtttgggtctaaaactgattggcgtgtgagagcaatatctgcaacaaacctctatcttcgtgtcaatcatatttacgtgaattcagaggatataaaggaaacaggatatacctatatcatgccaaagaacattttgaagaagtttatctgcatggcagatctgcggacacaaattgctggttacttgtatggtataagtcctcctgacaaccctcaggttaaggagatccgctgtattgccatgccaccacagtggggaacccatcagcaagtcaatcttccatcagctctcccagagcatgatttcctgaatgatttggagcctttgggatggatgcatacacagcctaatgaacttccccagttatcaccacaggatctcacaagtcatgctaagatcctggaaaacaacaagcaatgggatggagagaagtgcattatttgacctgcagtttcactccaggttcctgctccctaactgcatataagctgacaccatcagggtatgagtggggccgtgtcaacaaggacactggaagcaatcctcatggttaccttcccactcattatgagaaggtccaaatgcttctcagtgaccgtttccttggtttctacatgatgccggataatggtccatggaattacaacttcatgggggtgaaacatgcacctagtatgaagtatggggtcaagctcgggacaccacgtgagtattatcatgaagaccacaggccaactcatttcctggagttcagcaacttggaggagggagagacttttgctgagggagaccgtgaggatacctttacataggagtcgggattattaacaaatattgttagttacaatgagaagtaattgtagtacatttgcagacttgggacagaaatcgtagagccctttgttgtaataatcatgtatatcatgatatggatggatatattatatccagattgaggttgtaagctttttgtagcgattgtaaactagtcggttgtatatataatattttggtatctaaagtgcatacattc

SEQ ID NO: 930 - DNA, 7850 bp, Theobroma cacao
gttaattcattcatgatggaaatctatatctttgctaggtagaccaactacacgttccgacgttaaaggaaacagatggtttacctgaaaagagaggccaaagaagacgacagattggcaggcaccagctaggtagccaagaatgaaatgctttgcggactgccatggaggccatggatatggatataaagagcatagcctaggcaaacccattgtaaagaaagtgatattggcgcggctcaatctgaaatgaattcctatgcgcttctcgcatacgcccatcttcagattgaacctcaccaacatcgccttcatcttaatccaaattcatagagatggggacgggtgcaaactcatctccagaagtggaaagttttggtctgaaaacacatgctgtatatgctatctttggttggaaatacaacagtgtttttgggtatagcggggtgggaggaagtaggaaaggatttcatttctacctctgaagcagaaattgcttcagccaacgctgccatgtggaacaacaacaataacggcgctcagatagcgcctccgggaactgggggatccaccatcccgcctcctccagctgcgcagccttcttacaccgtgctggctccgcagacgactccgcaggaggcggaggccaagctggaggagaaggcgcggaaatggatgcagctcaactctaagcgatatggagataaaaggaagtttgggtttgtcgagacgcagaaggaggacatgcctcctgagcacgtcagaaagattatcaggtcagatattagaacacttttttagcaactttgaggacagagtttaagaccatggggacatgtcttcaaaaaagtatcgccacgataaacgtgtgtatcttggggcccttaaattcattccccatgcagtttacaagctccttgagaatatgccaatgccttgggaacaggttcgtgatgtaaaggtcttatatcatattacaggagctatcacatttgtgaatgaaataccatgggttgttgaaccgatttacttagcacagtggggtacaatgtggatcatgatgcgaagggagaaacgagatcgtcgtcatttcaagagaatgcggtttccaccatttgatgatgaggaacctccattagactatgctgataatctgttagatgttgatcctctcgagccaattcaattggagatggatgaagaagaagattctgctgtatatgcttggttttatgaccataagcctcttgtaaaaacaaaactcatcaatggtccgagttacaggaaatggcatctctcccttccaattatggcaactttgcaccggcttgctggacagttgctttctgatttgattgaccgtaattatttctacttgtttgacatggagtcattcttcacggctaaagcattaaacatgtgcatacctggtggtcctaagtttgaaccactataccgtgatatggagaaaggggatgaggactggaatgaatttaatgacataaacaaactcattatccggtcaccccttaggacagagtaccgaattgctttccctcatctttataacaatcggcccaggaaagtaaagcttggtgtgtatcacactcccatggtcatgtacattaaaacagaagaccctgatttaccggcattctattatgatcccttgatacaccccataactaccacaaacaaggagcgacgtgagaagaaaatttatgatgacgaggatgaagacgattttgtcttgccagaaggggtggaacctttactgaatgacacacagctttatactgacactactgctgcagggatatctctgttatttgctccacgcccttttaatatgagatctggtcggatgcgacgtgctgaagatataccacttgtgtcagagtggtacaaggagcactgtccgccatcttatcctgttaaagtgcgggttagttatcagaaactattgaaatgctttgtgctgaatgagctgcatcataggcctcctaaggctcagaagaagaagcacttgtttcgatctctccaagcgactaagtttttccaaacgacagagcttgattgggttgaagcaggtcttcaagtttgcaagcaagggtacaacatgcttaacctgttgatacataggaaaaatttgaactaccttcacctggattataactttaacttaaagcctgtgaagactctcaccacaaaagaacgcaagaagtcacgatttggcaatgcttttcatctctgtcgtgagatcctgcgtttaacaaagcttgttgttgatgccaatgtccaattccgacttggcaatgttgatgccttccagttggcagatggtctgcagtatacattttcccatgttggccagttgactgggatgtaccgttacaagtaccgtctcatgaggcagattaggatgtgcaaagacttaaagcacttaatttactatcgcttcaatactgggccagtgggtaaaggacccggatgtggattttgggcaccgatgtggagagtatggctgtttttccttcgtggcattgtgcctcttctggaaaggtggttaggaaatctgcttgcacgtcagtttgaagggcgtcattcaaaaggagtggccaagactgttacaaagcaacgtgttgagagccattttgatttggaacttcgtgctgctgtgatgcatgatgttcttgatgccatgccagagggcattaaacaaaataaagctagaacaatattgcagcatctcagtgaggcatggcgatgttggaaggcaaacatcccctggaaggttccgggtttgccagttcccattgagaatatgatccttcgatatgtcaagtcaaaagcagactggtggacaaatgttgctcattacaatcgtgagcgtatcaggagaggtgcaactgttgataaaacagtctgcaggaaaaacttaggcagattgactcgcctctggctgaaagctgagcaggaacgacagcacaattatttgaaagatgggccatatgtcactccagaagaagcagttgccatttatactacaactgtgcattggttggagtcaagaaagttttctcccattccatttcctcctttgtcttacaaacatgatacaaagctacttatccttgcactggagaggttgaaggaatcttacagtgtagctgtgagattaaaccaactccaaagagaagaattgggtctaattgaacaagcttatgataatcctcatgaggccttgtcgaggatcaagcgccacctgcttacccagcgtgccttcaaagaagttggtatagagttcatggatttgtacagctatttgattccagtctatgaaattgagcccctggagaagattacagatgcttatcttgaccaatatctatggtatgaaggagacaagcgccacctgtttcctaattggattaagcctgcagattcagagccacccccgcttttggtttacaaatggtgtcaaggtataaacaatttgcaagggatatgggacacaagtgaggggcagtgtgtggtgatgcttcaaacaaagtttgagaagttctttgagaagattgacttgacaatgttaaacaggcttctacgtttggttcttgatcacaacattgcagattatgttactgcaaagaataacgtggtgttgtcttacaaagatatgagtcacacaaattcatatggtcttatccgtggtcttcagtttgcttcttttgttgtccagtattatggacttgttttggatctcttgcttcttggattgactcgtgctagtgagattgctggtcctccccagatgccaaatgaatttatcacatactgggacacaaaagttgagacccggcatccaattcgtctgtactctaggtacattgataaggtgcatatattgttcagattcactcatgatgaggcacgagaccttatccagcgatatctcactgagcaccctgatccgaacaatgaaaacatggttggatataacaacaagaaatgctggccaagagatgcaagaatgaggcttatgaaacacgacgttaatcttgggagaagtgtcttttgggacatgaagaatcgtttgcctagaagcatcacaactttggaatgggagaacagctttgtttctgtctatagcaaggacaatcccaacctgctttttagcatgtgtggttttgaagttcggatacttccgaaaacaagaatgactcaagaagcatttagcaatacaagagatggagtgtggaatttgcagaatgaacagacaaaagagcgaaccgcagttgctttcttacgggttgatgatgagcacatgaaagtatttgagaatcgtgttaggcagattctcatgtcttctgggtcaacaacatttacaaagattgttaacaaatggaatactgccttaataggtcttatgacctacttccgtgaagcaactgtacacacacaagagcttttagatctgctggttaaatgtgaaaataaaattcaaactcgtatcaagattggactgaattcaaaaatgcctagccgattccctcctgtcattttttacactcctaaagaaattggtggacttggcatgttatcaatgggtcacatattgattccacagagtgacctccgatacagtcagcagactgatgttggtgtaactcactttaggagtggaatgagtcacgaggaagaccagctgattccaaatctttatcgttacatacagccatgggaaagtgagttcatagactcacagcgtgtttgggcagagtatgcactgaagaggcaggaagctcaggcacaaaataggcgtctaacccttgaagatttggaagattcatgggataggggaataccacgtataaatactttgtttcagaaggataggcacacgttagcatacgacaagggatggagagtacgtacagacttcaagcagtaccaagttttgaagcagaacccattctggtggactcaccaaaggcatgatggcaaattgtggaacttgaataactatcgaactgatgtcatccaagctctgggaggtgttgaaggaatcctagagcataccttgtttaaaggaacatactttccaacttgggagggtctgttttgggaaaaggcttctggattcgaggagtcaatgaagtataagaagctcactaatgctcagagatctggtcttaaccagattcctaaccgtaggtttactctttggtggtcaccgacaattaatcgggctaatgtttacgtgggatttcaagtgcaactcgatctaactggaattttcatgcacgggaagatcccaaccttgaaaatatccttgattcagatcttccgtgctcatttgtggcaaaaaatacatgagagtgtggttatggatctttgccaagtcttagatcaggagttggatgctttggaaatcgaaactgttcagaaggagacaatccatccaaggaagagttacaagatgaacagctcttgtgcagatattcttctctttgcagctcatagatggcctatgtcaaagcctagtcttgttgcagagtccaaggatatgtttgatcaaaaagcaagcaacaaatattggatagatgtacagctccggtggggagattatgattcacatgatattgagcgttacactcgagccaaatttatggattatacaacagacaacatgtctatttatccatctcctacaggggtgatgattggccttgatctagcttacaacttgcattctgcatttggcaactggttccctggatcaaagccactgcttgctcaggcaatgaataagatcatgaagtcaaatccagctttatatgttttaagagagcggataaggaaaggtttacagttgtattcttctgagcctactgagccatatctttcatcccaaaactatggagagatcttcagcaaccagatcatttggtttgttgatgacaccaatgtgtatcgtgttacaatccataagacatttgaagggaatctcacaacaaaacccattaatggtgccatctttatattcaatccacggacaggacagttgttcttaaaggtcattcatacaagtgtgtgggcaggtcaaaagcgtcttggtcagctagccaagtggaaaacagctgaagaagttgctgctcttgtgcggtctttgcctgttgaagaacaaccaaagcaaatcattgttactcgaaagggaatgcttgatcctttggaggttcacttgctggatttccctaacatagttatcaagggaagtgagttgcaactcccattccaggcttgcttgaaaattgagaaatttggggatctgattctgaaggctacagagccacaaatggttttgtttaacatctatgatgactggttgaaaagtatctcatcatacactgcattctctcgactcattctgatccttcgtgcacttcatgtgaacaatgagaaggctaagatgttattgaaacctgataagacaattgttactgagccacaccatatctggccttctcttactgatgatcaatggatgaaggtcgaagttgctttaagagatctcatactctctgactatgccaaaaagaacaatgtgaatacatcagccctgacacagtctgagattcgtgatattattcttggagctgagatcactccaccctctcaacagaggcagcagatagcagaaatcgagaaacaggcaaaggaggcaagccagctgacagctgtgacaactaggactacaaatgtgcatggtgatgaactcattgtcaccaccacaagtccctatgagcaagcagcatttgggtccaagacagattggcgtgttagagcaatatcagcaacaaatctttatcttcgagtcaatcatatatatgtgaactcagaggatataaaggaaactgggtacacttacatcatgccaaagaacattctaaagaagttcatctgcatagcagatctacggactcaaattgctggatacttgtatggaataagtcctcctgacaatcctcaggttaaggaaattcgctgcattgccatgccaccacagtggggaactcatcagcaagttcatcttccatcagctcttcctgaacatgatttcttgaacgatctggagcctttgggatggatgcacacacagccaaatgagcttcctcaattatcgccacaggatgtcacatctcatgctcggattttagagaacaacaagcagtgggatggagagaagtgcattatcttgacatgcagtttcactccaggttcttgctcattaacagcatacaagctgactccaagtggttacgagtggggacgggttaacaaagatacaggaagtaatccccatggttaccttccaactcattatgagaaggtgcagatgctcctaagtgatcggttccttggattttatatggttcctgacaatgggccatggaattacaatttcatgggagtgaagcacacagtaagcatgaaatatggggtgaagcttggaccacctagagaatactaccaggaggaccacaggccaactcattacctcgagttcagcaacttggaggaaggtgagactgcagagggagacagggaggatacatttacctaaatctgttcaatggtattatgtttgtaatttttgttgaattaactctgaaacacttaatgctttttcagtgcttggcctgaaagatcagtagaggcctaaatctttttgtttggataacttacatgtaccttatcccaattgtaacattgctgaatctgttgtaaatatacgagtaaaatgcattttgatttaggcccctgaaagtttcttacattgttgtcatgtt

SEQ ID NO: 931 - DNA, 2995 bp, Podocarpus macrophillus
gcatctggcttcgaggagtccatgaagtacaaaaaactgacaaatgcacaaagatcagggctaaatcaaatccccaatcgacggtttactctttggtggtctcctaccattaatcgggccaacgtttatgtgggtttccaagttcagttggatttgacgggcatttttatgcatggaaaaattccaacattgaagatctcattgatacagatatttagagcacatctgtggcagaaagtgcatgaaagtgttgttatggatctctgtcaagtactagatcaggagctggatgctttggaaattgagaccgtacagaaggaaactatacatccccggaagagttacaagatgaacagctcttgtgctgatattcttctttttgcagcttataaatggcctatgtccaagcccagccttgtggcagagtcgaaggatacatttgatcaaaagtcgagcaataagtattggattgatgtgcagcttcgatggggagattatgattctcatgacattgagaggtatacaagggccaaattcttggactacacaacagacaacatgtcaatctatccatctcctacaggggtaatgattgcgattgatcttgcttataatttacattctgcatttggtaattggtttccgggttcaaagcctctgttggctcaagcgatgaataaaataatgaagtcaaatcctgcattgtatgtgttaagggagcgtatacggaaaggtctacagctttattcttctgagccaacagaaccgtatttgtcatctcaaaactatggagagattttcagcaaccaaattatatggtttgtggatgatacaaatgtgtatcgagtaaccatccataagacttttgaaggaaatcttacaacaaagcctatcaatggggcgatattcattttcaatccaaggacaggacaactgtttttgaaggttatccatactagtgtatgggcagggcagaagcggcttggccagctggcaaaatggaaaactgcggaagaagtagcggcattggtaaggtcactgccagtcgaggagcagccaaaacagatcattgttactcgtaaaggaatgcttgatcccttggaagttcatttactcgactttccaaacattgttatcaaaggaagcgagcttcagttgccattccaagcatgcttaaagattgagaaatttggtgatctgattcttaaggctactgagccacagatggttcttttcaacatttatgatgattggttaaaaactatctcatcatacacggcattttctcgtttaatattgatccttcgtgcacttcatgtgaataatgagaaagcaaagatgctcttgaaaccagacaagactgttgttacggagccacaccacatttggccaagtttatctgatgatcagtggatgaaggtggaagttgctttgagagaccttatcttgtctgactatgcaaagaagaataatgttaacacatcagcattaactcagtcagaaattcgggatattatacttggagctgaaattaccccaccttctcaacaaaggcaacagattgctgaaattgaaaagcaggcaaaggaagcaagtcaactcactgctgttacaaccaggacaacaaatgtgcatggtgatgaattaattgttaccactacaagtccatatgagcaagctgcatttggttctaaaacagattggcgagtcagggctatatctgcaacaaatctctatcttcgagtcaatcacatttatgtgaactcagatgacataaaggaaactggctatacatatattatgcccaaaaatatattgaagaaattcatttgtattgcggaccttaggactcagatagctggctatctttatggtgtaagtcccccggataacccacaggtgaaggaaattcgctgcataggtatgcctccacagtggggaacacatcaacaagtaaatttaccttcggcattgcctgagcacgagtttttgaacgacttagaaccactaggatggatgcatacacaacccaatgaactacctcagctatcaccccaggacctgacaagtcatgctcgaatactagagaacaataagcaatgggatggagagaagtgcataattctaacatgcagtttcactcctggctcctgttctttaactgcatataagcttacaccaactggatatgaatggggtcggctcaataaagatacaggaagcaatccacatggttatctccctactcactatgagaaagtacaaatgcttctgagtgaccgctttttgggcttctacatgattccagacaatggtccttggaattacaatttcatgggtgttaaacatacggttagtatgaaatatggagttaaacttggaactcctcgtgacttctacaacgaggatcatcgacccacacactttctggaatttagcaatcttgaagagggggagcatgcagagggagataatgaagatgttttcaattaagggttcattgctgtaataggtcacgtttgttcaacattgaaacagacaaagaagatgggacaggcttggtaaagctacatgagcattctaaaaattgagagtcgttaaattgatgttccataaatttgctatttcattgcttggaaaagcttttaaatagttgtagcttctttagcactcttccgagctatagtgcaactttgctgtacctttttagtcctactgaccaaaaatgttgtcgtttgtagacaacattaatataacatctcgtacgagacaatttgttttcaacgttttgatgaacaaggaaatatattacgagaatgtacttgtatcaacttcttttccaataatttcttcttttcttagctgtactcaacggttcagactttgtattcacctacacttgtgtgacactagacagtttgagaaggcttgtagtaaggaggatggattccagcctcgccgatccataaatgactggcaaaagtataagcaaaaa

SEQ ID NO: 932 - DNA, 2500 bp, Artemisia annua
ccaggttctggatcaggagttggatgcactggaaatcgagactgtgcagaaggaaacaatccatcccagaaagagttacaaaatgaacagctcatgcgctgacattctcctatttgctgcacatagatggccgatgtcaaaacccagtcttgttgctgagtcgaaggatatctttgatcagaaagcaattaataagtactggattgatgtgcagcttcgctggggtgattatgattctcatgatattgaacgttacacgagagccaagttcatggactacactaccgacaacatgtctatttatccttcaccaacaggggtgatgattggactggatcttgcatacaacttgcattccgctttcggtaattggttcccagggtcaaaaccgctgcttgcccaggctatgaacaagatcatgaagtcaaatccagctctatatgttttgagggagcgcatacggaaagggttgcaattgtattcttctgagccaactgaaccttacctgtcgtctcagaactatggagaaatctttagcaatcagattatttggtttgttgatgatacaaatgtgtaccgagtgaccattcacaagacatttgaaggaaatcttacaacaaaaccgattaatggtgctattttcattttcaatccacgtacaggacagctgtttttgaaggttattcacacaagcgtgtgggcagggcaaaagcgtcttggtcagcttgccaagtggaaaactgcagaagaagtggctgctcttgttcgatcattgcctgttgaggaacagcccaagcagatcattgtcactcgtaaaggcatgttggatcctttggaagtccatttgcttgatttccccaatattgttatcaagggaagtgagttgcagcttccgttccaggcttgtctgaaaattgagaaatttggggatctgattctgaaggcatctgaaccgcaaatggtgctgtttaatatatatgatgattggttgaagactatatcatcgtacacagcattctctaggctaattttgattctgcgagctctacatgtgaataatgagaaggcaaagatgttgctcaagcctgataagactattgttacagagccccatcacatctggccatctcttacagacgatcagtgggtgaaggttgaagttgctttaagagatctcatattgtctgattatgcaaagaagaataatgttaacacctcggcactgacacagtctgagatacgtgacattattcttggtgctgaaattaccccaccttctcagcagcgccaacaaatagccgagattgagaaacaggcaaaggaagctagtcaattgacggcagtaacaaccaggactacgaatgttcatggtgatgaactcattgttactacaacaagtccttacgaacaatctgcttttgcttccaaaactgactggcgtgtgagagcaatatcagctacaaacctctatctccgtgtgaatcatatatatgtaaactcggaagacataaaggaaacggggtacacatacattatgccaaagaatattttgaagaaattcatatgcattgctgatttgagaactcagatttctggctacttgtatggtgtaagtcctcctgacaaccctcaagtgaaagaaatccgttgcattgccatgccgccacagtgggggacccatcaacaagtgcatcttccatcagctctccctgaacatgacttccttaacgatcttgaaccattgggatggatgcacacccaaccaaacgagctccctcagttgtcgccacaggaccttaccttccatgctcggatattggaaaacaacaagcaatgggacggggagaaatcaatcatattgacttgcagtttcacccctggttcgtgctctttgactgcatataagctcactcctaccggatatgaatggggccgcgctaacaaagataatggaagcaaccctcatgggtatcttccaactcactatgagaaggtccagatgcttctaagtgaccgttttctcgggttctacatggttcctgataatggtccttggaactacaatttcatgggagtgaagcatacagcaggcatgaagtacgggataaagctaggaactccacgagaatattatcatgaagatcacaggccaacacatttcttggagtttagcaatctggaagaaggtgatgtggccgagggagatcgggaagacacattctcttaaacaaaaatgctgttgttaaaacttgttgtaaactgcaactttttgatcagtcgtgcaaactaggctcatctctgatatgttgtaaatatttgaatagttcatcttgatctgtatgatctatgcccggtgcttgcaaaccaggcttattacaaaagattttgtaggcatttgagagtttatataacaaaatcagaacttccgcgaagtgtttgacaatcatattgttttagttttcggttgtctcaaattaattgtccaccccgtcggagtact

SEQ ID NO: 933 - DNA, 7385 bp, Ricinus communis
atgtggaacaacaacggagaaccacatatagcgccgccggggacgggtggtccttcaataccaccgccatctgtgcctgctcagccgtcttataccgttctcgtacctcaatcgcaaacgcctcagactccggcggaggcggaggcgctgctagaagagaaggcacgtaaatggcagcaacttaatacgaagagatatagcgataaaaggaagtttggatttgttgagacgcagaaagaggacatgccgcctgaacatgttagaaaaattatcagagaccatggggacatgtcctcgaagaagtatcgtcatgataaacgtgtatatcttggagcccttaaattcattccacatgctgtttacaagcttcttgagaatatgccaatgccatgggagcaggttcgtgatgtgaaggttctatatcatatcactggtgctatcacttttgtgaatgaaataccatgggttgttgagcctatttacttagctcagtggggttcaatgtggattatgatgcgaagagagaagagggatcggcgacatttcaagagaatgaggtttccaccctttgatgacgaggagcctccgttagattatgctgataatctgttagatgttgaccctctagagcctattcagctagagttggatgaagaagaagattctgcagtttatacttggttttatgaccataagccccttgttaaaacaaagcttataaatggtcctagttacaggaaatggcatctctcccttcccatcatggcaacacttcatcggttggctgggcagctcctctctgatcttattgaccgcaactatttctacttgtttgacatggagtcgttcttcacagctaaagcattgaatatgtgcatacctggtggccctaagtttgaacctttgtaccgtgatatggagaagggggatgaagattggaatgagttcaatgatattaacaaactcattattcggtcacctctcaggacagagtacagaattgcatttcctcatctttataacaataggcccaggaaagtaaaacttggtgtatatcacactcccatggtcatgtacattaaagctgaggatccagatttacctgctttctattatgatccattaatacatcctataacctccactaacaaggaacgccgggaaaaaaagtctcaggatgatgatgaggatgaagatttccttttgcctgaaggggtggagcctttgctgcaggacactcagctttatacagataccacagctgctggcatctcactgttatttgccccacgtccttttaacatgagatctggtcggatgcgacgagcagaagatatacccctcgtgtctgagtggtataaggagcattgcccgccatcatatccagtgaaagttagggtaagttatcagaaattgttgaaatgttttgttttgaatgagctgcatcatcgaccgcccaaagcacagaagaagaagcacttgtttcggtctctagctgcaaccaagttcttccaaactacagaacttgattgggctgaagcgggcttgcaagtttgtaagcaggggtacaacatgctgaatctgttgatacacaggaaaaatttgaattacctccatcttgattataattttaacttgaagcctgtgaaaactcttaccacaaaggaacgtaagaagtcgcgatttggaaatgctttccatctatgccgtgagatattgcgtttgacaaagcttgtggttgatgccaatattcagttccgactgggtaatgttgatgctttccaacttgctgatggtttgcaatataccttttcccacgttggccagttgactggcatgtaccgatacaagtataggctgatgcggcagattagaatgtgcaaggacttgaagcatttgatatattaccgcttcaatactggtccagtggggaaaggacctggctgtggcttctgggcgccaatgtggagggtgtggttatttttcttgcgtgggattgtgcctcttctagaaaggtggttggggaatcttcttgcacgtcagtttgaaggacgtcattcaaaaggaacggctaagactgttacgaagcaacgtgttgagagccacttcgacttggagcttcgtgctgctgtgatgcatgatgttcttgatgccatgccaggtaatacgttctcatgttgtttttcctttgatgtttattttgtgtttctacttctcttttttgctgtgtcccaagctagaaccatattgcagcacctcagtgaggcttggcgttgttggaaagccaacattccctggaaggtgcctgggttgcctgttcctattgaaaacatgattctccgttatgtcaagtctaaagcagactggtggacaaatgtcgctcactataatcgtgagcgtatcagaagaggtgcaactgttgataagactgtttgtagaaagaatcttggaaggttgactcgcctttggcttaaggcagaacaggaacgtcaacacaattatttgaaggatggtccatatgtaaccccagaggaagcagttgccatttacaccacaacagtgcattggctggagtcgagaaagttttctcccatcccattccctcccttatcatacaagcatgacaccaagctacttatacttgctttggaaaggttgaaggaatcatatagtgtagctgtgcgattaaaccaactacagagggaagagctaggtcttattgagcaggcttatgataatccacacgaggccttgtcaaggattaagcgtcaccttcttactcagcgcgcattcaaagaagtgggcatagagttcatggatttatatagtgctttgattccagtgtatgaaattgaacctcttgaaaaaataacagacgcatatcttgaccaatatctgtggtatgaaggtgacaagcgccatctgtttccaaactggattaaacctgcagattccgagccaccaccactgcttgtatataaatggtgtcaaggtataaataatttgcagggtatatgggatacaagtgaagggcagtgtgttgtgatgcttcaaacaaagtttgagaagttcttcgaaaagattgacttgacaatgctaaataggcttcttcgtttggtgcttgaccacaatattgctgattatgtcactgcaaagaacaacgttgttttgtcatacaaagatatgagtcacacaaactcatatggcttgatacgtggtctgcagtttgcgtcttttgttgtacagtattatgggcttgtccttgatctcttacttcttggattgacccgggccagtgagattgctggtcctccaaatatgccaaatgagttcatcacatattgggatacaaaagttgaaacaaggcaccctatccggttgtattcgagatatattgacagagttcatatattgttccgtttcactcatgaagaggctcgagatctcatccagcggtatcttactgagcatcctgatcctaacaatgaaaacatggttggataccaaaacaagaaatgctggcctagagatgcaagaatgaggctcatgaaacatgatgtaaatcttgggagaagtgtgttctgggatatgaagaaccgtctccctcgaagcatcacaaccttggagtgggagaacagctttgtttctgtttacagcaaggacaatccaaacttgcttttcagcatgtgtggttttgaagttcgaatacttcctaaaataaggatgactcaggaagccttcagcaataccaaggatggggtatggaatttgcagaatgaacagactaaggaacggactgcagttgccttccttcgggttgatgatgagcacatgaaggtgtttgaaaatcgtgtgaggcagattctcatgtcttcaggatcaactactttcacaaaaattgtcaacaaatggaatacagccctgataggtttaatgacttatttccgcgaagccactgtacatactcaagagctattagatctgcttgtcaaatgtgaaaataaaatccaaactcgcatcaagatcggtttgaactcaaagatgccgagccgatttcctccagttattttctatactccaaaagaaattggaggacttggcatgctatcaatgggtcacatattgattccacaaagtgaccttcgatatagccagcagacagatgttggtgtaacccacttcaggagtggaatgagtcatgaagaggaccagctgattccaaatctttatcgctatattcagccctgggagagtgagttcatagattcacagcgtgtctgggcagagtatgctcttaagcggcaagaagcgcaggcacaaaaccggcgtttaacacttgaggatttagaagattcgtgggacaggggaattccacgtattaatactttatttcagaaggatcgtcacaccctggcatatgacaaaggatggagagtacgcacagatttcaagcaataccaagttctaaaacagaatcctttctggtggacacaccagaggcatgatgggaaactgtggaacttgaataattaccgaacagatgttattcaagctctcggtggagttgagggaattcttgagcatactttgtttaaaggaacatatttcccaacttgggaaggtctcttttgggagaaggcatctgggtttgaagagtcgatgaagtacaagaagcttaccaatgcacagagatctggtttgaaccaaattccgaaccgaagatttactctttggtggtcacccacaataaatcgggcaaatgtttatgtgggtttccaagtgcagttggatctaactggcatcttcatgcacgggaagatcccaaccttaaaaatctcattgattcaaatattccgagcacatttgtggcagaagattcatgagagtgttgtcatggatttgtgtcaagtcttagatcaggagctggatgctctggaaattgaaacagtgcagaaggaaacaatccatccgaggaagagttacaagatgaacagctcctgtgcagacattctcttgtttgctgctcatagatggcctatgtcaaagcctagtctagtggctgagtcaaaggatgtgtttgatcagaaggccagcaataaatactggatagatgtacaactacgatggggtgactacgattctcatgatattgaacgttatacccgggccaaatttatggattacacaacagataacatgtctatttatccgtctccaacaggggtgatgattggacttgatctggcttacaatttgcactctgcatttggtaattggtttcctgggtcaaaaccgctgctggctcaggcaatgaataagataatgaagtcgaacccagctttgtatgtcttgagggagcgcataaggaaaggtttgcagctgtattcttctgagcctacagaaccgtatttgtcatcccagaattatggtgaaatcttcagcaatcagatcatttggtttgttgatgataccaatgtgtatcgtgtcacaatccataagacttttgagggaaaccttacaacaaaacctattaatggtgccatatttatatttaacccaagaactggccagctatttttgaaggttatccacaccagtgtatgggcaggacagaagcgtcttggtcaacttgctaagtggaaaactgctgaagaagttgctgctcttgtgcgttctctgcctgttgaagagcaaccaaaacaaatcattgtgacacgtaaaggcatgcttgatccattggaggttcacttgcttgatttcccaaatatagttattaaaggaagtgagttgcagttgccattccaggcatgcttgaagatagaaaaatttggtgatttaattttgaaggcaacagagccacaaatggttttgttcaacatttatgatgactggctgaagagtatctcatcttacactgcattttctagactcattctgatccttcgtgcacttcatgtgaataatgagaaagcaaagatgcttctcaagcctgacaaatccataattactgagccacaccacatctggccttctcttactgatgatcaatggatgaaggttgaggttgctttgagagatctcatactttctgactatgccaagaagaacaatgtgaatacatcagccctgacacagtctgaaatccgtgatattattcttggagctgagatcactcctccttctcaacagaggcaacaaatagcagagattgagaaacaggccaaagaagcaagtcaactgacagcggtgacaacaaggaccacaaatgtgcatggtgatgaactcattgtcaccaccacaagtccctatgagcaggctgccttcggttccaaaacagattggcgtgtcagggcaatatcagctacaaatctttatcttcgagttaatcacatatatgttaactcagaggatatcaaagaaacaggatatacctatatcatgcccaagaatattttgaagaagtttatctgcttagcagatttgcgaactcaaattgccgggtacctgtatggtataagtcccccagataaccctcaggtgaaggagattcgctgtattgccatgccaccgcagtgggggactcaccagcaagttcaccttccatcagctctacccgagcatgactttctcaatgacctggagcctctaggatggatgcatactcaaccaaatgaactaccgcagttgtcaccacaggatctcactgctcatgctcggattttagagaataacaagcaatgggatggtgaaaagtgcatcattttgacttgcagtttcactcctggatcgtgctcattaactgcatataagcttacgccaagtggttatgagtggggacgtgtcaacaaggacacaggaagcaatcctcatggttacttgccaactcattatgagaaggtccaaatgctattgagtgaccgcttccttggattttacatggttcctgataatggtccatggaactacaacttcatgggagtgaagcatacagtcagcatgaagtatggaatcaaactgggcacaccccgggagtactatcacgaggaccatagaccaactcattttctggagttcagcaacttggaagagggtgagactgcggagggtgaccgcgaggatacattcacttgaaaagaattgcatttcaacttctctatctaaatatcgagttttaactctataacatgtttcaaaattagatccaggtgttgggggaaaatacacttgtgtagtaatatttgtacactacatacccagatcacttttgtaaatcagcgactgtattcttgatgagctgtaaatacgtgtttcctagaaatggaagtttatactttgcaattgaattccgagcacttggtgattctgtatgcgaatgctgttggata

SEQ ID NO: 934 - DNA, 3429 bp, Gossypium hirsutum
gcaactgtacatacacaagagcttctagatctgcttgttaaatgtgaaaataaaattcaaacacgtatcaagattggattgaattcaaaaatgcctagtcggttccctcctgtcattttttacactcctaaagaaattggaggacttggcatgttatcaatgggacacatattgattccacagagtgaccttcgatacagtcaacagactgatgttggtgtgactcactttaggagtggaatgagccatgaagaggaccagctgatccctaatctttaccggtacatacagccatgggagagtgagttcatagactcacagcgtgtttgggccgagtatgctctgaagaggcaggaagctcaagcacaaaataggcgcctaactcttgaggatttggaagattcatgggataggggaataccacgtataaatactttgtttcagaaggataggcacacattagcatatgacaaaggatggcgagtacgcacagacttcaagcagtaccaggtgctgaagcagaatccattctggtggacccaccaaaggcatgatggcaaattgtggaacttgaacaactatcgaactgatgtcatccaagctctgggaggtgttgagggaattctagagcataccttgtttaaaggaacatacttccctacctgggagggtctttttgggaaaaggcttctggattcgaggagtcaatgaagtataagaagcttactaatgctcagagatctggtcttaaccagattcctaaccgtagatttactctctggtggtcacctacaatcaatcgggctaatgtttacgtgggttttcaagtgcaactagatctcactggaatattcatgcatgggaagatcccaaccttgaaaatatctttgattcagatcttccgtgcccatttgtggcaaaaaattcatgagagtgtagttatggatctttgccaagtgctagatcaggaattggatgctttggaaattgaaactgttcagaaggagacaattcatccaaggaagagttataagatgaacagctcttgcgcagatattcttctctttgcagctcatagatggcctatgtcgaagcctagtcttgtggcagagtccaaggacatgtttgatcaaaaagcaagcaataaatattggatagatgtacaacttcggtggggagattatgattcgcatgatattgagcgttacactcgagccaaatttatggattatacaacagacaacatgtctatttatccatctcctactggggtgatgattggacttgatctggcttacaacttgcattctgcgttcggtaactggttccctggatcaaagccactgcttgctcaggcaatgaataagatcatgaagtcaaatccagctttatatgtcctaagggagcggataagaaaaggtttgcagttgtattcttctgagcctactgagccatatctttcatcccaaaattatggggagatcttcagcaaccagattatctggtttgttgacgacaccaatgtttatcgtgtgacaatccataagacatttgaagggaatctcacaacaaagcccattaatggtgccatcttcatatttaatcccaggaccgggcagttgttcctaaaggtcattcacacaagcgtgtgggcaggtcaaaagcgtcttggtcagcttgctaagtggaaaactgctgaagaagttgctgctcttgtgcggtctctgcctgttgaagaacaaccaaagcagatcattgttactcggaagggaatgcttgatcctttggaggttcacttactggatttccctaacatagttatcaagggaagtgagctgcaactaccattccaagcttgcttgaaaatagaaaaatttggtgatctgattcttaaggctacagaaccacaaatggttttgtttaacatctatgatgactggttgaagagtatctcatcatacactgcattctcccgacttattctgatccttcgtgcacttcatgtgaacaatgagaaggctaagatgttactgaaacctgacaagacaattgttactgagccacatcatatctggccttctctaactgatgatcagtggatgaaggttgaagttgctttaagagatctcatactctctgactatgccaaaaagaacaatgtgaacacatcagccttaacacagtccgagattcgtgacattattcttggagctgagattactccaccctctcaacagaggcaacaaatagcagagattgagaaacaggctaaggaagcaagtcagctgacagctgtgacaactaggactacaaatgtgcatggtgatgagctcattgtcacgaccacaagtccttacgagcaagcagcatttgggtccaagactgactggcgtgttagagcaatatcagctactaatctttatctccgtgtcaatcatatatatgtgaactcagaagacataaaggaaacggggtacacttacatcatgccaaagaacattttaaagaagttcatctgcatagcagatttgcggactcaaattgctgggtacttgtatggaataagccctcctgataatcctcaggttaaggaaattcgctgtattgcaatgccaccacagtggggtactcatcagcaagttcatcttccatctgctcttcctgaacatgatttcttgaatgatctggagcctttgggatggttgcacacacaaccaaatgagcttccccaattatcaccacaggatgtcacatcccatgctcggattttggagaacaacaaacagtgggatggagagaagtgcattatcttgacttgcagtttcactccaggttcttgctcattaacagcgtacaagcttacaccaagtggatatgagtggggacggataaacaaagatacaggaagcaatcctcatggctaccttccaactcattacgagaaggtgcagatgctcttaagtgataggttccttgggttttatatgattcctgacaatggtccatggaattacaatttcatgggagtgaagcatacagttagcatgaaatatggggtgaagctagggacacctagagaatactacaacgaggaccacaggccgactcatttccttgagttcagcaacttggaggaaggtgagactgcagaaggagatcgggaggatacattcacctaagtctgggttcatgtcaaccttgttcgttgttgtttctgtagcttacgcctgttaacactttgtgcccgaaatattagtagaggcctgacctttttgtttgaatagttgcatgtactttttataccatttgtaacaatgctgggagttgtaaatatacgagcaaaacccttctgattttgccctctaacaaatattcttttggtgttttacttattttggtgttcataaagaaagggattaagagtttgca

SEQ ID NO: 935 - DNA, 6810 bp, Cucumis sativus
agatcatggggatatgtcctcgaaaaaatatcgccatgataaacgtgtttatcttggtgccctaaagttcgttccacatgcagtttacaagctgcttgaaaacatgccaatgccctgggagcaggttcgtgatgtaaaggttctttatcatattactggagcaatcacatttgttaatgaaataccatgggtggttgaacctatatatttggctcagtggggaaccatgtggattatgatgagaagagagaagagagatcgtcggcatttcaagaggatgcgttttccaccatttgatgacgaggagcctccactagattatgccgataatttgctggatgttgatcctttggaaccaattcagttagagttggatgaagaggaggattctgcagtttacacttggttctatgaccataagcctcttgtgaaaacaaagctcattaatggtccaagttaccggaaatggcatctttcccttccaatcatggcaactcttcatcggctagctggacagttactctctgatttaatcgatcgcaactatttctacttgtttgatatggagtctttttttacagcgaaagcattaaacatgtgcataccaggtggcccgaagtttgagccattgtatcgtgacatggagaagggggatgaagactggaatgagttcaatgacatcaacaagctcataatacggtcacctcttagaacggagtatcggatagcatttcctcacctttataacaacaggcctagaaaagtgaagcttggtctatatcacactcctatggtcatgtatataaagactgaagatcctgacttaccggcattttactatgatcctttgatacatccgataaccagcaccaataaagatcgtcgtgataagagaacttatgatgatgaagatgatgatgattttgagttgccagagggggttgaaccttttttgaaggacactcaactttatacagacaccacagctgctggcatctctcttctgtttgctccacgcccttttaacatgagatctggtagaacacgtcgggctgaagatattcctctggtttcggagtggtacaaggaacactgtcctccgtcatatcctgtcaaggtcagggttagctatcagaagttgttgaaatgctttgtgttgaatgagctgcatcataggccacccaaagctcagaagaagaagcatttattccgatcacttcaagccaccaaatttttccagacaactgaacttgattgggttgaagcaggtctgcaagtttgtaagcagggatacaacatgctgaacttattgattcatagaaaaaatttgaactatcttcaccttgattataacttcaatctgaagccagtgaaaactctgaccaccaaagaacgtaagaaatcacgttttggaaatgcttttcacctctgtcgtgaaatattgcgattgacaaagctcgttgttgatgccaatgttcagttccgcttgggcaatgttgatgcatttcaattggctgatggtttacagtatatattttcacatgttgggcagctcactggaatgtacaggtacaagtacagacttatgcgtcaaattagaatgtgtaaagatttgaagcacttgatatactatcgcttcaatactggtccagtgggaaaagggcctggatgtggattttgggcaccaatgtggagagtctggttatttttccttcgtggtatagtccctcttcttgaacggtggctaggaaatttacttgctcgccaatttgaaggaagacattcaaaaggagtggcgaagactgtcactaaacagcgtgttgaaagtcattttgatttggaacttcgagcagcagttatgcatgatgttcttgatgccatgcctgagggcattaagcaaaataaagctcgaactatcctccagcacctaagtgaggcatggcgatgttggaaagcaaatattccttggaaggttcctggtttgccagttcctattgaaaatatgattcttcgctatgtcaagtcaaaagctgattggtggacaaatgttgctcattacaatcgtgaacgtataagaagaggtgctacggttgataagacagtttgtaggaagaatcttgggagacttacacgtctttggctaaaggctgaacaggagcgacagcataattatttgaaagatggtccatatgtcacacctgaagaagcagttgccatttactccacgactgtgcattggttggagtcaagaaagttctctcctattcctttccctccattgtcatacaagcatgatacaaaattactgatccttgctttagagaggttaaaggaatcatacagtgtggctgtgaggttaaatcaactccagcgagaggaattaggtctcattgaacaagcttatgataacccacatgaagcactatctcgtattaagcgtcacttgctcacacaacgtgccttcaaagaggcgagttggcatagagtttatggatctgtacagttatctcataccagtttatgagattgaacctcttgagaagattacagatgcatatcttgaccagtatctatggtacgaaggtgacaagcggcatttgtttcccaattggataaagcctgcagattcagaacctccacctcttttggtctataagtggtgtcagggtattaacaatcttcaaggtatatgggacacaagtgatgggcaatgtgttgtgatgcttcagaccaagtttgaaaagttctttgagaagatagatttaacaatgttaaataggcttcttcgtttggttctcgaccataatattgctgattatgttactgcaaagaataacgttgtcctgtcttacaaagacatgagccacacaaattcatatggtttgatacgtggtcttcaatttgcttcgtttgttgttcagtattatggacttgtgcttgatctattgcttctcggattgacccgagccagtgaaatcgctggtccaccacagatgccaaatgaattcattacttattgggacacagaggtggagacgaagcatccaattcggttatattctcgttatatagacaaagtacatatcttattccgcttttctcatgaggaagcacgagaccttatacagagatatctcactgaacaccctgatccaaacaatgaaaatatggttgggtataataacaagaagtgctggccaagagatgcaagaatgaggctcatgaaacatgatgtcaaccttggaagaagtgttttttgggatatgaagaaccggcttcctcgaagtataacaactttagaatgggaaaacagctttgtgtctgtttatagcaaggacaatcctaacctgcttttcagcatgtgtgggtttgaagtacgaatacttcccaagattagaatgactcaggaagcattcagcaacacaaaggatggagtttggaatcttcagaatgaacagacaaaagaaagaactgctgtagccttcttaagggttgatgacgaacacatgaaggtgtttgaaaatcgtgtcaggcaaattcttatgtcttcagggtccacaacatttacgaaaattgtcaacaaatggaatactgctctgattggtctcatgacttactttcgtgaggcaactgttcacacacaagaactgctagatttgctggtcaaatgcgaaaataaaattcaaactcgtattaagattgggctgaattcaaagatgcctagcaggtttcctccagttattttctatactcccaaggaaattggaggtcttggcatgctatccatgggtcacatattgatcccacaaagtgatcttcggtacagtcagcagacagatgttggtgtaacccattttaggagtggaatgagccacgaagaggatcagcttattcctaacctttatcgatatatacagccttgggaaagtgagttcatagattcacagcgggtatgggctgaatatgctctgaagaggcaagaagctcaggctcaaaataggcgattgacacttgaagatttggaagattcctgggacaggggaataccacgaatcaatactttatttcaaaaggatcgccacactttagcatatgacaaaggatggagggtccgcacagattttaaacaataccaggtcttgaaacaaaatcctttctggtggacgcaccaaagacatgatgggaaattgtggaacctgaacaactataggacagatgtcattcaagcacttggaggtgttgagggtattcttgagcacaccttattcaaaggaacatacttcccaacttgggagggtctcttctgggagaaggcatctggatttgaggagtccatgaagtacaaaaagctgaccaatgcacagaggtcaggtctgaaccagattcctaaccgtaggtttactctttggtggtcacctaccataaacagggcaaatgtttatgtgggatttcaagtgcagttggatctaactggaatcttcatgcatggaaagatcccaactttgaaaatttccctcattcagattttccgagctcatttgtggcagaagatccatgagagcgttgtcatggatctctgtcaggttctggatcaggagttagatgctttggaaattgaaactgtgcagaaagaaacaattcacccgaggaaaagttacaaaatgaacagttcttgtgctgatattctactctttgctgcccatagatggccaatgtcgaagcctagtcttgtggctgagtccaaggatgtttttgatcaaaaaccaagtaacaagtactggattgatgtgcagcttcgttggggggattatgattctcatgatattgagcgttacactcgagccaagttcatggactacactacggataatatgtctatctatccgtcacccactggtgtaatgattgggattgatcttgcatataacttacattctgcatttggaaactggtttcctggatcaaaaccactattggcccaagcaatgaacaagatcatgaagtcaaatccagccttgtatgttctgagggagcgtatacggaaaggtctgcagttatattcttctgagcctacagaaccttatttatcatcacaaaactacggagagatattcagcaatcaaataatatggtttgttgatgatactaatgtgtatcgtgtcacaattcacaagacatttgaaggaaatcttacaaccaaacccatcaatggtgccatctttattttcaacccaaggactgggcaactatttttgaaggttatccatacaagtgtgtgggctggacagaagcgtcttggtcagttggccaagtggaaaacagcagaagaagttgctgctcttgtacgatctttaccagttgaagaacagccaaaacaaattattgtgactcgtaaaggaatgcttgatccattggaggttcacttgcttgattttcccaatatagttatcaagggaagtgaactgcaactcccattccaagcatgtttgaagattgaaaaatttggtgacttgattttgaaggctactgagccccagatggttctcttcaatatctatgatgattggttgaagagtatttcatcgtatactgcattttcccgtctaattctgatcttgcgtgcccttcatgtgaataatgaaaaagctaaaatgttgctaaagccagacaaaacaattattacagaaccccaccacatctggccttctctcacagatgaccaatggatgaaggttgaggttgcgttaagagatcttattttgtcggattatgcaaagaagaacaatgtgaacacatcggctctaacacaatctgagattcgtgatatcattcttggagccgaaatcactccaccctcccaacaaagacagcagatagctgagattgagaaacaggccaaagaagcaagtcaactaacagcagtcaccacaaggactacaaatgtgcatggtgatgagctcatcgtcacaacgacgagtccatatgagcaggctgcatttggatccaaaactgattggcgtgtgagagcaatatcagccactaatctctatcttcgtgtgaatcacatttacgtaaattcagaagatataaaggaaactggatacacttacatcatgccaaagaatatcttgaagaaattcatctgcattgcagatctacgaactcagatagctggatatttgtatggaataagtcccccagataatccccaggttaaagaaatacgctgtattgtaatgccaccccagtgggggacacatcagcaagttaatcttcctacagctcttcctgagcacgactttttgaatgatttggagccattgggatggatgcacacgcagccaaatgagcttcctcagttatcaccacaggatctcacaaatcatgctaaggtcttagagaacaacaaacaatgggatggtgaaaaatgtatcattttgacctgtagttttactcccggttcctgctcactaactgcgtataagttaaccccatcgggttacgagtggggacgtgtaaacaaggacactggaagcaatccacacgggtacctcccaactcattatgagaaggtgcagatgctcctcagtgatcgcttctttggcttctacatgatccctgataatggtccctggaactacaacttcatgggggtaaagcatacagcaggcatgaagtacggagtaaaacttggaacgccacgtgagtactatcatgaagaccaccgacctacccatttcctagaattcagtaacttagaggaaggtgaaaccgctgaaggagatcgtgaggatactttcacttgaaaat

SEQ ID NO: 936 - DNA, 2334 bp, Vitis vinifera
caaaggatgtgtttgatcagaaagcaagcaataagtactggatagatgtgcagctccgctggggggattatgattctcatgatattgagcgttatactcgtgccaaatttatggattatacaacagataacatgtctatttacccatctccaaccggggtgatgattggtattgatcttgcttataacttgcattctgcatttggtaactggtttcctgggtcaaaaccactgcttgctcaggcaatgaataagatcatgaagtcaaatccagctttatatgttttgagagagcgtataaggaaagggttgcagttgtattcttcagagcctacagaaccatatttgtcatctcaaaattatggggaaatctttagcaatcaaataatatggtttgtagatgataccaatgtgtatcgtgtcacaatccataagacatttgaaggaaatctcacaactaaacctatcaatggtgccatcttcatatttaatccgaggactgggcagctgtttttaaaggtcattcacacaagtgtgtgggcaggacagaagcgtcttggccagctggcaaagtggaaaacagcagaagaagtggctgctcttgttcggtctctgcctgtggaagaacagccaaagcaaatcattgtgactcgtaaaggaatgctggatcccttggaggtccacttgctggatttccccaatatagttattaaaggaagtgaactgcaacttccgttccaggcttgcttgaagattgagaaatttggtgatctaatcttgaaggctacagagccacaaatggttttgttcaatatctatgatgattggttgaagagtatttcctcctacactgcattctcccgactcattttgattctgcgtgcacttcatgtgaacaatgagaaggcaaaaatgttactaaagccagacaaaacaattgtcacagagccacaccacatctggccttctctcactgatgaccaatggatgaaggttgaggttgctttgagagatcttatactctctgattatgccaagaagaacaatgtgaacacatcggccctgacacaatctgagattcgtgatattattcttggagctgagattactccaccttctcaacagagacaacagatagctgagattgagaaacaggcaaaagaagcaagtcagctgacagctgtcacgacaaggaccacgaatgtgcatggtgatgaactcattgtcaccaccacaagtccatatgagcaatctgcatttggatcaaagacagattggcgagtaagagcaatctcagctacaaatctctatcttcgggtcaatcatatttatgtgaattcagaggacataaaggaaacagggtatacttacattatgcctaaaaatattttgaagaaatttatctgcatagcagatttgcggacacaaatttcaggttacttgtatggtataagcccaccagacaatcctcaggttaaggaaattcgctgtattgccatgccgccacagtggggtacccatcagcaagtgcatctcccatctgctcttcctgagcacgatttcctgaatgatttggagcctttgggatggatgcatacacaaccaaatgagctgcctcaattatcaccacaggatctcacttctcatgctcggattcttgagaacaacaagcagtgggatggagagaagtgtatcattcttacctgcagttttactccaggttcttgctcattgactgcatataagctcaccccaactggatacgagtggggtcgtgtgaacaaggacactggaagcaatcctcatggttatctgccgacgcattatgagaaggtccaaatgcttttgagtgaccgattccttggtttctatatgattcctgataacggtccctggaattacaacttcatgggagtgaaacatacagtgagtatgaagtatgggatcaagctcgggacaccacgagaatactatcatgaagaccacaggccaactcatttcctggagttcagcaacttagaggagggtgagatggcggagggagatcgtgaggatacatttacctaggccatggtatcactgagattaagctgtaactctgtaagctgtctcactactttaaaatgctagtagtgtttgcagtcccacttgcgacaaagtagtggtagatctttccccagttgtaatagttcatgtagcttttgataaagattttgtaactcagtcccggtgaaggcattgtgctatttgtgtttacagtaagttgtaaatataagaacgaggttcatattattgtttttgaaatcctagtctgactcctttctatgttctggtt

SEQ ID NO: 937 - DNA, 7501 bp, Tabernaemontana elegans
tggtgggaatatgcaaccgatagctcctccgggaaccgccggaataatgccgccgggtacaagcggtgcaggtggagggggacctagtggcccgactcctcctccaccaccgccttcatatacggtcttgccgactgaggcgcagcttgaggagaaagctagaaaatggatgcaacttaattctaagcggtacagtgataagaggaagtttggctttgttgaaacacagaaagaagatatgcctcccgagcacgttaggaagattataagggaccatggggacatgtcgtccaaaaaatatcgccatgacaagcgtgtatatttgggagctttgaagtttgttcctcatgctgtttacaagctcctagaaaatatgccgatgccttgggaacaggtacgcgatgtaaaggtcttgtaccatatcactggtgctattacatttgtgaatgaaataccgtgggtggttgaaccaatctatctagcgcagtggggtacaatgtggattatgatgcgaagggagaagagagataggcgacatttcaagaggatgcggtttcctcctttcgatgatgaggagcctccgctggattatgccgataaccttttagatgtggatcctttggagccaatacagttagagttggacgaggatgaagattctgctgtttatacttggttttatgatcataagccattggtgaaaactaagcttattaatggtcctagctataggaaatggcatttgtccctccctatcatggcaacgcttcaccgtcttgctggacagcttctctctgatttgattgatcgcaactacttctacttgtttgatatggagtcgttttttacagcgaaagcacttaacatgtgcatacctggtggtcccaagttcgaacctttgtatcgagacatggagaagggggacgaagattggaatgagtttaatgacatcaacaagcttatcatcaggtcacccctcaggacagaatacaggattgcattccctcatttgtataataataggcctcgaaaagtgaagcttggagtatatcataccccaatggttatgtatataaaaactgaggatcctgatctacctgcatttttattatgatcctctcatccaccccataaccagcacgaataaggataggcgggagaagaaaaacaacgaagaggaggatgatgatgatttttgtttgcctgatggggtagaaccattgctgactgatgttcctatctatactgatactactgctgctggcatttcgcttttgtttgcaccacgtcctttcaacaggagatctggtcggatgcgtcgtgctgaagacatacctctagtttcagagtggtacaaggaacactgtcctccttcatatcctgtaaaagttcgtgttagttaccagaaactgttgaaatgttttgtgttaaatgaactgcatcataggccaccaaaggctcagaaaaagaagcatctgtttcggtctcttgcagctacaaagttcttccaaactacagagcttgattgggctgaagctggacttcaagtttgtaagcaagggtacaatatgctgaatctgttaattcaccgaaagaatctgaattatcttcatcttgattacaatttcaacttgaaacctgtgaagacactcaccaccaaggagcgtaagaagtctcgttttggcaacgcttttcatctttgccgtgaaattctccgattgacaaagctggtagttgatgcaaatatccagtttcgtctgggaaatgtggatgcatttcagttggccgatggtttgcaatatatattttcccatgttggccagttgacaggtatgtacaggtacaagtacagacttatgcggcaaattcgaatgtgtaaagatttgaagcacttgatttattaccggtttaacacgggaccagttggtaaaggacctggttgtggtttctgggctcctatgtggcgggtttggttgttcttccttcgtggcatagtgcctttacttgagcggtggttagggaatttacttgcccgacaatttgaggggcgacattctaagggggttgctaaaactgttaccaaacagcgtgttgagagccactttgatctagagcttcgtgcagcagtaatgcatgacgttcttgatgctatgccagaaggtatcaagcagaacaaagcaagaacaatcctgcagcatttgagtgaagcatggcgttgttggaaagcaaatattccctggaaggtgcctggtttacctgttccaattgagaacatgatccttcgatatgtgaagtcaaaggctgactggtggaccaatgttgcccattacaatcgtgaacgaataaggagaggtgcaactgtggacaaaacagtgtgccgaaagaaccttgggagattgacccgtctttggctgaaagcagaacaagagcgccaacataactacttgaaggatggtccttatgttacaccagaagaagccgttgcaatttacactaccactgtgcactggttggagtcaagaaagttctcacctattccattccctccattgtcatataagcatgatacaaagcttctcattctagcactcgagaggttgaaggaatcttacagtgtggctgtgcggctaaatcaattgcaaagggaagagcttggtctcattgaacaagcttatgataatccacatgaggctttgtcaaggattaagcgtcatcttctcacccaacgagcctttaaagaagttggtattgagttcatggatttgtacagttatctgattcctgtgtatgagattgaacctctagagaaaataactgatgcatatttagaccagtatctatggtatgaaggtgacaaacgccatctgttcccaaattggataaaacctgcagactctgagccacctccattgttggtgtataaatggtgtcagggtatcaataacttacaagggatatgggacaccagtgaagggcagtgtgttgtgatgcttcaaactaaatttgagaagttctttgaaaagattgatttaacgatgctgaacaggcttctgcggttggtacttgatcacaatatcgctgattatgtcacagccaagaacaatgttgtgctgtcatacaaggacatgagccataccaattcgtatgggcttatccgtggtcttcagtttgcttcctttgttgtacaatactatggactagtactagatcttttgcttcttggcttgacacgagctagtgaaattgctggtcctccacagtcacctaatgagttcattacttactgggacactaaagtagaaacaaggcaccccataagattgtattccagatacattgataaggtgcatatattgtttcgcttcactcatgaggaagcgagagacctcatccagcggtatcttactgagcatcctgatcccaacaatgagaacatggttggttataataacaagaagtgctggcccagagatgctcgtatgaggcttatgaagcatgatgtcaatcttgggagaagtgttttctgggacatgaagaaccggcttcctagaagtatcacaactctggagtgggaaaatagctttgtctctgtctacagcaaggacaatcctaacttgcttttcagcatgtgtggatttgaggttcgtatactgccgaagattagaatgactcaagaagcattcagcaatacaagagatggagtgtggaatctgcagaatgagcagaccaaagagcggactgctgttgctttcttacgagttgatgatgagcacttgaaagtgtttgagaatcgtgttaggcagattctcatgtcatcgggttctactactttcacgaagattgttaacaagtggaatacagctttaataggtcttatgacatatttccgggaagcaacagtgcatacacaagaattattggatttgctggtcaaatgtgaaaacaagattcaaacccgtattaagattggattaaattctaaaatgccaagcaggtttcctcctgtaattttttacacaccaaaggaaattggaggtctggggatgttgtcaatgggtcacatattgattccacagagtgacctgcggtatagtcagcagacagatgtgggtgtgacacacttcaggagtggaatgagtcacgaagaggaccagttgattcccaatctttatcgttacatacagccatgggaaagcgagtttattgactcccagcgagtttgggcagaatatgcattaaaaaggcaggaagcacaggcacagaataggcgtttaacactcgaagatcttgaggattcttgggatcgtgggataccccgaatcaacactttgttccagaaggatcgacacacacttgcatatgataaaggatggagggtgagaacagatttcaagcagtatcaagttctcaaacagaatccattctggtggacacaccagaggcatgatgggaagctgtggaacttgaataactacaggactgatgttatccaagctttgggtggtgtggaaggaattttggagcatacattattcaaaggaacatactttcctacatgggagggtcttttttgggagaaggcttcaggttttgaggagtccatgaagtacaagaaattgacaaatgcacaaagatctggtctcaaccaaatccctaatcgtaggtttacactttggtggtcacctactataaatcgagccaatgtctatgtcggcttccaagtgcagttggatttaactgggatatttatgcacggaaaaataccaactctcaagatatctttaatccagatattccgtgcacacttgtggcagaagatacatgagagtgttgtcatggatctttgccaggtcctagatcaggaacttgatgcattggaaattgagactgtgcagaaggaaaccattcatccaagaaagagttacaaaatgaacagctcctgcgctgacattcttctgtttgcagcccataagtggcctatgtcaaaacctagtctagttgctgagtctaaagatgtttttgatcaaaaggctagcaacaagtactggattgatgtgcagcttcggtggggtgattatgactctcatgatatagaacggtatacgagggcaaaattcatggattatacaacagacaacatgtcgatttatccatcgccaactggggtgatgattggcattgatcttgcttacaacttgcattctgcctttggaaattggttccctgggtcaaaaccattgcttgctcaggctatgaacaagattatgaagtcaaacccagcattgtatgttttgagggagcggataagaaaagggttgcagttgtattcttcagaacccacggaaccctatttgtcttctcagaactatggtgaaattttcagcaatcagattatttggtttgttgatgatacaaatgtgtatcgtgtcactatacacaagactttcgaaggaaatcttacaacaaaacccatcaatggtgctatatttattttcaatcccaggacagggcagctctttcttaaggtgattcacacaagtgtctgggccgggcaaaagcgtcttggtcagctggccaagtggaaaactgctgaagaggtcgctgctttggttcgatcattacctgttgaagaacaacctaaacaaatcattgttactcgtaaaggcatgttggatccgttggaggttcacttgcttgattttcctaacatagtcatcaaaggaagtgaactccaactgcctttccaagcatgcttgaagattgagaaatttggtgatctaatactgaaagccacagagcctcaaatggttttattcaacatttacgatgattggttgaagagtatatcatcgtacactgccttctcgaggctcattttgattttacgtgcactgcatgtgaataatgagaaggcaaaaatgttgctaaagcctgacaagtccattgtcactgaaccacaccatatttggccctctcttacagatgaccaatggatgaaggttgaggtgtctttgagagatctgattttatctgattatgcaaagaagaacaatgtcaatacatcagcactgacacagtcagaaattcgtgatatcatccttggagctgaaattacccccccttcgcagcagcggcagcaaattgcagagatagagaaacaggctaaggaagcaagtcagctgacagcagtcactacaagaacaacaaatgtacatggtgatgaactgattgtcactaccacaagtccatatgagcagtctacatatgcatctaaaactgactggcgtgtgagagcaatttctgccacaaatctttatctccgagtgaatcacatctatgtcaattcggaggatataaaggagactggttatacttacatcatgcccaagaatattttgaagaagttcatatgcattgcagacttgagaactcaaattgcaggatatttgtatggcataagccctccagataatcctcaggtcaaggagattcgatgtattgccatgccaccacagtggggaacacatcagcatgtgaatctcccatcagctcttcctgagcatgacttcctaactgatttggagcctctgggctggatgcatacacaaccaaatgaacttcctcaattgtcacctcaggatttgacaagccatgctcgaatcttagaaaacaacaagcagtgggatggagagaagtgcataattctgacttgcagctttacgccggggtcatgctctttgacagcatataagctcacactatcaggctatgaatggggacgagccaacaaggatacaggaagcaatccacatggttacttgccaacgcattatgagaaggtgcagatgctcctgagtgatcgtttccttggtttttatatgatcccagataatggtccatggaattataactttatgggagtaaaacatacagtaagcatgaggtacggggtcaagctaggaacacctagggagttctatcacgaagatcaccggccaacacatttcctcgagttcagcaacttggaagagggtgagactgcagaaggggaccgcgaggatacattctcgtaaattccaatatccaaccttccccaacagaaattggcatttggaagatctttctgtttctagattcgggtttcttttcccgactactttttgccgtaactttatgctccgataagctgtgtattagaaggctttgacgttgtaaatatgtacttgaaaaactgtggatctgattctcctgtatacgcggttagcaacagcgacatgcatatcctccaaagcaagctgaaagttcgtcggagtcttaatttttgtggtgaattcaactcttcctgatcgttgtgaatgatcctaaaattttctgttagacgaatgatttcggcattctctttaattggaagtcaagtaattaaacttataatcaccctttccttcacttacgcaagacggaagttttgggagaatttattcactttggcgatgagaagtgg

SEQ ID NO: 938 - DNA, 5921 bp, Taxus baccata
gtatcggctcatgcggcaaatcagaatgtgcaaagatctgaagcatttaatctactatcgttttaacactgggcctgttggaaagggacctggttgtgggttctgggctccaatgtggagggtgtggctatttttcctacgtggtatagtgccattgttggaaagatggcttggtaatttgcttgcccgacagtttgaaggtcgccattcaaagggagttgcaaagactgtgaccaaacaaagagttgaaagtcattttgacttggaacttagagcagctgtcatgcatgatgttcttgatgcaatgccagagggtattaaacagaacaaagcacgcactatcttgcagcacttgagtgaagcttggcgttgttggaaggcaaacatcccctggaaggtgccaggtctgccagtccctattgaaaatatgattcttcgttatgttaaatcaaaagcagactggtggactaatgttgcacactataatcgagaacgtattcgacgtggtgcaactgtggataagacagtttgccgtaaaaatctgggaaggctcacacgtttgtggcttaaagcagagcaggaacgacaacataattacttgaaagatggtccatatgtgacaccagaggaagctgtggctatctataccactacggtgcattggctggaatcgagaaagttttctcctattccttttccgcctttgtcatataagcatgatactaagcttctgatactggcacttgagcggttgaaggagtcttatagtgttgcagtgcgattaaatcagcaacagagagaagagctaggtcttattgaacaggcttatgacaatcctcatgaggctttatcccgtattaaacgtcacctgcttacccaacgctccttcaaagaagtgggaattgagtttatggacttgtatagctatctgattcctgtttatgaaattgaacctctggagaaaatcacagatgcatatcttgatcagtatctctggtatgaaggtgataaacgccatctctttccaaactggatcaaacctgcagattcagaaccacctcctctgttggtttataaatggtgtcaaggcatcaataatttacaggatatatgggataccagtgaaggccaatgtgttgtgatgctgcagacgaaatttgagaaattctttgaaaaaatagatctgacaatgttgaacaggcttctgcgattggtgcttgaccacaacattgcggattatgtcactgcaaagaacaacgtggtactatcatacaaagatatgagccacaccaattcatatggcttaatacggggcctccagtttgcttcctttgttgtgcaatattatggtctggttctagatcttctggttcttggtttgactcgggcaagtgaaatagctggttcgccacagatgccaaatgagttcatcacctactgggatacaaaagtagagacaaggcatccgataagattgtattctcgatatattgacaaggtgcacatgctctttagattcactcatgaagaggcaagagatcttatccagcgttaccttacagaacatccggatccaaacaacgaaaacatggttggttacaacaataagaagtgctggcctagagatgctcgcatgaggcttatgaaacatgatgttaatcttgggaggagtgttttctgggatataaagaacagacttcctcgcagtatcacaacattggagtgggaaaacagttttgtttctgtttacagcaaggacaatcctaatttacttttcagcatgtgtggatttgaagttcgtatattgcccaagataagaatgactcaagaagcatttagcaacttaaaggacggagtctggaatctgcaaaatgaacagactaaagagcgcaccgctgttgctttcttgcgtgttgatgatgaacacatgaaggtgtttgagaatcgtgttaggcagatcctcatgtcatcaggatcaacgactttcacgaaaattgtaaacaagtggaatactgcacttatagggcttatgacctacttccgtgaagcaacagtgcatacgcaagagcttcttgatctccttgtgaaatgtgaaaacaaaattcaaactcgtatcaaaattggtttgaactccaagatgcctagcagatttccgcctgtcatcttctatacacccaaagagattggaggactgggaatgttatctatgggacatattttgattccacagagtgacttgcgttatagccaacagacagatgttggagtgacacatttccgtagtggtatgagccacgaggaggatcaacttattcctaatctgtatcgatacatacagccctgggagagtgagttcatagattctcaacgtgtttgggcggaatatgctttaaagaggcaagaggcacaagctcagaataggcgtctaactcttgaggatctcgaggactcatgggatagaggcattcctcgcattaatactctctttcagaaagatcggcacacactggcatatgacaaaggatggagagtacggacagactttaaacagtaccaggttttgaagcagaatccattctggtggactcaccagcgccatgatgggaagctgtggaatctgaataattatcgaacagatgttattcaggcacttggaggagtggaaggcattctggagcatactctcttcaaaggaacttacttcccaacttgggaaggtctgttttgggaaaaggcatctggttttgaggagtcaatgaagtacaaaaagctgacaaatgcacaaagatccgggctgaatcaaattcccaatcgacgatttactctctggtggtctcccactataaatcgtgccaatgtttatgtgggtttccaagtgcagttagatttgacaggaattttcatgcatgggaaaattccaacgttgaaaatatcattgatacagatatttagagctcatctgtggcagaaagtacacgaaagtgttgttatggatctctgtcaggtacttgaccaggagttggatgctttggaaattgagactgtccaaaaggaaactatacatccccggaaaagttataagatgaacagctcttgtgctgatattcttctgtttgcagcatataaatggccaatgtgtaaacccagccttgttgcagagtcgaaggatgtttttgatcagaaagcaagcaataagtattggattgatgtgcaacttcgttggggtgattatgattctcatgacattgagagatatacaagagccaagttcttggactacacaacagacaacatgtcaatctatccatcacctactggtgttatgattgctattgatcttgcctacaatctacactctgcatttggtaattggtttccggggtcaaagcctcttctagcccaagctatgaataaaataatgaagtcaaatccggcactgtatgtattaagggagcggataaggaaaggtctacagctttattcttctgagccaacagaaccatatttgtcttctcaaaattatggagagattttcagcaaccaaattatatggtttgtggatgatacaaatgtgtatcgtgtcactatccataaaacttttgaaggaaaccttacaacaaagcctatcaatggggcaatttttatattcaacccaaggacggggcaactgtttttgaaggttatccatactagtgtgtgggcgggccagaagcggcttggtcagctggcaaaatggaagactgccgaagaagtagctgcattggtaaggtcactgcctgttgaagagcagccaaaacagattattgttactcgtaaaggaatgcttgatccgttggaggttcacttgctcgactttccgaacatcgtcatcaaaggcagtgagcttcagttgccatttcaagcatgcttaaaaattgaaaagtttggtgacctaattctaaaggctactgaaccacaaatggttctgttcaacatttatgatgattggttgaagactatctcttcatacacagcattttctcgcctaatattgatccttcgtgcccttcatgttaataatgagaaagcaaagatgctgttgaaaccagacaagactgttgttaccgagccgcaccacatttggccaaacctcactgatgatcaatggatgaaggtggaagtagctttgagagacctgatcctgtctgattatgcaaagaagaataatgttaatacatcagcattaactcaatcagaaattagggatattatacttggagctgaaataaccccaccttctcaacaaaggcaacagattgcagaaattgaaaagcaggcaaaggaagcaagtcaactcactgcagttacaactagaactacaaatgtgcacggtgacgagttgatcgttaccactacaagtccctatgagcaggctgcttttggttctaaaacagattggcgagtgagggctatatctgcaacaaacctctatcttagagtcaatcatatctatgtgaactcagatgatatcaaggaaactggttacacatacatcattcctaagaacatattgaagaaattcatctgcatagcagaccttagaacacagattgcaggctatctttatggtgtaagtccaccagacaatccacaggtgaaggaaattcgttgcatttctatgcctccccagtggggtacacatcagcaagttcatttgcccttggctttgccggagcatgattttctgaatgatctagaaccactaggatggatgcacacacaaccaaatgaacttcctcagttatcacctcaggatctaacatgtcatgctcgaatccttgaaaacaataagcaatgggatggagagaaatgcataattctaacatgcagtttcacacctggttcctgctccttaactgcatacaagctcacaccgacaggttatgaatggggaaggcttaacaaagacactggaagcaatccacatggttatctacctactcattatgagaaagtacaaatgcttctgagtgaccgcttccttggcttttatatggttccagacaatggtccgtggaattataatttcatgggtgttaagcatacggttagtatgaagtatggagttaagctgggagctcctcgagacttttatcatgaggatcatcgacccacacactttctggaattcagcaatctcgaggagggggagcatgcagagggagatactgaagatgtttttaattagcttcatttgtctgatagaccatggatatgtaacactgtgacccactcgcaaatttttattagtctaggtacatgcttcagttatagcaatagtctaataaatgttgcacaaatatgtctagttgtacttgtgggaagatgccatctttttgctggtcctctggaaaacatcatttttgcctagatgtctcaaacctaaatgcaccacccattctgtaatatatataactgttgactgaacactgagttgcactgctttgataccacgtcattgagcaggttagaaattctctaaataacaaagatatcacaagactgtaccttccttcaaaaataccggatttgggtgtttcattcaattttccttggtctcaaatttcactaatgtctagagggcatggtctcaagattggtttgaaatgcagtaaggcagtttgcgaaggctttttaacttcgattgtaattccgttgtgggtagttaaatctttttctgcaagaattagactgtaaagtgatgtttttggtctatgccagcataaccaccatatcggatggcaaaaatatccgcggccaattactcaatatggagtttttatatttttatatggtgcagcggatattttgtcctgatttcaaggtagtggaattggagtattgacttagtaacatgcgatagtgttctaaatgaattggcc

SEQ ID NO: 939 - DNA, 3253 bp, Gossypium hirsutum
gcaactgtacatacacaagagcttctagatctgcttgttaaatgtgaaaataaaattcaaacacgtatcaagattggattgaattcaaaaatgcctagtcggttccctcctgtcattttttacactcctaaagaaattggaggacttggcatgttatcaatgggacacatattgattccacagagtgaccttcgatacagtcaacagactgatgttggtgtgactcactttaggagtggaatgagccatgaagaggaccagctgatccctaatctttaccggtacatacagccatgggagagtgagttcatagactcacagcgtgtttgggccgagtatgctctgaagaggcaggaagctcaagcacaaaataggcgcctaactcttgaggatttggaagattcatgggataggggaataccacgtataaatactttgtttcagaaggataggcacacattagcatatgacaaaggatggcgagtacgcacagacttcaagcagtaccaggtgctgaagcagaatccattctggtggacccaccaaaggcatgatggcaaattgtggaacttgaacaactatcgaactgatgtcatccaagctctgggaggtgttgagggaattctagagcataccttgtttaaaggaacatacttccctacctgggagggtctttttgggaaaaggcttctggattcgaggagtcaatgaagtataagaagcttactaatgctcagagatctggtcttaaccagattcctaaccgtagatttactctctggtggtcacctacaatcaatcgggctaatgtttacgtgagttttcaagtgcaactagatctcactggaatattcatgcatgggaagatcccaaccttgaaaatatcgttgattcaaatcttccgtgcccatttgtggcaaaaaattcatgagagtgtagttatggatctttgccaagtgctagatcaggaattggatgctttggaaattgaaactgttcagaaggagacaattcatccaaggaagagttataagatgaacagctcttgcgcagatattcttctctttgcagctcatagatggcctatgtcaaagcctagtcttgtggcagagtccaaggacatgtttgatcaaaaagcaagcaataaatattggatagatgtacaacttcggtggggagattatgattcgcatgatattgagcgttacactcgagccaaatttatggattatacaacagacaacatgtctatttatccatctcctactggggtgatgattggacttgatctggcttacaacttgcattctgcgttcggtaactggttccctggatcaaagccactgcttgctcaggcaatgaataagatcatgaagtcaaatccagctttatatgtcctaagggagcggataagaaaaggtttgcagttgtattcttctgagcctactgagccatatctttcatcccaaaattatggggagatcttcagcaaccagattatctggtttgttgacgacaccaatgtttatcgtgtgacaatccataagacatttgaagggaatctcacaacaaagcccattaatggtgccatcttcatatttaatcccaggaccgggcagttgttcctaaaggtcattcacacaagcgtgtgggcaggtcaaaagcgtcttggtcagcttgctaagtggaaaactgctgaagaagttgctgctcttgtgcggtctctgcctgttgaagaacaaccaaagcagatcattgttactcggaagggaatgcttgatcctttggaggttcacttactggatttccctaacatagttatcaagggaagtgagctgcaactaccattccaagcttgcttgaaaatagaaaaatttggtgatctgattcttaaggctacagaaccacaaatggttttgtttaacatctatgatgactggttgaagagtatctcatcatacactgcattctcccgacttattctgatccttcgtgcacttcatgtgaacaatgagaaggctaagatgttactgaaacctgacaagacaattgttactgagccacatcatatctggccttctctaactgatgatcagtggatgaaggttgaagttgctttaagagatctcatactctctgactatgccaaaaagaacaatgtgaacacatcagccttaacacagtccgagattcgtgacattattcttggagctgagattactccaccctctcaacagaggcaacaaatagcagagattgagaaacaggctaaggaagcaagtcagctgacagctgtgacaactaggactacaaatgtgcatggtgatgagctcattgtcacgaccacaagtccttacgagcaagcagcatttgggtccaagactgactggcgtgttagagcaatatcagctactaatctttatctccgtgtcaatcatatatatgtgaactcagaagacataaaggaaacggggtacacttacatcatgccaaagaacattttaaagaagttcatctgcatagcagatttgcggactcaaattgctgggtacttgtatggaataagccctcctgataatcctcaggttaagaaattcgctgtattgcaatgccaccacagtggggtactcatcagcaagttcatcttccatcagctcttcctgaacatgatttcttgaatgatctggagcctttgggatggttgcacacacaaccaaatgagcttccccaattatcaccacaggatgtcacatcccatgctcggattttggagaacaacaaacagtgggatggagagaagtgcattatcttgacttgcagtttcactccaggttcttgctcattaacagcgtacaagcttacaccaagtggatatgagtggggacggataaacaaagatacaggaagcaatcctcatggctaccttccaactcattacgagaaggtgcagatgctcttaagtgataggttccttgggttttatatgattcctgacaatggtccatggaattacaatttcatgggagtgaagcatacagttagcatgaaatatggggtgaagctagggacacctagagaatactacaacgaggaccacaggccgactcatttccttgagttcagcaacttggaggaaggtgagactgcagaaggagatcgggaggatacattcacctaagtctgggttcatgtcaaccttgttcgttgttgtttctgtagcttacgcctgttaacactttgtgcccgaaatatt

SEQ ID NO: 940 - DNA, 7526 bp, Populus trichocarpa
ttcaaaacctattttagaaacgcacactactaaaatctcaaaaccctagaaagtaaatcgaatcatgtggaacgacaccggagagcagcatatagcgcctccggggacggctgggccgtcgatcccaccgcctccaccgtcgcagccttcttacaccgtactggcgccgtcgcaaacggtgtcgaatccagcggatgcggaggcgaagctggaggagaaggccaggaaatggcagcaacttaacacgaagaggtacagtgataagcggaagtttggtttcgtcgagacgcaaaaggaggatatgccgccggaacacgtgaggaagattataagggaccatggtgatatgtcctcgaagaaatatcgccatgataaacgtgtgtatcttggagcccttaaattcattccacatgcagtatacaagcttcttgagaatatgccaatgccctgggagcaggttcgtgatgtgaaggttctataccatattacaggagcgatcacttttgtgaatgaaattccatgggttgttgaacctatttacttagctcagtgggggacaatgtggatcatgatgcgaagagaaaagagggatcggcggcatttcaagagaatgaggtttccgccttttgatgatgaggaacctcctttagactatgctgataatttgttagatgttgatcctctagagcctattcaattagagttggacgaagaagaagattctgctgtctatacttggttttatgaccataagcctcttgttaaaacgaagcttatcaatggtcctagttacaggaagtggcatctctctcttccaataatggcgactcttcaccgtctggcaggacagcttctttctgatctaattgaccgcaactatttttacttgttcgacatggagtcattctttacagccaaagcattgaacatgtgcatacctggcgggcctaagtttgaacctttgtatcgtgacatggagaaaggtgatgaggactggaacgaattcaatgacatcaacaaactcattattcggtcacctttgcggacagagtatagaattgcatttcctcatctttacaataataggccccggaaagtaaaactttgtgtgtatcacactcccatgatcatgtacattaaagctgaggatcctgatttacctgctttctattatgatcctttgatacacccaataacctcctctaacaaggaacgccgtgaaaaaaagactcatgatgacgatgatgatgatgaggattttgttatgccagaaggggtggaaccttttttggaggatacacagctttatactgacaccacagctgctggcatttccttgttatttgctaaccgaccttttaacatgagatctggacggatgcgacgggcagaagatataccccttgtgtcggagtggtataaggagcactgtcctccatcatatcctgtcaaagttcgagttagctatcagaaattgttgaaatgttttgttttgaatgaactgcatcatagaccgccaaaagctcagaagaagaagcacttgttccggtcattagcagcaactaaattcttccaaaccacagagctagattgggctgaagcaggtctccaagtttgtaagcaggggtacaacatgctgaatctattgatacaccggaaaaatttaaattacctccaccttgattataattttaacttgaagcctgtgaagacccttacgacaaaggaacgcaagaagtcacggtttgggaatgcttttcatctttgtcgtgagatcttgcgtttgacaaagcttgtggttgatgccaatatacaattcaggttaggtaatgtggatgctttccaattggctgacggtcttcagtatacattttcccatgttggtcagttgacgggaatgtacagatacaagtataggctgatgcgccagataagaatgtgcaaagatcttaagcatttgatatattaccgcttcaatactggcccagtgggtaagggacctggttgtggattttgggcaccaatgtggagggtatggctatttttcctacgtggcatagtgcctcttcttgaacggtggttgggtaatcttcttgcaagacagtttgaagggcgccattcaaaaggaactgccaagactgttacaaagcagcgtgtcgagagccactttgacttggaactccgtgccgctgttatgcatgatgttcttgatgccatgccagagggcattaagcaaaataaggctagaacgatactgcagcaccttagtgaggcttggcgctgctggaaagcaaacattccatggaaggttcctggtttaccagttcccattgaaaacatgatacttcggtatgttaagtcaaaagcagactggtggacgaatgttgctcactataatcgtgagcgtatcagaaggggtgcgactgttgacaagacagtatgcagaaagaatcttggaagactgactcggttgtggttaaaggcagaacaggaacgtcaacacaactatttgaaggatggcccatatgtcactccagaagaagctgttgcgatttacacaactactgtccattggttggagtccagaaagttttcaccaattccattccctcccttgtcatacaagcatgacactaagctgcttatccttgctttggaaaggttgaaagagtcatacagtgtggctgtgagattaaaccaactgcagagggaagaactaggtcttattgaacaagcttatgacaacccccatgaggctttatcacggatcaagcgtcacctgctcactcagcgtgctttcaaagaagtgggcatagagttcatggatttgtacagttctctgattccggtttatgaaattgagcctcttgaaaaaataacagatgcttatttggaccaatatctgtggtatgaaggtgataagcgccacctctttccaaactggattaaacctgcagattccgagccaccaccactgcttgtctataaatggtgtcaaggcataaacaatttgcaaggtatctgggacacaagtgaggggcagtgtgtggtgatgcttcagaccaagtttgagaagttctttgaaaagatcgacttgacaatgttaaataggcttcttcggttggtccttgaccacaatattgctgattatgtgactgccaagaacaatgttgtcctttcctacaaggacatgagtcacacgaactcgtatggtttgatacgtggccttcagtttgcttcttttgtggtgcagtattatggacttgtgctggatctcctgcttcttggattgacccgggccagtgagatcgctggtccgccacaaatgccaaatgaatttatcacctactgggatacaaaggttgagacacgacatccaattcgtctttattccaggtacatagacagggtgcatatattgtttcggtttactcatgaagaggcccgagatctaatacaacgatatctcactgagcatcctgatcccaacaatgaaaatatggttgggtatcagaacaagaaatgctggcctagagatgcaaggatgaggcttatgaaacatgatgtcaatcttgggaggagtgttttctgggacatgaagaatcgtctccctcgaagcatcacaactttagagtgggagaacagctttgtttctgtttacagcaaggacaacccaaacctgcttttcagcatgtgtgggtttgaagttcggatacttcctaaaataagaatgactcaagaagcattcagcaatacaagagatggtgtttggaatttgcagaatgagcagaccaaggaacggaccgcagttgcttttctacgggttgatgatgagcacatgaaagtgtttgagaatcgtgtgaggcagattctgatgtcctcagggtcaactactttcacaaagattgttaacaaatggaatacagccttgattggattgatgacatatttccgtgaagcaactgtgcatactcaagagctgttagatttgcttgtaaaatgtgaaaataaaattcaaacccgtatcaagattgggctaaactcaaaaatgccaagcagatttcctcctgttatcttctatacaccaaaagaaattggaggacttggcatgttatccatgggtcacatattgatccctcaaagtgatcttcgatatagtcagcaaacagatgttggtgtaacccatttcaggagcggaatgagtcatgaggaggaccagctgattccaaatctttatcggtacattcagccatgggagagtgagttcattgactcgcagcgggtttgggcagagtatgcattgaagaggcaggaagcgcaggcgcaaaataggcgtctaacacttgaagatttggaagattcatgggacaggggaattccacgcattaatactctttttcagaaagatcgtcacactttagcatatgacaaagggtggagagtgcgcacagacttcaagcaataccaagttttaaaacaaaatcctttctggtggacgcaccagagacatgatggaaaattgtggaacttgaacaattatcgaactgatgtcattcaagctcttggtggtgttgaaggaattcttgagcataccttgttcaaaggaacatatttcccaacttgggaaggtctcttttgggaaaaggcatctggctttgaggagtccatgaagtataagaagcttactaatgcacagagatctggtctgaaccaaattcctaaccgtagatttacactttggtggtcccccacaataaacagggcaaatgtttatgtgggttttcaagtgcagttagatctaaccggcatcttcatgcacgggaagatcccgaccttgaagatttcgctgattcagatattccgtgctcacttgtggcagaagattcatgagagtgttgttatggacctctgtcaggtcttggatcaggaactggatgctttggaaattgagactgtgcagaaagaaacaatccatccaaggaaaagttataaaatgaacagctcctgtgcagacgttctcctttttgctgcccatagatggcccatgtcaaagcctagtcttgtggctgagtcaaaagatgtgtttgaccagaaagcaagcaataaatactggatagatgtacagctgagatggggagactatgattctcatgatattgagcgctatactagggccaaatttatggattacacaacagacaacatgtctatatatccatctccaactggggttatgattgggcttgatctagcgtacaatttgcactctgcatttggcaactggtttccggggtctaaaccactgctagctcaagctatgaacaaaataatgaagtcaaacccagctttgtatgtcttgagggagcgcataagaaaaggtttgcagttgtattcttcagagcctacagaaccatatttatcatcacagaattatggggagatctttagcaatcagataatatggtttgttgatgatactaatgtctaccgtgtcacaatccacaagacatttgaagggaatctcacaacaaaacccataaatggtgcaatcttcatattcaatccgagaactgggcagctatttttgaaggttatccacactagtgtatgggcaggacagaaacgtctgggccagcttgccaagtggaaaactgctgaagaagttgcagctcttgtgcggtctctgcctgtggaagaacaaccaaaacaaattattgtgactcgcaaagggatgcttgatccattggaggttcacttgcttgatttccccaacatagttatcaagggaagtgagttgcagctcccattccagtcatgcttaaagatagagaaatttggtgatttgattttgaaggcaacggaaccacaaatggttttgttcaatatttatgatgattggctgaagagtatatcatcttacactgcgttctctcggctcattctgattctccgtgcacttcatgttaataatgagaaggcaaagatgctactcaagcctgacaagactatcgttactgagccacaccacatctggccttcacttactgatgatcagtggatgaaagttgaggttgctttaagggatctcatactctctgactatgccaagaagaacaatgtgaacacctcagcactgacacaatctgagatacgtgatattattcttggagctgagatcactcctccttctcaacaaaggcagcagatagcagagattgagaaacaggccaaagaagcgagtcaactgacagcggtcaccacaaggaccacaaatgtgcatggtgatgaactcattgtcacaaccactagtccatatgagcaagctgcgtttggttctaaaacagattggcgtgtcagagctatatctgctacaaatctctatcttcgagtcaatcatatctatgtgaattctgaggatatcaaggaaactggatacacatatatcatgccgaagaatatcttgaagaagtttatctgtatagctgatctgcgaactcaaatttctgggtatttgtatggtataagccccccggacaatcctcaggtcaaggaaatccgttgtattgctatgcccccacagtgggggactcatcaacaggttcatcttccatcagctcttcctgagcatgatttcctcaatgatctggagcctttgggatggatgcacacacaaccaaatgagcttcctcagttatcaccacaggatctcacggctcatgctcgggttttggagaacaacaagcaatgggatggagaaaagtgcatcatcctgacatgtagtttcactccaggatcatgctcgttaactgcatataagcttactcctagtggttatgagtggggacgtgtcaacaaggacacgggaagcaatcctcatggctacctgccaactcattacgagaaggttcagatgctcctgagcgaccgcttccttggtttctacatgattcctgataatgggccatggaattacaattttatgggagtgaagcatacagtgagcatgaaatatggaatcaagctggggacacctcgagagtattaccatgaggaccataggccaacacatttcctggagttcagcaacctggaggagggcgagaccgctgaaggcgatagagaggatacattcacttgaagtataataatactatttccgtcgtcgttggatgatggtgccttttgaagtagtttgccaacggcatggctgaggataaaatcatgtcaaacctttgttgtttttttgttgtatcagtattgtattttcctgatgaggttaccttacccagatctctgttaagtctgcgacagcgctctttataagctgtaaatatttgctagaagttggaattggtgaatgagctttggctctattttctgcattttgtgctgcccaaatcggttgaccggtgccggattatgaagtggtttgctctgaagccatattaatttatggttttttagtattctgcaaatctatttgcctgctcgatgccaagtgcctcctttaggaaaaaaatattcta

SEQ ID NO: 941 - DNA, 4399 bp, Abies balsamea
aggtacaatagtgtagttgatgcttcaagtacaaaaatttagtaaaagttaactttgtaaaaaattaagtaatctgtacaatgttaaacaggcttctgcgtttggtgcttgaccacaacattgctgattatgtcactgcaaaaaacaatattgttttatcatacaaagatatgagccacacaaattcatatggcctgattcgaggtcttcagtttgcctcatttgttgtgcaatattatggtctggtcttggatctcttggttcttggtttgactcgggcaagtgaaatcgctggtcctccacagatgccaaatgagtttattacttactgggatacaaaagtggagacgaggcatcctataaggttgtattctcgttatattgacaaggtgcacattctttttagattcactcatgaagaggcaagggatcttatccagcgctaccttacagaacatccagatccaaacaatgaaaacatggttggttacaacaacaaaaagtgctggcctagagatgctcgcatgaggctaatgaaacatgatgttaatcttgggaggagtgttttttgggatataaagaacagactccctcgtagtatcacaacgttagaatgggagaacagttttgtctctgtttatagcaaagacaacccaaatttgcttttcagcatgtgtggatttgaagttagaatattacccaagataagaatgtctcaagaagcatttagcaatacgaaggatggagtctggaatctgcaaaatgagcagactaaagagcgcactgctgttgctttcttgcgtgttgatgatgaacacatgaaggtgtttgagaatcgtgttaggcagatcctcatgtcatcagggtcaacaaccttcaccaaaattgtaaacaagtggaatactgcactaatagggctcatgacctatttccgtgaagcaacagtgcatacacaggagcttcttgatctccttgtcaaatgtgaaaataaaattcaaacacgtatcaagattggtttgaactccaagatgcctagcaggtttcctcctgttatcttctacacacccaaggaaattggaggacttggaatgctatctatgggacatattttaattccacaaagtgacctacgttatagtcaacagacagatgttggagttacacacttccgtagtggtatgagccacgaggaagatcaacttattccaaatctctatcgatacatacagccctgggagagtgaatttatagactctcaacgtgtttgggccgaatatgctttaaagaggcaggaagctcaggcccagaatagacgtttaacactagaggatcttgaggattcatgggacagaggcattcctcgcattaatactctctttcaaaaagatagacacacactggcttatgacaaaggttggagggtacgaacagacttcaaacagtatcaggttttgaaacaaaatccattttggtggactcatcaacggcatgatgggaagctgtggaatctgaataattatcgaacagatgttattcaggctcttggaggagtggaaggcattctggagcatactctatttaaaggaacttacttcccaacatgggaaggtctgttttgggagaaagcttctgggtttgaggaatcaatgaagtacaaaaaacttacaaatgcacagagatcagggctgaatcaaattcccaatcggcgatttacactttggtggtctcctaccatcaaccgtgccaacgtttatgtgggttttcaagtgcagttggatttgacaggaatttttatgcatggaaaaattccaacactgaagatatcattgatacaaatatttagggctcatttgtggcagaaagtacacgaaagtgttgtaatggatctctgccaggtacttgatcaggagttggatgctttggaaattgagactgttcaaaaggagactatacatcccaggaaaagttacaagatgaacagctcttgtgctgatattcttctttttgcggcatataaatggccaatgtgcaagcccagccttgtcgcagagtctaaggatgtttttgatcagaaggccagtaataaatattgggtcgatgtgcaacttcggtggggagactatgattctcatgacattgaacggtatacgagagccaaattcttggactatacaacagataacatgtcaatttacccatcacccactggtgttatgattgcaattgatcttgcttacaatttacattcagcatttggtaattggtttcctggttcaaagcctcttttggctcaagctatgaataaaataatgaagtcaaatcctgccttatatgtgttaagggagcgcataagaaagggcctgcaactttattcttctgagccaacagaaccatatttgtcgtctcaaaattatggagagattttcagcaatcaaatcatatggtttgtggatgatacaaatgtgtatcgtgtcacaatccataaaacttttgaaggaaatcttacaacaaaacctattaatggtgcaatttttatattcaacccaaggacagggcaactatttttgaaggttatccatactagtgtgtgggcaggacagaagcgtcttggtcaactggctaaatggaagacagctgaagaggtagctgcattggtacgttcactacccgtcgaggagcagccaaaacagataattgtaactcgaaaggggatgcttgatcccctggaagttcacttgcttgactttccaaacattgtcattaaaggaagtgagcttcagttaccattccaagcatgcttaaaaattgagaagtttggtgacctgattctaaaggctacagaaccacagatggttcttttcaacatatacgatgattggttaaagactatctcatcatacacagcgttttctcgtcttatactgatccttcgtgcccttcacgtgaacaatgagaaagcaaagatgttgttgaaaccagacaagactattgttactgagccacaccacatctggccaagccttaatgatgatcaatggatgaaggtggaagttgctttgagagaccttatcctctctgactatgccaagaaaaataatgttaatacatcagcgttaacacaatcagaaatccgtgatattatacttggagctgagataactcccccttctcaacaaaggcaacagattgcagaaattgaaaagcaggcaaaggaagcaagccagctcactgcagttaccacaaggactacaaatgtgcacggtgatgagttgattgtcacaactaccagtccgtatgagcaggctgcttttggttctaaaacagattggcgtgtgagggcaatatctgcaacaaatctgtatctccgagtcaatcatatctatgttaactctgatgatatcaaggagactggttatacatacattatgccaaagaacatattgaaaaaattcatttgcatagcagaccttaggactcagatttctgggtatatttacggtataagccctccagacaatccacaggtgaaggaaattcgatgtatagctatgcctccacaatggggaacacatcagcaagttcatttgcctttagctttgccggagcatgagtttttgaatgatttagagcctttgggatggatgcatacacaacccaatgagcttcctcagttatcacctcaggacttaacatgccatgctcgaatcttggagaataataagcagtgggatggagagaagtgtatcattcttacatgcagtttcactcccggctcctgctccttaactgcatataagcttactccaacaggttatgagtggggacggctcaacaaagacactggaagcaatccacatggttatctgcctactcattatgagaaagtacaaatgcttctcagtgaccgtttcctgggattttacatggtaccagataatggtccttggaattacaattttatgggtgttaagcatacagtcagtatgaagtatggaattaagcttggagctcctcgtgacttttatcatgaggatcatcgtcccactcactttctggagttcagcaatcttgaggaaggtgatcatgcagagggagatgctgaagatgtatttacttagcttcagttatctggcaagttttgggtgtttaaattttcaatcaccgagaaatatgagaaatgctggtaagctagctagcataacttgtgagtaaatgctttagttttagcaactgtctaattgctataaatatcttctccaatatttggaaaaagcaatctttcgctgtttctggagagcctgaaaaacccttactggactgcatttgtacaaaatatgaaactggtgactagaagttgcagtcatatatgcttggcattacttgtttttatctctcatta

SEQ ID NO: 942 - DNA, 4190 bp, Cephalotaxus harringtonia
caccacagatgccaaatgagttcatcacctactgggatacaaaagtagagacaaggcatccaataagattgtattctcgatatattgacaaggtgcacatgctttttagattcactcatgaagaggcaagggatcttatccagcgctaccttacagaacatccagatccaaacaatgaaaacatggttggttacaataataagaagtgctggcctagagatgctcgcatgaggctgatgaaacatgatgttaatcttggaaggagtgttttctgggatataaagaacagacttcctcgtagtatcacaacattagagtgggaaaacagttttgtttctgtttacagcaaggacaatcctaatttgcttttcagcatgtgtggatttgaagttcgtatattgcccaagataagaatgactcaagaagcatttagcaacacaaaggatggagtctggaatctgcaaaatgaacaaactaaagagcgcactgctgttgctttcttgcgtgttgatgatgaacacatgaaggtgtttgagaatcgtgttaggcagatcctcatgtcatcaggatcaacgactttcacaaaaattgtaaacaagtggaatactgcacttatagggcttatgacctacttccgtgaggcaacagtgcatacccaagagcttcttgatctccttgtgaaatgtgaaaataaaattcaaactcgcatcaaaattggtttgaactctaagatgcctagcaggtttccacctgtcatcttctatacacccaaggagattggaggactgggaatgttatctatgggacatattttgattccacagagtgatttgcgttatagccaacagacagatgtggtgtaacacatttccgtagtggtatgagccatgaggaagatcaacttatccctaatctatatcgatacatacagccctgggagagtgagttcatagattctcaacgtgtttgggctgaatatgctttaaaaaggcaagaggcacaggctcagaataggcgtttaactcttgaggatcttgaggactcatgggatagaggcattcctcgcattaatactctctttcagaaagatcggcacacgctggcatatgacaaaggatggagggtgcgaacagactttaaacagtaccaagttttgaagcaaaatccattttggtggactcaccagcgccatgatgggaagctgtggaatctgaataattatcgaacagatgttattcaggcacttggaggagtggaaggcattctggagcatactctcttcaaaggaacttacttccaacttgggaaggtttgttttgggaaaaagcatctggttttgaggagtcaatgaagtacaaaaagctgacaaatgcacaaagatcagggcttaatcaaattcccaatcgacgatttactctctggtggtcacctactataaatcgtgccaatgtttatgttggtttccaagtgcagttggatttgacgggaattttcatgcatgggaaaatccctacgctgaaaatatcattgatacagatatttagagctcatctgtggcagaaagtacatgaaagtgttgttatggatctctgccaggtacttgaccaggagttggatgctttggaaattgagactgtccaaaaggaaactatacatccccggaaaagttataagatgaacagctcttgtgctgatattcttctctttgcggcatataaatggccaatgtgtaaacccagccttgttgcagagtcgaaggatgtttttgatcagaaggcaagcaataagtattggattgacgtgcaacttcgttggggtgattatgattctcatgacattgagagatatacaagagccaagttcttggactacacaacggacaacatgtcaatctatccgtcacctactggtgttatgattgctattgatcttgcctacaatctgcattctgcgtttggtaattggtttccgggttcaaagcctcttctggcccaagctatgaataaaataatgaagtcaaatcctgcactgtatgtattaagggagcggataagaaaaggtctacagctttattcttctgagccaacagaaccatatttgtcatctcaaaattatggagagattttcagcaaccaaattatatggtttgtagatgatacaaatgtgtatcgtgtcaccatccataaaacttttgaagggaatctcacaacaaagcccatcaatggagcaatttttatattcaacccaaggacagggcaactgtttttgaaggttatccatactagtgtgtgggcggggcagaagcggcttggccagctggcaaaatggaaaacagctgaagaagtagctgcattggtaaggtcactgcctgttgaggagcagccaaaacagattattgttactcgtaaaggaatgcttgatcccttggaggttcacttacttgactttcctaacatcgtcatcaaaggcagtgagcttcagttgccattccaagcatgcttaaaaattgaaaagtttggtgacctgattctgaaggctactgagccacaaatggttcttttcaatatttatgatgattggttaaagaccatctcatcatacacagcattttctcgcctcatattgatccttcgtgcccttcacgttaataatgagaaagcaaagatgttgttgaaaccagacaagacagttgttaccgagccacaccacatttggccaaacctcactgatgatcaatggatgaaggtggaagtagctttgagagacctgatcctgtctgattatgcaaaaaagaataatgttaatacgtcagcattaactcaatcagaaattagggatattatacttggagctgaaataaccccgccttctcaacaaaggcaacagattgcagaaattgaaaagcaggcaaaggaagcaagtcaactcactgcagttacaactagaactacaaatgtgcatggtgacgagttgattgttaccactacaagtccctacgagcaggctgcttttggctctaaaacagattggcgagtgagggctatatcagcaacaaacctctatcttagagtcaatcatatctatgtgaactcagatgatatcaaggaaactggttatacatacatcattcccaagaacattttgaagaaattcatttgcatagcagaccttagaacccagatttcaggctatctttatggtgtaagccccccagacaatccacaggtgaaggaaattcgttgcatatctatgcctccacagtggggtacacatcagcaagttcatttgcccttggcgttgcctgagcatgattttctgaacgacctagaaccactgggatggatgcacacacaaccgaatgaacttcctcagttatcacctcaggacctaacatgtcatgctcgaatcctagaaaacaataagcaatgggatggagagaaatgcataattctcacatgcagtttcactcctggctcctgctccttaactgcatataagctcacaccgacagggtatgaatggggacggcttaacaaagacacgggaagcaatccacacggttatctacccactcattatgagaaagtacaaatgcttctgagtgaccgcttccttggcttttatatggttccagacaatggtccttggaattataacttcatgggtgtcaagcatacggttagtatgaagtatggagttaagctgggaactcctcgagacttttatcacgaggatcatcgacccacacactttctggagttcagcaatcttgaggagggggaccatgcagagggagatactgaagatgtgttcaattagcatcatctgtctgacagactatggatatgcaacactgtgacccactcacaaatttgagtagtcttggcacatacttcagttgtaccaacattctaattaatgttgcactagtatgtttaattgcaggaagaggccaccttttagctggtcctctggcaaacatcatttttatctagatggcttgaccttaatgcaattttccattctgtaatatatatacaactgttgactgaaagttgagtcgcatttctttgataacagagtcaaagtcattgagcaggttggaaattctctaaatgaacacagaaagatgtgacgaaaatgtactttggttctcacaaatactggactcggatgtttaatttaatttt

SEQ ID NO: 943 - DNA, 3379 bp, Gossypium hirsutum
agattggactgaattacaaaaatgcctagtcgattccctcctgttaatttttacactcctaaagagattggaggacttggcatgttatccatgggtcacatattgattccgcagagtgatctccggtacagtcagcagactgatgttggcgtaactcactttaggagtggaatgagtcatgaagaggaccaactgattcctaatctttatcggtacatacagccatgggagagtgagttcatagactcacagcgtgtttgggctgagtatgctctgaagaggcaggaagcacaggcacaaaataggcgcttaacccttgaggatttggaagattcatgggataggggaataccacgtataaataccttgtttcagaaggacaggcacacattagcatatgacaaaggatggagagtacgtacagactttaagcagtaccaagttttgaagcagaacccattctggtggactcaccaaaggcatgatggcaaattgtggaacttgaacaactatcgaactgatgttatccaagctcttggaggtgttgagggaattctagaacataccttgtttaaaggaacatactttccaacttgggagggtctgttttgggaaaaggcttctggattcgaggagtcaatgaagtataagaagctcactaatgctcagagatctggtcttaaccagattcctaaccgtaggtttactctttggtggtcacctacaatcaatcgggctaatgtttacgtgggttttcaagtgcaactagatctaactggaattttcatgcatgggaagattccaaccttgaaaatatctttgattcagattttccgtgcccatctgtggcaaaaaattcatgagagtgtggttatggatctttgccaagtcttagatcaggagttggatgctttagaaattgaaactgttcagaaggagacaatccatccaaggaagagttacaagatgaacagctcttgtgcggatattcttctctttgcagctcataggtggcctatgtcaaagcctagtcttgtggcagagtccaaggacatgtttgatcaaaaagcaagcaataaatattggatagatgtacagctccggtggggtgattatgactcgcatgatattgagcgttacactcgagccaaatttatggactatacaacagataacatgtctatttatccatctcccactggggtaatgattggccttgatctggcttacaacttgcattctgcatttggtaattggttccctggttcaaagccactgctcgctcaggcaatgaataagatcatgaagtcaaatccagctttatatgtcttaagggagaggataaggaaaggtttgcagttatattcttctgagcctactgagccgtatctgtcatcccagaactatggggagatcttcagcaaccagatcatttggtttgttgatgacaccaatgtgtatcgtgtgacaatacataagacatttgaagggaatctcacgacaaaacccattaatggtgccatctttattttcaatccacggactggacagttgttcctaaaggtaattcacactagtgtctgggcaggtcaaaagcgtcttggtcagcttgccaaatggaaaactgctgaagaagttgctgctcttgtgcggtctttgcctgttgaagaacaaccaaagcagatcattgttacacgaaagggaatgcttgatcctttggaggttcacttactggatttccctaacatagttatcaagggaagtgagctgcaactcccattccaggcttgcttgaaaattgagaaatttggtgatctaattctgaaagctacagagccacaaatggttttgttcaacatctatgatgactggttgaagagtatctcatcatacactgcgttctcccgactcattctgatccttcgtgcgcttcacgtgaacaatgagaaggctaagatgttactgaaacctgataagacaatcgttactgagccacaccatatttggccttctctaactgatgatcaatggatgaaggtcgaagttgctttaagagatctgatactttccgactatgccaaaaagaacaatgtgaacacatcagccctgacacagtctgagattcgtgacatcatccttggagctgagattactccaccctctcaacagaggcagcagatagcagagattgagaaacaggcgaaggaggcaagccagctaacagctgtgacaactaggactacaaacgtgcatggagatgagctcattgtcaccaccacaagtccctatgaacaagcagcatttgggtccaagacggattggcgtgttagagcaatatcagctactaatctttatcttcgagtgaatcatatatatgtgaactcagaggacataaaggaaactgggtacacatatatcatgccaaagaacattttaaagaagttcatctgtatagcagatctcaggactcaaattgctggatacttgtatggaataagccctcctgataatccccaggttaaggaaatccgatgcattgccatgccaccgcaatggggtactcatcagcaagtcaatcttccatcagctcttcctgaacatgatttcttgaatgatctggagcctttgggatggctgcacacacagccaaatgagcttcctcaattatcgccacaggatgtgacatcccattctcggatattagagaacaacaaacagtgggatggagagaagtgcataatcttgacatgcagtttcactcccggttcttgctcattaacagcctacaagcttaccccaagtggttatgagtggggacgggttaacaaagatacaggaagcaaccctcatggttacctcccaacgcattatgagaaggtgcagatgctcctaagtgatcggttccttggattttatatgatacctgacaatggtccgtggaattacaatttcatgggagtgaagcatacagtgagcatgaaatacggggtgaagctggggacaccgaaagagtactacaatgaggagcataggccgacacatttcctggagttcagcaacttggaagaaggtgaaactgtggaaggagatcgggaggatacttttacttaaatccctaaatctgtttttaccaaagactccaaattctactatgtatggaatgaagggaaaaaaatacttgcattgcatagttgcatgtactaaatcccaatcgtaagaatgttttttggagttgtaaatacgagtaagaactaggatttgaatacgatcacctcaaatgttgggttaaacacaatatgtgcccaagaagctctgctcaggttaggtttcaatagtaacagacttatttgctttaaattcaactcaattttattttatt

SEQ ID NO: 944 - DNA, 2929 bp, Distylium racemosum
gtacagatgttattcaggcacttggaggagtggaaggcattctagagcataccctcttcaaaggaacatacttcccaacttgggaaggtttgttttgggaaaaagcatctggttttgaggaatcaatgaaatacaaaaaactgacaaatgcacaaagatcagggttgaatcaaattcctaatcgacggtttactctctggtggtctcctaccattaatcgtgccaatgtttatgtgggtttccaagtgcagttggatttgacgggtattttcatgcatggaaagatcccaactctgaagatatcattgatacagatattcagagcccatttatggcagaaagtgcatgaaagtgttgttatggatctctgtcaagtacttgatcaggagttggatgctttggaaattgaaactgtccaaaaggaaactatacatcctcgtaaaagttataagatgaacagctcctgtgctgatgttcttcttttcgcgtcatataaatggccaatgtgcaagcccagccttgtggcagagtcgaaggatgtttttgatcagaaggcaagcaataagtattggattgatgtgcaacttcgttggggagattatgattctcatgatattgagagatacacaagagccaagttcttggactacacaacagacaacatgtcaatctatccatcacctacaggtgttatgattgcaattgatctggcttacaatttgcattctgcatttggaaactggtttccgggttcaaagcctcttttggcccaagctatgaataaaataatgaagtcgaatcctgcactgtatgtattaagggagcgcataagaaaaggtctacagctttattcttcggagccaacagaaccatatttgtcctcccaaaattatggagagattttcagcaaccaaattatatggtttgtggacgatacaaatgtgtatcgtgtcaccatccataaaacatttgaaggaaatcttacaacaaagcctataaacggggcaatttttatattcaatccaagaacaggacaattatttttgaaggttatacatactagtgtgtgggcaggacagaagcggcttggtcagctggcaaaatggaagacagctgaagaagtagctgcattggtaaggtcactgccggttgaggagcagccaaaacagattattgttactcgcaaaggaatgcttgatccattggaagttcacttgcttgactttcctaacatagtcatcaaaggcagtgaacttcagttgccattccaagcatgtttaaaaattgagaagtttggtgacctaattctaaaggctactgagccacagatggttcttttcaacatatatgatgattggctgaagactatatcttcatacactgcattttctcgtctaatattgatcctccgtgcacttcatgtaaataatgagaaagcaaagatgctgttgaaaccagataagactgttgtgactgagccacaccacatttggccaagcctctctgatgatcagtggatgaaggtggaagttgcattgagagaccttatcctttctgactatgcaaagaagaacaatgttaatacgtcagcactaactcagtcagaaattcgagatattatacttggagctgaaataaccccaccttctcaacaaaggcaacaaattgcagaaattgaaaaacaggcaaaagaagcaagtcaactcactgccgttacaactaggacaacaaatgtgcatggtgacgagttgattgtcaccactacgagtccctatgagcaggctgcttttggttctaaaacagattggcgtgtgagggctatatctgcaacaaacctttatcttcgagtgaatcacatctatgtcaactcagatgatatcaaggaaactggttatacatacatcatgcccaagaacatactgaagaaatttatctgtatagcagatcttagaactcagatttcaggctatctttatggtgtaagccccccagacaatccgcaggtgaaggaaattcgttgcatagctatgcctccacaatggggaacacatcagcaagttcatttgcctttggctttgcctgagcatgattttctgaatgacttagaacctctaggatggatgcatacacaacccaatgaacttcctcagttatcacctcaggacctgacatgtcatgctcgaatcctagagaacaataagcaatgggatggcgagaaatgtatcattctaacatgcagtttcactcctggatcatgctccctaactgcctataagctcacaccaacaggttatgaatggggacggctcaacaaagacactggaagcaatccacacggttatcttcctactcattatgagaaagtacaaatgcttctgagcgaccgtttcttaggcttctatatggttcctgacaatggtccttggaattacaatttcatgggagtcaagcacacagttagtatgaagtatggagttaagcttggaactcctcgagacttctatcatgaggatcatcgaccgacacattttctggagtttagcaatcttgaggagggggatcatgctgaaggagataatgaagatgtgttcacttaaaacttcatttgtctagcagatgaccgaagtgttgtaacattgtgacccattaacaaggttgagtaggcttgatagctctgttgtatgcttcaattattgcaacacaataattgatgttgtataaatgtactcttaattgctaggaaaagccatctccttcctttagttggagttttagtactttgtaatctcctgtaagttgctgtatcatttacatgttttggtcactggcggtcataaatgttttacagcttttcctctttaagacaggtttgaaattctcaaaatgaataatgtcacagcaatattgtattgattaaagctttatggaa

SEQ ID NO: 945 - DNA, 7502 bp, Eucalyptus grandis
agagcctacagagtcctcgagccatctcgagccgccattcctccctcgagctcggctcgcgtccgcggctccgtctggaagagaatcgcgcgcgcgcgctcgaggtgccgccgggaggggcttttctagggttttggagccatgtggaacggcgccggcaacggccagattgcgccgccggggaccagcgggccctccgcgatcccgccgccgcccgcgccccagccctcgtacaccgtcctgccctcgcccgccgaggccgaggccaggctcgaggagaaggcgcggaaatggatgcagctcaactcgaagcggtacggggacaagaggaagttcgggttcgtggagacgcagaaggaggacatgcctcccgagcacgtcaggaagattattcgggaccatggggacatgtcctctaaaaaatatcgccatgataaacgtgtatatctcggagctttgaagtttgttcctcatgcggtttataagctcctagagaacatgcccatgccttgggagcaggttcgcgacgtgaaggttttataccatatcaccggggcaataacatttgtcaatgaaataccttgggttgttgagcccatctatttagctcagtggggtacgatgtggatcatgatgcgaagggaaaaaagggatagaaggcatttcaagagaatgcggtttccaccttttgatgatgaggaacctcctttggattatgctgataatctattggatgtcgatcctctggaaccgattcagttagagttagacgacgaagaagattcggctgtatgtacttggttttatgaccataagcctcttgtgaaaacaaagcttataaatggtccgagttatcggaagtggcatctttctctgccaattatggccaccctccatcggctagcagggcagcttctttctgatttgatcgaccgcaactacttttatctgtttgatatggaatcctttttcactgctaaagcactgaacatgtgcataccaggaggtcctaagtttgagccgttgtaccgggatatggaaaagggagatgaggattggaatgagttcaatgacattaacaaactcattattcgatctcctcttaggacagaatacaggattgcatttccacatctttacaacaataggcctcggaaagtaaagctttgtatataccatactcccatggtcatgtatataaagacggaggatcccgatttaccagccttttattatgatcctttgattcatcctattaccagcattaacaaggagcggcgtgagaaaaaggcatatgatgatgaggatgaggatgatttctccttgccagaaggcgttgaacctttgctgagtgatacccagctttataccgacaccacagctgcaggaatctcattgttatttgccccacgtcctttcaacacaagatcagggcgcatgcggcgggctgaagatataccccttgtgtcagagtggtacaaggagcactgtcctccaacatatcctgtgaaagttcgagtcagctatcaaaaattgttgaaatgtttcgtcttgaatgagctacatcatcgacctcctaaggctcaaaagaagaagcatttgttccggtctcttcaggcaaccaagtttttccagactactgagctggattgggcggaggcgggcctgcaagtttgtaaacagggctacaatatgttgaatctattgatacacaggaagaatttgaactatcttcaccttgactacaatttcaatcttaagccagtgaagactctcacgacaaaagaaaggaagaaatcacgatttggtaatgcatttcatctctgtcgtgagattctgcgtcttaccaagcttgtggttgatgccaatgtccagttcagactagggaatgtggacgcattccaattggctgatggtttacagtatacattttcgcacgttggacagttgactggcatgtaccgatataagtaccgactgatgaggcagattaggatgtgtaaagacctgaagcacttaatttactatcgcttcaatacggggcccgtggggaagggacctggttgtggtttctgggcgccaatgtggagggtgtggctgttctttctgcgtggtatagtacctttgcttgaaaggtggttagggaacttattggcgcgtcaatttgaaggacgccattcaaaaggggttgctaagaccgtaacgaagcaacgggtggaaagtcattttgatctggagcttcgagctgctgttatgcatgatgttcttgatgccatgccagagggcattaagcagaataaagcaaggaccatcttgcagcatcttagtgaagcatggcgctgttggaaagccaatattccttggaaggttcccggtcttccagttcccattgagaacatgattcttcgttatgttaaatcgaaagctgattggtggacaaatgttgcgcattataatcgtgaacgtataagaagaggtgcgacagttgataagactgtgtgtcggaaaaatcttggaagattgactcgcctctggttgaaggctgagcaggaacgacagcataattatctgaaagatgggccatacgtcacaccagaagaagctgtggcaatttataccacgactgtgcactggttggaatcaagaaagttctctcccattcctttccctccgttgtcatacaaacatgatacgaagctgcttattttggctctagagagattaaaggaatcttacagtgttgccgtgagattgaatcagttgcaaagggaggagttgggtctcattgaacaagcatatgataatcctcatgaagctttgtcacgaataaagcgtcacttgcttacacagcgtgcctttaaagaggtgggcatagagtttatggacctgtatagctatttgattcctgtatatgagattgagcctcttgagaagatcactgatgcttatcttgaccagtatctgtggtatgaaggtgataaacgtcatctgtttcctaactggattaagcctgcagattcagaaccacctccgctcttagtttataagtggtgtcagggtataaataacttacagagcgtatgggatacaagcgaggggcagtgtgtagtcatgcttcaaaccaagttcgagaagttctttgaaaagatcgacttgaccatgttaaataggcttcttcgcttagttcttgatcacaacattgctgattatgtaactgcgaaaaacaacgttgtcctttcttacaaggatatgagccatacaaactcttatggtcttattaggggacttcagtttgcttcttttgttgtccagtattatggactcgtgttggatctactgcttctgggattgactcgagccagtgagattgctggtccaccacagatgccaaatgagttcattacgtattgggacacaaaagttgagaccagacatcccattcggttgtattctcgttacatagacaaagttcatatcctgtttagattcactcacgaggaggcccgtgaccttatccagcggtaccttactgaacatcctgaccccaataatgaaaacatggtcggatacaataacaagaaatgctggcccagagatgcaaggatgaggcttatgaaacatgatgttaatcttgggagaagtgttttctgggacatgaagaatcgtcttcctagaagtattacaaccttagagtgggagaacagttttgtttctgtttatagcaaggacaatccaaacttgctattcagcatgtgtgggttcgaagtccgcatactaccgaagataagaatgacgcaggaagcgtttagcaataccagggatggtgtttggaatttgcaaaatgagcagaccaaagaacggacagcagttgcatttttgcgggttgacgatgaacacatgaaagtttttgagaatcgtgtgaggcaaattctgatgtcctctgggtcgacgacattcaccaagattgttaataaatggaatactgccctcataggactcatgacatacttccgtgaagcgactgtgcatacacaagagcttttggatttgttggtcaaatgtgagaacaagatccaaacacgtatcaagattggattgaattctaaaatgcctagcaggtttcctcccgtcattttttacaccccgaaggaaattggaggtcttggtatgctgtcaatgggtcatatattgattccacaaagcgatcttcgatacagcaagcaaacggatgttggtgtaacccattttagaagtggaatgagtcacgaggaggatcaattgataccgaatctttatcgctacatacagccatgggaaagtgagttcattgattcacagcgagtgtgggctgaatatgccttgaagaggcaagaggcacaggcacaaaacaggcgtttaacgttggaggatttggaggattcatgggacagggggatacctcgtataaatacactgtttcagaaggataggcatacgcttgcgtatgacaagggatggagggtacggactgatttcaagcagtaccaggtcttgaaacaaaaccctttttggtggacacaccaaaggcacgatggtaaactttggaacttgaataactatcggactgatgttatccaagctcttggaggtgttgaagggatcctggagcacaccttattcaaaggaacatattttccaacatgggagggtctcttttgggaaaaggcatccggttttgaagagtcaatgaagtacaaaaagttgacaaatgcacagagatctggtcttaaccagattccaaatcgtaggtttaccttgtggtggtcgcctacaattaatagagcaaatgtttacgtgggtttccaagtgcagttggatctcactgggatatttatgcatgggaagattcctactttgaagatatctctaatccagatattccgtgctcatttgtggcaaaagatccatgagagtgttgttatggatctttgccaagttcttgaccaggagttggatgcattagaaattgaaactgtccagaaggaaactatccacccgaggaagagttacaaaatgaatagttcttgtgctgacattctccttttcgctgctcatagatggccaatgtcgaagcccagtcttgtggctgaatctaaggacgtttttgaccaaaaagcaagcaataagtattggatagatgtacagcttcgttggggagattatgattctcacgatattgagcgttacacaagagccaaattcatggattatacaacggataacatgtctatatatccatctccaactggtgttatgattggacttgatcttgcttataacttgcattctgcatttggtaattggtttcctggttccaaaccactgcttgcacaggctatgaataagattatgaagtcaaatccagcattgtatgtgctccgcgagcgcataaggaaaggtttgcagctctattcttcagagcctacagagccatacttgtcatctcagaattatggagagattttcagtaatcaaataatatggttcgttgatgacactaatgtttatcgtgtcacaattcacaagacattcgagggaaatctgaccacaaagcctatcaatggtgccattttcatattcaatccaaggactggccagcttttcctgaaggtcattcatacaagtgtttgggctgggcaaaagcgtctaggtcagctggccaagtggaaaacagcagaagaagtagctgctcttgtgcgttctttgccggttgaagaacaaccaaagcagatcatcgtcactcggaaggggatgcttgatcctttggaggttcacttgttggatttccccaatattgttattaaagggagtgagctgcaactaccgttccaagcttgcttgaaaatagaaaaatttggtgatctgattctgaaggcaacagagcctcaaatggttctgtttaacatatatgatgactggctgaagagcatatcatcttacactgcattctctcgtctcattttgattctccgtgctcttcatgtgaacaatgagaaggctaaaatgttactaaaacctgacaagacaattgtcactgaacctcatcatatttggccgtctctcacagatgatcagtggatgaaggttgaagtagctttgagagacttgattctctcggattatgcgaagaagaacaatgtgaatacttcagctcttacacagtctgagattcgtgatattatacttggtgctgagattacccctccatcgcaacagaggcagcaaattgcagaaattgagaaacaggcaaaagaagccagtcagcttacggcagtcacacaaggaccaccaatgtgcatggtgatgaactgattgtgaccaccacaagtccttatgaacaagcagcatttgggtctaagactgactggcgtgtgagggcaatatcggcgaccaatctttatcttcgagtgaaccacatctatgttaattcagaggacataaaggagacaggatatacttatattatgcccaagaacatattgaagaaatttatctgcatagcagatctgcgaactcagattgctgggtacttgtatggtataagcccacccgataatcctcaggtcaaggaaattcgctgtattgcgatgccacctcaatggggaacacatcagcaagtgaatcttccaagtgcactccctgagcatgatttcctaaatgacttggagccattggggtggatgcacacacaaccaaatgagcttccacagttatcacctcaagatctaactaatcatgctcgggttctggagaacaacaagcaatgggatggcgagaagtgcattatcctgacatgcagtttcacgccaggttcctgctcattgactgcttacaagctcaccccttcaggttatgaatgggggcgtctgaataaagacactggaagcaatcccgccggataccttccgactcactacgaaaaggttcagatgctcctgagcgacaggttccttggcttttacatgatgccggataatggcccctggaactacaacttcatgggggtgaagcacacatcaagcatgaagtatggaatgaaactggggacgccgagagagtactatcacgaggaccacaggcccactcacttcctggagttcagcaacatggaagagggcgacaccgtggagggcgatcgtgaagacacatttacttagggccttagtagaacttttgggttgtcttttggatgttgaaaaccaccttgttgcacttttccactcaaatagatggtcctgaaattttgcaacagcaacctgttgtaatattttatctcactcgcttttgagagtgatgtatgtatgatagtcagcaagagctagtttttgttttcaaaaatgagataacatagtttataactgcggtgtcgtttagataaactccacagttttgcctgcgaggtattctgaatccgatttcatatgctctatcatggctacagttccggggtttagaaaacggta

SEQ ID NO: 946 - DNA, 4582 bp, Pseudotsuga menziesii
aaattacagatgcatatcttgatcaatatctttggtatgaaggtgacaaacgccatctcttccaaactggattaaacctgcagattcagagccgcctccacttttggtatataaatggtgtcaaggaatcaataaattgcaggatatatgggataccagtgaaggtcaatgtgttgtgatgcttcagacgaaatttgagaaattctttgagaaaatagatctgacaatgttaaacaggcttctgcgtctggtgcttgatcacaacattgctgattatgtcactgcaaaaaataatattgttttatcatacaaagatatgagccataccaattcgtatggtttgatacggggtcttcagtttgcctcctttgttgtgcaatattatggtctggtcttggatctcttggttctcggtttgactcgggcaagtgaaatagctggtcctccacagatgccaaatgagtttattacttactgggatacaaaagtggagacaaggcatcctataagattgtattctcgttatatcgacaaggtgcacattctttttagattcactcatgaagaggcaagggatcttatccagcgctaccttacagaacatccagatccaaacaatgaaaatatggttggttacaacaacaaaaagtgctggcctagagatgctcgcatgaggctgatgaaacatgacgttaatcttgggaggagtgttttctgggatataaagaacagactccctcgtagtatcacaacattagaatgggagaacagttttgtgtctgtttatagcaaagacaacccaaatttgcttttcagcatgtgcggatttgaagttcgaatattaccaaagataagaatgtctcaagaagcatttagcaatacaaaggatggagtctggaatttgcaaaatgagcagactaaagagcgcactgctgttgctttcttgcgtgttgatgatgaacacatgaaggtatttgagaaccgtgttagacagatcctcatgtcatcagggtcaacaacgttcaccaaaattgtaaacaagtggaatactgcactaatagggcttatgacctatttccgtgaagcaacagtgcatacacaggagcttcttgatctccttgtcaaatgtgaaaataaaattcaaacacgtatcaagattggtttgaactccaagatgcctagcaggtttcctcccgttatcttctatacacctaaggaaattggaggacttggaatgctatctatgggccatattttaattccacaaagtgacctacgttatagtcaacagacagatgttggagttacacacttccgtagtggtatgagccatgaggaagatcaacttattccgaatctgtatcgatacatacagccttgggagagtgaattcatagactctcaacgtgtttgggctgaatatgctttgaagaggcaggaagcacaggctcagaatagacgtttaactcttgaggatcttgaggattcatgggacagaggcattcctcgcattaatactctctttcaaaaagatagacacactctggcctatgacaaaggttggagggtacggacagacttcaaacagtatcaggttttgaaacaaaatccattttggtggactcatcagcggcatgatgggaagctgtggaatctaaataattatcgaacagatgttattcaggctcttggaggagtggaaggcattctggagcatactctatttaaaggaacttacttcccaacatgggaaggtttgttttgggagaaagcttctgggtttgaggagtcaatgaagtacaaaaagcttacaaatgcacagagatcagggctgaatcaaattccaaatcggcgattcacactttggtggtctcctaccatcaaccgtgccaatgtctatgtgggttttcaagtgcagttggatttgactggaattttcatgcatggaaaaattccaacactgaagatatcgttgatacaaatatttagggctcatctgtggcagaaagtacacgaaagtgttgtaatggatctctgccaggtacttgatcaggagttggatgctttggaaattgagactgttcaaaaggagactatacatcccaggaaaagttacaagatgaacagctcttgtgccgatatacttctttttgcagcatacaaatggccaatgtgcaagcccagccttgtggcagagtccaaggatgtgtttgatcagaaggcgagtaataaatattgggtcgatgtgcaacttcggtggggagactatgattcccatgacattgaacggtatacgagagccaaattcttagattatacaacagataacatgtcaatttacccatcacccactggtgttatgattgcaattgatcttgcttacaatttacattctgcatttggtaattggtttcctggttcaaagcctcttctggctcaagctatgaataaaataatgaagtcaaatcctgccttatatgtgttaagggagcgcataagaaaaggcctgcaactttactcttcagagccaacagaaccgtatttgtcatctcaaaattatggagagattttcagcaaccaaatcatatggtttgtggatgatacaaatgtgtatcgtgtcacaatccataaaacttttgaaggaaatcttacaacaaagcctatcaatggagcaattttcatattcaacccaaggacagggcaactatttctgaaggttatccatactagtgtgtgggcaggacagaagcgtcttggtcaactagctaaatggaagacagctgaagaagtagctgcattggtacgttctttgcctgttgaggagcagccaaaacagataattgtaactcggaagggaatgcttgatcccctggaagttcacttgcttgactttcctaacattgtcattaaaggcagtgagcttcagttaccattccaagcatgcttaaaaattgagaaatttggtgacctgattctaaaggctacagaaccacagatggttctttttaacatatatgatgattggttaaagactatctcatcatacacggcattttctcgtcttatactgatccttcgtgcccttcatgtgaacaatgagaaagcaaaaatgttgttgaaaccagacaagactattgttactgagccacaccacatttggccgagccttaatgatgatcaatggatgaaggtggaagttgctttgagagaccttattctctctgactatgccaagaagaataatgtcaatacatcagcattaacccaatcagaaatccgtgatattatacttggagctgagataactcccccctctcaacaaaggcaacagattgcggaaattgaaaagcaggcaaaggaagcaagccagctcactgcagttaccacaaggactacaaatgtgcatggtgatgagttgattgtcaccacaaccagtccatatgagcaggccgcttttggttctaaaacagattggcgtgtgagggcgatatctgccacaaatctgtatcttcgtgtcaatcatatctatgttaactctgatgatatcaaggagactggttatacatacattatgccaaagaacatattgaaaaaattcatttgcatagctgatcttaggactcagatctcagggtatatttatggtataagccctccagacaatccacaggtgaaagaaattcgctgtatagctatgcctccacaatggggaacgcatcagcaagttcacttgcctttggctttgccggagcatgaatttttgaatgatttagagcctttgggatggatgcatacacaacccaatgagcttcctcagttatcacctcaggacttaacatgccatgctcgaatcttggagaataataagcagtgggatggagagaagtgtatcattcttacatgcagtttcactcctggctcctgttccttaactgcatataagctcactccaacaggttatgagtggggacggctcaacaaagacactggaagcaatccgcatggttatctgcctactcattatgagaaagtacaaatgcttctcagtgaccgtttcctgggattttacatggtaccagataatggcccttggaattacaactttatgggtgtcaagcatacagttagtatgaagtatggaattaagcttggagctcctcgtgacttttatcatgaggatcaccgtcctactcactttctggagttcagcaatcttgaggagggtgatcatgcagagggagatgctgaagatgtatttacttagcttcagttcgctggcaagttttgggtatttaactttccaatccaccgagaaatatgagatatgcgggtaagctagctagcatgacttgtgagcaaatgctttagttttagcaactgtctaattgttttataaatatcttctccaaaagttggaaaaagcaatctttcgtcgtttctggggaatacaagtcagaaaaatcctttctggactgtatttgtataaatatgaaactggtgacgaaaaggttgcagtcatataatccttacttggcattacttgtttttatctttcatcacgaggggtaaacattcgggaaac

SEQ ID NO: 947 - DNA, 2907 bp, Sciadopitys verticillata
gttttgggaaaaagcatctggatttgaggagtcaatgaagtacaaaaagctgacaaatgcacaaagatcagggctgaatcaaattcccaatcgacggtttactctttggtggtctcctaccataaatcgtgccaatgtttatgtgggtttccaagtgcagttggatttgactggaattttcatgcatgggaaaattccaacactgaagatatcattgatacagatatttagagctcatctgtggcagaaagtacatgaaagtgttgttatggatctctgtcaggtacttgaccaggagttggatgctttggaaattgagactgtccaaaaggaaactatacatccccggaaaagttacaagatgaacagctcttgtgctgatattcttctctttgcagcatataagtggcctatgtgtaagcccagccttgttgcagagtcaaaggatgtttttgatcagaaggcaagcaataagtattggattgatgtgcaacttcgttggggtgattatgattctcatgacattgaaagatatacaagggccaagttcttggactatacaactgacaacatgtcaatctatccatcacctactggtgttatgattgcaattgatcttgcctacaatttacattctgcatttggtaattggtttccgggttcaaagcctcttctggcccaagctatgaataaaataatgaagtcaaatcctgcactctatgtattgagggagcggataagaaaaggtctacagctttattcttctgagccaacagaaccatatttgtcatctcaaaattatggtgagattttcagcaaccaaattatatggtttgtcgatgatacaaatgtgtatcgtgtcactatccataaaacttttgaaggaaatcttacaacaaagcctatcaatggcgcaattttcatatttaacccaaggacagggcaactatttttgaaggttatccatactagtgtgtgggcaggacagaaacgacttggccagcttgcaaaatggaagacagctgaagaagtagctgcattggtaaggtcactaccggttgaggagcagccaaaacagattattgttactcgcaaaggaatgcttgatcccttggaagttcacttgcttgattttcctaacatcgttattaaaggcagtgagctccagttgccattccaagcatgcttaaaaattgaaaagtttgggacctgattctaaaggctactgagccacagatggttcttttcaacatttatgatgattggttaaagactatctcttcatacacagcattttctcgcttaatattgatccttcgtgcacttcatgtaaataatgagaaagcaaagatgctgttgaaaccagacaagacagttgttactgaaccacaccatatttggccaaacctctctgacgatcaatggatgaaggtggaagtagctttgagagacttgatcctctctgactatgcaaagaagaataatgttaacacatcagcattaactcagtcggaaattagggatattatactcggagccgaaattaccccaccttctcaacaaaggcaacagattgcagaaattgaaaagcaggcaaaggaagcaagtcaactaactgcagttacaactaggactacaaatgtgcatggtgatgaattgattgttaccactacaagtccctatgagcaggctgcttttggttctaaaacagattggcgagtgagggctatatctgcaacaaacctttatcttcgagtcaatcatatctatgtcaactcggatgatataaaggaaacgggatatacatatatcatgcccaagaacatattgaagaagttcatttgcatagcagatcttagaactcagatttcaggttatctttatggcgtaagccccccagataatccacaggtgaaggaaattcgttgcatatctatgcctccacagtggggaacacatcaacaagttcatttgccttcggctttacctgagcatgattttctgaatgatctagaacctctgggatggatgcacacacaaccaaatgaacttcctcagttatcacctcaggacctaacatgtcatgctcgaatcctagagaacaataagcaatgggatggagagaaatgcataattctaacatgcagtttcactcctggctcctgttccttaactgcatataagctcacaccaacagggtatgaatgggggcggctcaacaaggacactggaagcaatcctcatggttatctccccactcattatgagaaagtacaaatgcttctgagtgaccgcttcctgggattttatatggttccagacaatggtccttggaattacaatttcatgggtgtcaaacatacagttagcatgaagtatggagttaagcttggaacacctcgagacttttatcacgaggatcatcgacccacacactttctggaattcagcaatcttgaggagggagagcatgccgagggagatactgaagacgtgttcaattagcttcatttgtcttatagactatgaatatgcaacattgtcaccaactaataaattttagtcgtctttttactatatctacctggctttgggttcatgtttcagttttggcctgtaattaatgttgcagattgtgttcttaatagctggaaaaggccatcttttagctatgacacacattttaattgtctagtgggtcaacttttatacaattttccatcctgtaatatataagataatgtctagatatctgacactacctcattgagacaaccaagatttatacaattttggatcctgtaatatatatgataatgttgacacatctgacactacctcgttgagatgagttagaaattttcattatgaatgaggaaagtgtcgcaaaaaatgtactatcagttc

SEQ ID NO: 948 - DNA, 6056 bp, Gossypium hirsutum
ccgcgcaggtagtggtacaaggagcattgtcctccatcttaccccgttaaagtgcgggttagttatcagaaattattgaaatgctttgtgctgaatgagttgcatcatagaccacctaaggctcaaaagaagaagcacttgttccggtctctccaggcgaccaagtttttccagacaacagagcttgattgggttgaagcaggtcttcaagtttgcaagcaagggtacaacatgttgaacctgttgatacataggaaaaatttgaactaccttcacctggattataacttcaacttgaagcctgtgaagactctcactacaaaagagcgcaagaagtcacgttttggcaatgcttttcatctttgtcgtgagatcttgcgtttaacaaagcttgtagttgatgctaatgtccagtttcgacttggtaacgttgatgctttccaattggccgatggtctgcagtatacattttcccatgttggccagttgactgggatgtatcgatacaagtaccggctcatgagacagattaggatgtgcaaagacttgaagcatttgatttactaccgcttcaatactgggcccgtagggaagggacctggatgtggattttgggcaccaatgtggagggtatggctgtttttcctccgtggcattgtccctcttctagaaaggtggttaggaaatctgcttgcacgacaatttgaagggcgtcattcaaaaggagtagccaagactgttaccaagcaacgtgttgagagccactttgatctggaacttcgagctgctgtcatgcatgatgttcttgatgccatgccagagggcattaagcaaaataaagctagaacaatattgcagcatctgagtgaggcatggcgctgttggaaggcaaacatcccatggaaggttccgggtttgccagttcccattgagaatatgattcttagatatgtcaagtcaaaagctgattggtggacaaatgttgctcattacaatcgtgagcgtatcagaaggggtgcaactgttgataaaacagtttgtaggaaaaacttaggcagattgacacgactctggctgaaagctgagcaagaacgacagcacaattatttgaaagatgggccatatgtcactccagaagaagcggttgcgatctatactacaactgtgcattggttggagtccagaaaattctcgcccattccatttcctcccttgtcttacaagcatgatacgaagttacttatccttgcactggagaggttgaaggaatcttacagtgtagctgtaagattaaatcaactccaaagagaagaattgggtctaattgaacaagcttatgataatcctcacgaggccttatcaaggatcaagcgccatttgcttacccagcgtgccttcaaagaagttggtatagagttcatggacctgtacagctatttgattccagtctatgaaattgagccccttgagaagattacagatgcttatcttgaccaatacctatggtatgaaggagacaagcggcatctgtttcctaattggattaagcctgcagattcagagccacctccacttttggtttacaaatggtgtcaaggtataaataatttgcaaggggtatgggacacgagtgaggggcagtgtgtggtaatgcttcaaacaaaatttgagaagttctttgacaagattgacctgacaatgttaaacaggcttctacgattggttcttgatcacaacattgcagattatgttactgcaaagaataatgtggtgctgtcttacaaagatatgagccacacaaattcgtatggtcttatacgtggtcttcagtttgcttctttcgttgtccagtattatggacttgttctggatctcttgcttcttggattgactcgtgctagtgagattgctggtccaccccagatgccgaatgagttcatcacatactgggatacaaaagttgaaacccggcatccaattcgtctgtactctaggtacattgatagggtgcacatattgttcagatttactcatgaagaagcacgggaccttatccagcgatatcttactgagcaccctgatccgaacaatgaaaacatggttggatataacaacaagaaatgctggccaagagatgcgagaatgaggcttatgaaacatgatgttaatcttgggagaagtgtcttttgggacatgaagaatcgtctgcctagaagcatcactactttggaatgggagaacagctttgtttctgtctacagcaaggataatccgaaccttctttttagcatgtgtggttttgaagtccggatacttccaaaaataagaatgactcaagaagcgtttagcaatacaagagatggggtttggaatctgcagaatgaacagacaaaggagcgaactgcagttgctttcttacgggttgatgatgagcacatgaaggtgtttgagaatcgtgttaggcagattctcatgtcttctggatcaacaacatttacaaagatagtcaacaaatggaatactgccttaataggtcttatgacttacttccgtgaagcaactgtgcatacacaagagcttctagatctactcgttaaatgtgaaaataaaattcaaacccgtatcaagattggactgaattcaaaaatgcctagtcgattccctcctgtaattttttacactcctaaagagattggaggacttggcatgttatccatgggtcacatattgattccgcagagtgatctccggtacagtcagcagactgatgttggcgtaactcactttaggagtggaatgagtcatgaagaggaccaactgattcctaatctttatcggtacatacagccatgggagagtgagttcatagactcacagcgtgtttgggctgagtatgctctgaagaggcaggaagcacaggcacaaaataggcgcctaacccttgaggatttggaagattcatgggataggggaataccacgtataaataccttgtttcagaaggacaggcacacattagcatatgacaaaggatggagagtacgtacagactttaagcagtaccaagttttgaagcagaacccattctggtggactcaccaaaggcatgatggcaaattgtggaacttgaacaactatcgaactgatgttatccaagctcttggaggtgttgagggaattctagaacataccttgtttaaaggaacatactttccaacttgggagggtctgttttgggaaaaggcttcaggattcgaggagtcaatgaagtataagaagctcactaatgctcagagatctggtcttaaccagattcctaaccgtaggtttactctttggtggtcacctacaatcaaccgggctaatgtttacgtgggttttcaagtgcaactagatctaactggaattttcatgcatgggaagattccaaccttgaaaatatctttgattcagattttccgtgcccatctgtggcaaaaaaattcatgagagtgtggttatggatctttgccaagtcttagatcaggagttggatgctttagaaattgaaactgttcagaaggaaacaatccatccaaggaaaagttacaagatgaacagctcttgtgcggatattcttctctttgcagctcataggtggcctatgtcaaagcctagtcttgtggcagagtccaaggacatgtttgatcaaaaagcaagcaataaatattggatagatgtacagctccggtggggtgattatgactcgcatgatattgagcgttacactcgagccaaatttatggactatacaacagataacatgtctatttatccatctcccactggggtaatgattggccttgatctggcttacaacttgcattctgcatttggtaattggttccctggttcaaagccactgctcgctcaggcaatgaataagatcatgaagtcaaatccagctttatatgtcttaagggagaggataaggaaaggtttgcagttatattcttctgagcctactgagccgtatctgtcatcccagaactatggggagatcttcagcaaccagatcatttggtttgttgatgacaccaatgtgtatcgtgtgacaatacataagacatttgaagggaatctcacgacaaaacccattaatggtgccatctttattttcaatccacggactggacagttgttcctaaaggtaattcacactagtgtctgggcaggtcaaaagcgtcttggtcagcttgccaaatggaaaactgctgaagaagttgctgctcttgtgcggtctttgcctgttgaagaacaaccaaagcagatcattgttacacgaaagggaatgcttgatcctttggaggttcacttactggatttccctaacatagttatcaagggaagtgagctgcaactcccattccaggcttgcttgaaaattgagaaatttggtgatctaattctgaaagctacagagccacaaatggttttgttcaacatctatgatgactggttgaagagtatctcatcatacactgcattctcccgactcattctgatccttcgtgcgcttcacgtgaacaatgagaaggctaagatgttactgaaacctgataagacaatcgttactgagccacaccatatttggccttctctaactgatgatcaatggatgaaggtcgaagttgctttaagagatctgatactttccgactatgccaaaaagaacaatgtgaacacatcagccctgacacagtctgagattcgtgacatcatccttggagctgagattactccaccctctcaacagaggcagcagatagcagagattgagaaacaggcgaaggaggcaagccagctaacagctgtgacaactaggactacaaacgtgcatggtgatgagctcattgtcaccaccacaagtccctatgaacaagcagcatttgggtccaagacggattggcgtgttagagcaatatcagctactaatctttatcttcgagtgaatcatatatatgtgaactcagaggacataaaggaaactgggtacacatatatcatgccaaagaacattttaaagaagttcatctgtatagcagatctcaggactcaaattgctggatacttgtatggaataagccctcctgataatccccaggttaaggaaatccgatgcattgccatgccaccgcaatggggtactcatcagcaagttaatcttccatcagctcttcctgaacatgatttcttgaatgatctggagcctttgggatggctgcacacacagccaaatgagcttcctcaattatcgccacaggatgtgacatcccattctcggatattagagaacaacaaacagtgggatggagagaagtgcataatcttgacatgcagtttcactcccggttcttgctcattaacagcctacaagcttaccccaagtggttatgagtggggacgggttaacaaagatacaggaagcaaccctcatggttacctcccaacgcattatgagaaggtgcagatgctcctaagtgatcggttccttggattttatatgatacctgacaatggtccgtggaattacaatttcatgggagtgaagcatacagtgagcatgaaatacggggtgaagctggggacaccgaaagagtactacaatgaggagcataggccgacacatttcctggagttcagcaacttggaagaaggtgatactgcggaaggagatcgggaggatacttttacttaaatccctaaatctgtttttaccaaagactccaaatcctactatgtatgaaatgaaggaaaaagaatatttgcattgcatactcgttttagtgctgaacccgcaacatggatagaggaggcttaaaacttgtttgttgaatagttgcatgtactaaatcccaattgtaagaatgctttttggagttgtaaatatgagtaagaactaggatttgaatacgttcttcaatgttctatcacctcaaatgttgggttaaacacaatatgtgcccaagaagctctgctcaggttaggtttcaatagtaacagacttatttgcttta

SEQ ID NO: 949 - DNA, 2789 bp, Aristolochia fimbriata
ctttccaacttgggagggtcttttctgggaaaaagcatcaggatttgaggagtcaatgaagtacaagaagctgaccaatgcacagagatctggtctcaatcagattccaaaccgtaggttcactctttggtggtcacctacaatcaatcgtgcaaatgtctatgtcggtttccaagtccaattggatctgacagggatatttatgcatggaaagatcccaacattgaagatatctttgattcagatttttagagcccatctttggcagaaagtccatgagagtgttgtcatggatctctgtcaggttttagatcaggaattggatgctttagaaattgaaactgtgcagaaagaaacaatacatccaagaaaaagttacaagatgaatagctcttgtgccgatattcttctctttgctgcacatagatggccgatgtctaagcccagtttagtggctgagtccaaggatgatgtgtttgatcaaaaagccagcaacaagtattggatagatgtgcagcttcgttggggtgattatgattctcatgatatagaacggtacacaagggccaaatttatggattacaccactgataacatgtctatctatccatctccaactggggttatgatcggaatagatctggcatacaacttgcattctgcctttggtaactggtttcctgggtcaaaacctctgctggctaaagctatgaataagatcatgaaatcaaatcctgctctttatgttctgagggagcgtatcagaaaaggtcttcagttgtattcatctgagcctactgagccatacctttcatctcagaactatggggagatcttcagtaaccaaatcatttggtttgttgatgatacaaatgtgtatcgtgtcacaattcacaaaacatttgaaggaaatctcacaacaaagcctatcaatggtgccatttttatatttaatccacgtactggacagctatttttgaaggttatccatacaagtgtgtgggccggacaaaagcgtcttggccagcttgccaaatggaaaacagcagaagaagtggctgctctggttagatcattgcctgttgaagaacaaccaaagcaaatcattgtgacacgtaaaggaatgttggatcctttggaagtccatttacttgattttcctaacattgtgatcaagggaagtgagttgcaattaccatttcaggcctgcttgaaaattgagaaatttggggacctaattctgaaggccactgaaccgcagatggttctgttcaacatttatgatgattggttgaagagtatatcatcgtacactgctttctctcgtctcattttgatcttacgtgctcttcatgtgaacaatgagaaggcaaaaatgttactgaagccgagtaaatctgtcatcacggaaccacatcacatctggccttcactcaatgatgatcagtggatgagggtggaggttgctcttagggatctcatactttcagattatgctaaaaagaataatgtcaacacttcagcattgacccaatctgagatccgtgatatcattcttggggcagagataactccaccttcacagcagaggcaacaaattgctgaaattgagaaacaggctaaggaagcaagccaacttactgcagtcacaacaaggacaacaaatgttcatggtgatgagctcattgttaccaccactagcccatacgagcaggctgcttttggctccaagacagattggcgggtgagggcaatatctgcaacaaatctttatcttcgagtcaaccatatctacgtcaattcagaggatattaaggaaacgggctatacatacatcatgccgaagaacatattgaagaagttcatttgtatagcagatcttcggactcaaattgcaggctacctatatggcgtaagccctcctgacaatcctcaagtcaaggaaattaggtgtataggcatgccaccacaatggggaactcatcagcaggttcatcttcctgctgctcttccggagcacgaattcttgaacgaccttgagcctttgggttggatgcatacacaaccgaatgagcttcctcaattatcgcctcaggatcttacctcacatgctcgcattttggagaacaacaagcagtgggatggcgagaaatgcatcattcttacttgcagtttcacccctggctcttgttccttaactgcctataagctcactccaaccggttatgaatggggtcgggtgaacaaggatacaggaagcaatccccatggctatctaccaacccattatgagaaggttcagatgcttctcagtgaccgcttccttgggttctacatgattccggataacggtccttggaattataatttcatgggggtgaagcacaccgtgagcatgaggtatggtgtaaagcttgggacacctcgagactactatcacgaggatcatcggcctactcattttctagaattcagtaacttggaggagggtgatattgcccaaggggatcgggaggatactttctcttagaagcctatgttttttggtcatgcggccaggagcatctcccatttcatgacctgtgtatttggaaattgtgtgccagtagaaacttgtataaaggcatttagaatcgacatacccttcttcctacggaagtctttgttgtacctctaagagataaaatagaaaaagccctgtacatatatgccttaccaagttgtgtactttttgttagatatttttgttaaggttgaatttttgggaagcagtaaggattctcctccat

SEQ ID NO: 950 - DNA, 7568 bp, Arnica chamissonis
cctccaacttcaatttctccctcgtttcgactgggactctcactccgtatcgggtcagatccaaaaccctagcgaccgccgttgaacctctcgaaaaaactcagttgatttcagtaactatcgtgtcgtcgaaattaggtcggttgatttcgtccctatttctagggtttatggttgatgtttagtaaccatgtggaataacaacggaccagagatgtggaataataacggtgtaattgctcctcctggaactggaggaggacaaccgctagcacctccggggactggaggtgttggtggctcaataccgccaccacccgccgcgcaaccgtcttacaccgtcttgccatctccggctgaagcggaggcgagactggaagagaaggcgaggaagtggatgcagttgaactcgaagcggtatggagataaacggaaatttggcttcgttgagactcagaaggaagatatgcctccagaacatgtcaggaagattatcaaggatcatggtgatatgtcatcgaaaaaataccgacatgataaacgtgtatacctaggggctcttaaatttgttcctcatgcagtctacaagcttctagagaacatgcccatgccatgggaacaggtccgtgatgttaaggtgctatatcacattactggagcaatcacatttgtgaatgagattccatgggttgttgaaccaatatatttagctcagtgggggaccatgtggattatgatgcgaagagagaagagggatcgaaggcatttcaagagaatgcgttttcctccttttgatgacgaagagcctccattggactatgctgacaatcttcttgatgtggacccattggaaccaattcaattggagttagatgaggaagaagattctgctgtttgtacttggttttatgatcataagcctcttgttaaaaccaaacttattaacggaccaagttatcgaaaatggcatctttcacttcctattatggcaacactccatcgattagcagggcagctgctttctgatctaatcgatcgcaattacttctacttgtttgatatggagtcattcttcactgccaaagctcttaatatgtgcataccaggtggtccaaaatttgaacccttgtatcgtgacatggagaaaggtgacgaggattggaatgagttcaatgatatcaataaactcattatccgttcgcctttgaggaccgagtacaggattgctttccctcatctatataacaacagaccaaggaaagtaaggctatgtgtatatcatacaccaatgattatgtatataaaaacagaggatcctgatttgcctgcattttattatgaccctctgatacaccccataactaataaagaccggcgtgataagaaaggccaggaggacgatgatgaagatgacgacttctctttgccagatggcgttgagcctttgcttactagcactcctttatatactgacacaacggctgctggtgtttctttgctatttgctccccggccctttaatatgagatctggtcgcatgcgacgtgctgaagatatcccccttgtgtctgagtggtataaggaacactgtcctccctcatatccagtgaaagttcgcgtcagctatcagaagttgttaaaatgttttgttttgaacgagctgcaccacagaccacctaaagctcaaaagaagaagcacttgttccgttctctccaggctactaagtttttccagaccactgaacttgattgggctgaagcaggtctacaagtttgtaagcagggttacaacatgctcaatctattgattcataggaaaaatcttaattaccttcatctcgattataatttcaatctgaagcctgttaagacccttactaccaaggagcgcaagaaatcacggtttggaaatgcttttcatctttgccgtgaaatcttgcgtttgacaaagcttgttgttgatgcaaatattcagtttcgtttggggaatgtggatgcattccagttggctgatggtttgcagtacacattttcacatgttggccagttaactggtatgtaccgttacaagtaccgactcatgcgacagattcgaatgtgcaaagatttgaaacatttgatctattatcggtttaacactggacctgttggaaaggggcctggatgtgggttctgggcacctatgtggcgggtgtggttgtttttcttacgtggtatagtgcccttactggaaaggtggttgggaaatttgcttgctcgccaatttgaaggacgtcattctaaaggggtggccaagactgttacaaagcaacgtgttgaaagccattttgatcttgagcttcgtgctgctgtcatgcatgatgttcttgatgccatgccagagggaataaagcaaaataaggcaagaaccattttgcagcacctgagtgaagcatggcgttgttggaaggcaaacatcccttggaaggtccctggtttaccagttccaattgaaaacatgatcctacggtatgtgaagtcaaaagctgactggtggacaaatgttgctcactataatcgtgaacgtataaggaggggtgccactgttgataagactgtttgtagaaaaaatttggggagattgactcgcctttggctcaaggcagaacaggaacgccaacacaactacttgaaagatggtccgtatgtgaccccagaagaagctgtggctatttacacaactacagtgcattggttggaatctagaaagttctcaccgataccattcccaccgttgtcctacaagcatgacacaaagcttcttattcttgctcttgagaggctcaaggaatcttacagtgtggcggtgaggctgaatcaacttcaaagagaagagttgggtttgattgaacaggcttatgacaatccgcacgaggcattatcgaggataaaacgtcatcttcttactcaacgtgcttttaaagaagttggcattgagtttatggatttatacagctatctgattccagtttatgagattgagcctcttgagaagattacagatgcatatcttgatcagtatttgtggtatgaaggtgacaaacgccatctgtttccaaattggatcaagcctgcagattcagagccaccaccactcttggtttataaatggtgccaaggcataaacaatttgcagggtgtatgggacactggtgatggtcagtgtgtggtgatgcttcagactaagttcgaaaagttctttgagaagatcgacttgacaatgcttaacaggcttctacgattggtccttgaccacaatattgctgattatgttacagcaaagaacaatgttgtgttgtcttacaaagatatgagtcacacaaactcatatgggctgatccgtggtcttcagtttgcttcttttgtggtacagtactatgggttggtgttggatcttttacttcttggattgacccgtgcaagtgaaattgctggcccactacaaatgcctaacgagttcattactttttgggacactaaagttgaaacacgacatcctatacggttgtactctcggtacattgataaagtgcatatcttatttcgtttctcacatgaagaggctcgggatcttatccagaggtatctcacggagcaccctgatcctaacaacgaaaacatggttggttacaataataagaagtgctggcctagagatgcaagaatgaggctgatgaaacatgatgttaatcttggaagaagtgttttctgggacatgaagaaccgtcttcctaggagtatcactactctggagtgggaaaacagctttgtttctgtttatagcaaagacaaccctaacctgctatttagcatgtgtgggtttgaggttcgcatattgccaaaaataagaatgactcaagaggcgttcagtaatacaaaagatggaatttggaatttgcagaacgaacagacaaaagagcgtacagcaattgctttcttacgtgttgacgatgaacacatgaaagtgttcgaaaatcgcgtgaggcagattctcatgagttcggggtctacaacattcacaaaaattgttaacaagtggaatacagctcttataggcctaatgacatactttcgtgaagcaactgtgcatacacaggaacttttagatctgttggtaaaatgtgaaaacaaaatccaaacccgtatcaaaattggattgaattccaaaatgcctagcaggttccccccggtgattttctacacacccaaggagattggaggtcttggcatgttatcaatgggtcacatattgattccacagagtgatctccggtacagtcagcagacagatgtcggtgtaacacactttaggagtggtatgagtcatgaagaagaccaattgattccaaatttgtatcgttatattcagccatgggagagtgagttcattgattcacaacgcgtttgggcagaatacgctctcaagaggcaggaagcccagtcacaaaacaggcgtttaacacttgaagatttggaagactcatgggaccgtggaataccaagaatcaataccctatttcagaaggatagacacacactagcatatgacaaagggtggagagtgagaacggattttaagcaataccaggttctcaaacaaaatccattttggtggacccaccagagacatgacggtaaactttggaacttgaataattaccgaactgatgtcattcaagcgctaggtggtgttgagggaattctcgagcatacattgtttaagggaacatatttcccaacatgggagggtcttttttgggagaaagcttcaggctttgaggagtcaatgaagtataagaagctgacaaatgctcagaggtcagggctgaaccaaattccaaaccgtaggttcacgctttggtggtctccaacgattaatcgagccaatgtttacgtcggtttccaagtccaactggatttaactggaatattcatgcatggaaaaatcccaaccttaaagatttctcttatccaaatcttccgggcccacttgtggcaaaaggtgcatgagagtgtggtgatggatctctgccaagtgttagatcaggagttggatgcactagaaattgaaactgtgcagaaggaaaccatccatcctagaaaaagttacaagatgaacagctcgtgtgctgatattctcttattcgctgcacatagatggcctatgtcaaaaccaagcctggtggcagaatcgaaggatgtcttcgaccagaaagcgagcaacaaatattggattgatgtgcagctgaggtggggtgattatgattctcatgacattgagcgttataccagggccaagtttatggactacaccactgataacatgtctatctatccgtcaccaacaggggtaatgattggacttgatcttgcgtacaacttgcattctgcatttggtaactggttccctggctcaaagccactacttgcccaggctatgaacaagattatgaagtcaaatccggctttatatgttctgagggagcgtataaggaaaggtttgcagttgtattcttcagagccaacagaaccatacctgtcatctcaaaactatggagaaatcttcagcaatcagataatctggtttgttgatgatacaaatgtgtaccgtgttaccatccacaaaacttttgaaggaaaccttaccacgaaacccattaatggtgctattttcatattcaatccccgcacaggacagctatttctgaaggttattcacacaagtgtgtgggctggtcaaaagcgtcttggtcaacttgccaagtggaaaacagcagaagaagtggctgctcttgttcgttccttacctgttgaggaacagccgaagcaaatcattgtgactcgtaaaggtatgttggacccactcgaagtccacttgcttgattttcccaacattgtcatcaagggaagtgagttgcagcttccattccaagcatgtctgaaaattgagaaatttggtgacttgattctgaaagcatctgaaccccaaatggttctgttcaatatctatgatgattggttgaaaagcatatcatcatatacggctttctccaggctcattttgattctgcgtgctttacatgtcaacaacgagaaagcaaaaatgttgctcaagcctgataagacgattgtcaccgagccccatcacatatggccttcccttagtgatgatcaatgggtgaaggttgaagttgctttgagagatctcatattgtctgattatgccaagaagaataatgttaatacttccgcgctcacgcaatctgagatacgggatattattcttggagctgaaattacccccccttctcaacagcgacaacagatagctgaaatagaaaaacaggcaaaagaagctagtcagttgacagcggttacaaccaaaacaacaaacgtgcatggggatgaacttattgttaccaccacaagtccgtatgaacaagctgcatttggttccaagactgattggcgtgtgcgggcaatatcagctaccaatctttatctccgtgtgaatcatatctatgtaaactcagaggacataaaggagactggatatacatacattatgccaaagaatatcttgaagaaatttatatgcatcgcagacttaagaactcaaatttctggatacttatatggtgtaagcccaccagataaccctcaagtgaaagaaatccgctgcatcgccatgccaccacaatggggtacacatcagcaagtccatctcccgtcagctctccctgaacatgacttccttaacgatcttgaaccattaggatggatgcacacccaaccaaacgagcttcctcaactatctccacaggatcttacctttcatgctcggattttggagaataacaagcaatgggacggggagaaatctattatattgacttgtagttttactcctggttcgtgctcgttgactgcttacaagcttacaccaactggttacgagtggggtcgtgcaaataaggactcaggaagcaatccacacgggtatcttccaacccactatgagaaggttcagatgcttttaagtgatcgttttctcggtttctatatggttcctgataacggtccttggaattacaatttcatgggagtgaagcatacagttagcatgaagtatggagtgaagctcgggactccacgggagtattatcatgaagatcacagaccgacacatttcttggagttcagcaatttggaagaggctgatgtggcggaaggtgatcgtgaggatacgttttcttgatcgatgaaatattacgcattcttgaaaacaagatacttgtaagctggcattgttatgttgggttgttataatgataatgccagtgtaagtatgtactcgtgatcgggcatgtaatcgtatacagtcgaaggctcgtctccttctgcacaatagccttgtaaacttgcaatgtttttgtaacgaactcagtgcatgtatatcaacccgtgagacgtatcatcttgatgtatttatttttctttctaaagtgaactgtttacttaaagtcttg

SEQ ID NO: 951 - DNA, 7550 bp, Pinus taeda
ccgaatttcacctgctcgcttatattttcatttggagcaagtcgtcgatgctgaccagggtttaagtcgtagggtttctttggagcagcagaaaatgtggaacccaggagtggcggggagctctcacatggctcccccgggcacgacaccgtcagtgccaccgccatccggaatgcagcagccgcagcatccctcttacggaccccctctaaattctgccgatgccgaggccatgctggaagagaaggcacgcaaatggatgcagcttaatgctaaaaggtatggcgataagcgtaaattcggattcgtcgagacgcagaaagaggacatgccgccggagcacgtcagaaaaatcatcagagatcatggagacatgtcttcaaaaaaatatcgccatgacaagcgtgtttatctgggagcacttaaatttgtacctcatgcagtctacaaacttcttgaaaacatgcccatgccctgggagcaggttcgtgatgtgaaggtactctatcacataaccggggctatcacttttgttaatgaaataccatgggttgttgagcccatatatatggcacagtggggcacgatgtggatcatgatgcgaagagaaaaaagggacaggcggcattttaaaagaatgcgctttccaccatttgatgatgaggaacctcctttagattacgcagacaatttgttagatgtggaccctctcgaacctatccagttggagctggatgaggaagaagattctgctgtatacacatggttttatgaccacaagcccctagtgaaaacaaaacttataaatgggcctagttatagaaggtggcagttatcacttccgatcatggcaactttgcaccgtcttgcaggacagctactttctgacttgattgataaaaactatttctatctctttgatatggagtcttttttcacagcaaaagcattgaacatgtgcataccaggagggccgaagtttgagcctttgtacagagatatggagaagggtgatgaagactggaatgaattcaatgatattaataagcttattatccgctctccacttcgaacagagtatagaattgcatttcctcatctctacaacaacaggcctaggaaagttaggctttgtgtatatcacagtcccatggtgatgtacataaaaactgaagatccagatttaccagcattttattttgatcctctgattcatcctatttcttttcataagactgatcgccgagagaggaaaacttacgaggaggatgatgacgatgatttttttgttccagaaggtgtggaacctttgttgcatgatacaccactttacacagatacaacagctgccggtatttcgttattgtttgctccacgtccattcaatatgcgatcaggtcgtatgcgacgagcagaagatattcctctagtttctgattggtacaaggaacactgtcctcccacatatccagtgaaggttcgtgtgagctatcagaagctcctaaaatgttatgtgttgaatgaacttcatcacaggcctccaaaggctcaaaagaagaaatacttgtttcgttccctacaagctaccaaatttttccagacaactgagctagattgggcagaggctgggcttcaagtttgcagacagggttacaatatgctgaatcttcttattcaccgaaagaacttgaattatcttcatcttgattacaattttaatctgaaacctgtgaagacactcacaacgaaggagcgtaagaagtcacggtttggaaatgctttccatttatgtcgtgaaattttgcgactaacaaaactagttgtcgatgcaaatattcaatttcgactgggaaatgtggatgctttccagttggcagatggattacaatatacattttcacatgtagggcagttgactggtatgtatcgttacaagtatcggcttatgcggcaaataagaatgtgtaaagatctgaagcacttgatttattatcgctttaacactgggcctgttgggaaaggacctggatgtggattttgggctccaatgtggagggtatggttgttttttctacgtggtatagtcccactgctagaaaggtggcttggaaacttgcttgcacgacagtttgaaggtcgtcattcaaagggagtggcaaaaactgtgaccaaacaaagggttgaaagtcattttgatttggagctgagagcagctgtcatgcacgatgttcttgatgcaatgccagagggcatcaagcagaacaaagctcgcaccattttgcaacatttgagtgaagcctggcgctgttggaaggcaaacatcccctggaaggtgcctggcctaccagtgccaattgagaatatgattcttcgttatgtaaaatcaaaagcagactggtggactaatgttgctcattataatcgtgagcgcattcggcgtggtgcaactgtagacaagacagtttgtcggaaaaatctaggaaggctcacacgtctttggctgaaagcagagcaggaacgacaacataattacttgaaagatggcccctatgtaacacctgaggaagctgtggccatctataccactacagttcattggctggaatcgagaaaattttctcccattccttttccaccactgtcatataaacatgacacgaaactcctaatattagcacttgaaagattgaaagaatcttatagtgttgctgtccgattaaatcaacaacagagggaagagctgggtcttatcgagcaggcatatgataatccacatgaggcattatcacgtatcaaacgtcatctgcttacacagcgtgccttcaaagaagtgggcattgaatttatggacttgtatagctatctgatccctgtatatgaaattgaacctcttgagaaaattacagatgcttatcttgatcaatatctttggtatgaaggtgacaaacgccatctctttccaaactggatcaaacctgcagattcagagccacctccacttttggtatataagtggtgccaaggaatcaataatttgcaggatatatgggataccagtgaaggtcaatgtgttgtgatgcttcagacaaaatttgaaaagttctttgaaaaaatagatctgacaatgttaaacaggcttctgcgtttggtgcttgaccacaacattgctgattatgtgactgcgaaaaacaacattgttctatcatacaaagatatgagccataccaattcatatgggctgattcgaggtcttcagtttgcttcctttgttgtgcaatattatggtctggtcttggatcttctggtccttggtttgactcgggcaagtgaaatagctggtcctccacagatgccaaatgaatttattacttactgggatacaaaagtggagacgaggcatcctataagattgtattctcgttatattgacaaggtgcacattctttttagattcactcatgaagaggcaagggatcttatccagcgctaccttacagaacatccagatccaaacaatgaaaacatggttggttacaacaacaaaaagtgctggcctagagatgctcgcatgaggctgatgaaacatgatgttaatcttgggaggagtgttttctgggatataaagaacagactccctcgtagtatcacaacattagaatgggagaacagttttgtctctgtttatagcaaagacaacccaaatttgcttttcagcatgtgtgggtttgaagttcgaatattaccaaagataagaatgtctcaagaagcattcagcaatacaaaggatggagtctggaatttgcaaaatgagcagactaaagagcgcactgctgttgccttcttgcgagtcgatgatgaacacatgaaggtgtttgagaatcgtgttaggcagatcctcatgtcatcagggtcaacaacctttaccaaaatcgtaaacaagtggaatactgcactaataggactcatgacctatttccgtgaagcaacagtgcacacacaggagcttcttgatctccttgtcaaatgtgaaaataaaattcaaacacgtataaagattggtttgaactccaagatgccaagcaggtttcctcctgttatcttctatacacccaaggaaattggaggacttggaatgctatctatgggccatattttaatcccacaaagtgacctacgttatagtcaacagacagatgttggagttacacacttccgcagtggtatgagccacgaggaagatcaacttattccaaatctgtatcgatacatacagccctgggagagtgaattcatagactctcaacgtgtttgggctgaatatgctttaaagaggcaggaagcacaggctcagaatagacgattaactcttgaggatcttgaggattcatgggacagaggcattcctcgcattaatacgctttttcaaaaagatagacacacactggcttatgacaaaggttggagggtacggacagacttcaaacagtatcaggttctgaaacaaaatccattttggtggactcatcagcgacatgatgggaaactgtggaatctgaataactatcgaacagatgttattcaggctcttggaggagtggaagggattctggagcacactctatttaaaggaacttacttcccaacatgggaaggtctgttctgggagaaggcttctgggtttgaggagtctatgaagtataaaaagcttacaaatgcacagagatcagggttgaatcaaattcccaatcgacgatttacactttggtggtctcctaccatcaatcgtgccaatgtttatgtgggttttcaagtgcagttggatttgactggaattttcatgcatggaaaaattccaacactgaagatatcattgatacaaatatttagggctcatctgtggcagaaagtgcacgaaagtgttgtaatggatctctgccaggtacttgatcaggagctggatgctttggaaattgagactgtccaaaaagagacgatacatcccaggaaaagttacaagatgaacagctcttgcgctgatattcttctttttgcagcatataaatggccaatgtgcaagcccagccttgtggcagagtctaaggatgtttttgatcagaaggcaagtaataaatattggattgatgtgcaacttcggtggggagactatgattctcatgacattgaacggtatacgagagccaaattcttagactatacaacagataacatgtcaatttatccatcacccactggtgttatgattgcaatcgatcttgcttacaatttacattctgcatttggtaattggtttcctggttcaaagcctcttttggcccaagctatgaataaaataatgaagtcaaatcctgccttgtatgtgttaagggagcgcataagaaagggcctgcaactttattcttcggagccaacagaaccgtatttgtcatctcaaaactatggagagattttcagcaaccaaattatatggtttgtggatgatacaaatgtgtatcgtgtcacaatccataaaacttttgaaggaaatcttacaacgaagcctatcaatggagcaattttcatattcaacccgaggacagggcaactatttttaaaggttatccatactagtgtgtgggcaggacagaagcgtcttggtcaactggctaaatggaagacagctgaagaagtagctgcattggtacgttcattgcctgttgaggagcagccaaaacagataattgtaactcgtaagggaatgcttgatccactggaagttcacttgctcgactttcctaacattgtcattaaaggcagtgagcttcagttaccattccaagcgtgcttaaaaattgagaaatttggtgaccttattctaaaggccacagaaccgcaaatggttcttttcaacatatatgatgattggttaaagactatctcatcatacacggcattttctcgtcttatactaatccttcgtgcccttcatgtgaacaatgagaaagcaaagatgttgttgaaaccagacaagactattgttactgaggcgcaccacatttggcctagccttaatgatgaccagtggatgaaggtagaagttgctttgagagaccttatactctccgattatgccaagaagaataatgtcaatacatcagcattaacccaatcagaaatccgtgatattatacttggagctgagataactcccccttctcaacaaaggcaacagattgctgaaattgaaaagcaggcaaaggaagcaagccagctcactgcagttaccacaaggactacaaatgtgcacggtgatgagttgattgtcaccacaactagtccatatgagcaggctgcttttggttctaaaaccgattggcgtgtaagggcaatatctgccacaaatctctatctccgagtcaatcatatatatgttaactctgatgatatcaaggaaactggttatacatacattatgccaaagaacatattgaaaaaattcatttgcatagctgaccttaggactcagatttcggggtatatttatggtataagccctccagacaatccacaggtgaaggaaattcgctgtatagctatgcctccacaatggggaacgcatcagcaagttcatttgcctttggctttgccggagcacgaatttttgaatgatttagagcctttgggatggatgcatacacaacccaacgagcttcctcaattatcacctcaggacttaacatgccatgctcgaatcttggagaataataagcagtgggatggagagaaatgtatcattcttacatgcagtttcactcccggctcctgctccttaactgcatataagcttactccaacaggttatgaatgggggcggctcaacaaagacactggaagcaatccacatggttatctgcctactcattatgagaaagtacaaatgcttctcagtgaccgttacctgggattttacatggtaccagacaatggtccttggaattacaacttcatgggtgttaagcatacagtcagtatgaagtatggaattaagcttggagctcctcgtgacttttatcacgaggatcaccgtcctactcactttttggagttcagcaatctcgaagagggtgaccatgcagagggagatgctgaagatgtattttcttagcttcggttatctggcaaatcgtggatatttaactttccaatccaccgagaaatatgagaaatgctgctaagatataactagcatgacgaatgagtaaatgcttttgttttagcagctgtccaattgttatataaatatcctctccaacgtttggaaaaagcaatctatctccgtttctggagaacacaagccaggaaaacccttcctcgaatgcatatgtataaaatatgaaactggtgagtcgctagaagttgggatcatatatgcttggcacgacttctttctatctatacatctttcattgcttgttttcattcctcattacttgtttttattcctccctcattatgagtggaaagtggaaaaattttaggtgttaaattttgat

SEQ ID NO: 952 - DNA, 6074 bp, Vinca minor
gctggtatttctctgttgttcgcaccacgtcctttcaacatgagatctggccggatgcgtcgtgctgaagatataccccttgtttccgagtggttcaaggagcactgtcctccatcgtacccggtcaaagttcgtgttagttaccagaagctgttgaaatgttttgtgttaaatgaattgcatcacaggccaccaaaggctcagaaaaaagaagcatctgtttcggtctcttgctgctacaaagttcttccaaacaacagagcttgattgggctgaagctggccttcaagtttgtaaacaagggtacaacatgctgaattattgattcaccgaaagaatcttaattatctccatcttgattacaatttcaacttgaaacctgtgaaaactctcaccaccaaggaacgtaagaagtcccgtttcggtaatgcttttcatctttgcgtgaaattctccggctgacaaagctggtagttgatgcaaatatccagttccgattgggtaatgtagacgcatttcagttggcagatggcttgcagtatatattttcccatgttggccagttgacgggtatgtacaggtacaagtacaggcttatgaggcaaatcagaatgtgcaaagatttgaagcacttgatttattaccggtttaacacagggccagttgggaaaggacctggatgtggtttctgggcgcctatgtggcgggtttggttattcttccttcgtggtatagtgcctttattggagcgatggttggggaatttgcttgcccgtcaatttgaggggcgccattctaagggggttgctaaaactgtcaccaagcagcgtgttgagagccacttcgatctagagcttcgtgctgcagtaatgcatgatgttcttgatgctatgccagaaggtatcaagcagaacaaagcaagaacaatactgcagcatctgagtgaagcatggcgttgttggaaagcaaatattccttggaaggtgccaggtttgcctgttccaattgagaacatgatccttcggtatgtgaaatcaaaggctgattggtggacaaacgttgcccattataaccgtgaacgaataaggagaggtgcaactgtggataaaaccgtgtgccgaaagaatcttggtaggttaacccgactttggctcaaagcagaacaagagcgtcaacataactacctgaaggatgggccctatgtaaccccggaagaagctgttgcaatttacactactactgtgcactggttggaatcaagaaaattctcgcccattccatttcctccactatcgtataagcatgatacaaagcttctaattcttgctcttgagaggttgaaggaatcgtacagtgtggctgtacggctgaatcaattgcaaagggaagagcttggtctcattgaacaagcctatgataatccacatgaggctttatcaaggatcaagcgtcatcttcttacccaacgtgcctttaaagaagttggtattgagttcatggatttgtatagctatttgattcctgtttatgagattgaacctcttgaaaagattactgatgcatatctagaccaatatctgtggtatgaaggtgacaaacgccatctattcccaaattggataaaacctgcagattccgagccacctccattgttggtgtataaatggtgtcagggaataaataacttacaagggatatgggacaccagtgaaggacagtgtgtcgtgatgcttcaaactaaatttgagaaattttttgagaagatcgatttgaccatgttgaacaggcttctgcggctggttcttgatcacaatatagctgattatgtcacagcaaagaacaatgttgtcttgtcatacaaggacatgagccacacaaattcgtatgggcttatccgtggtctccagtttgcatcttttgttgtccaatactatggactagtactggatcttttgcttctcggcttgactcgagcaagtgaaattgctggtcccccacaaatgccaaacgagttcattacttactgggatgctaaggtagagacaaggcatcccataagactgtattcaagatacattgacaaggtgcatatattgtttcgcttcactcatgaagaagcaagagatcttatccagcggtatcttactgagcatcctgatccgaacaatgagaatatggttggttataacaataagaagtgctggcccagagatgctcgaatgaggcttatgaagcatgatgtcaaccttggtagaagtgtcttctgggacatgaagaaccggcttccgagaagcatcacaactctggagtgggaaaatggctttgtctctgtctacagcaaagacaatcctaacttgcttttcagcatgtgtgggtttgaggttcgtatactgccaaaaattagaatgactctggaagcattcagcaataccagagatggagtttggaatctgcagaatgaacagacgaaagaacgtactgctgtcgctttcttacgagttgatgatgagcacatgaaagtgttcgagaatcgtgtcaggcagattctcatgtcttcaggttctactacattcacgaagattgttaacaaatggaatacagctttaataggtctaatgacatatttccgtgaagcaacagtgcatacacaagagttgctagatttgctggtgaaatgtgaaaataaaatccaaacccgcatcaagattggattaaattctaaaatgccaagcaggtttcctcctgttatcttttacacaccaaaggaaattggaggactcggaatgttgtcaatgggtcatatattgattccacagagcgaccttcgatatagtcaacagacagatgtgggtgtaacgcacttcaggagtggaatgagtcatgaagaggaccagttgatcccgaatctttaccgttacatacagccatgggaaagcgagttcatcgattcccagcgagtatgggcagaatatgcattaaagagacaggaagcccaggcgcagaataggcgtttaacgcttgaagatcttgaggactcttgggatcgtgggatacctcgaatcaacacattattccagaaggatagacacaccctggcatatgataaaggatggagggtgagaacagatttcaagcagtatcaagttctcaaacaaaatccattttggtggacacaccaaaggcatgatgggaagttatggaacttaaataattataggaccgatgttatccaggctttgggaggagttgaaggaattttggagcatactttattcaaaggaacatactttcctacttgggagggtctcttctgggagaaggcttcaggttttgaggaatccatgaagtacaaaaagctgacaaatgcacagagatctgggctcaatcaaattcctaatcgtaggtttacactttggtggtcacctactataaatcgagccaatgtctatgtcggtttccaagtgcagttggatttgactgggatatttatgcatggcaagataccaactctcaagatatccttaatccagatattccgtgctcacttgtggcagaagatacatgagagtgttgtcatggatctttgccaggtcctagatcaagagcttgatgcattagaaattgagactgtgcagaaagaaacaattcatccaagaaagagttacaaaatgaacagttcctgcgcagacattcttctgttcgctgctcatagatggcctatgtcaaaacctagtctggttgccgagtcgaaagatgtttttgatcaaaaggctagcaacaagtactggattgatgtgcagcttcgatggggtgattatgattcgcacgatatagaacgatacacaagagcgaagttcatggattatacaacagataacatgtcaatttatccgtcaccaactggggtgatgattggccttgatctcgcttacaacttgcattctgcctttggaaactggttccctgggtccaaaccattgctggctcaggctataaacaagattatgaagtccaatccagcgttgtatgttttgagggagcgaataagaaaagggttgcagttgtattcttcagaacccacagaaccctacttgtcatctcagaactatggagaaattttcagtaaccagattatttggtttgttgatgacacaaatgtgtatcgtgtcactatacacaagacttttgaaggaaatcttacaacgaaacccatcaatggtgctatctttattttcaatcccaggacagggcagctctttctcaaggtgattcacacgagtgtctgggctgggcaaaagcgtcttggtcagctggccaagtggaaaactgctgaagaagtggctgctttggtgcggtctttacctgttgaagagcagcctaaacaaattattgttactcgtaagggcatgttggatcctttggaggttcacttacttgattttcctaacatagtcatcaagggaagtgagctccaactgcctttccaagcatgcttgaagattgagaaatttggggatctgatcctcaaagcgactgagccacaaatggttttattcaacatttatgatgattggttgaagagtatatcatcatacactgccttttcgagactgattttgattttgcgtgcactgcatgtgaataatgagaaggcaaaaatgttgctaaagcctgataagacagttgtcactgagccacaccatatttggccctctcttacggatgatcaatggatgaaggttgaagtggctttgagagatttgattttatccgattatgcaaagaagaacaatgtcaatacatcggctcttacacagtctgaaattcgtgatataatccttggagctgagattactcccccttcacaacagcgacagcaaattgcagagattgagaaacaggcaaaggaagcaagtcagctcacagcagtcactacaagaacaacgaatgtacatggtgatgaactgatagtcacaactacaagtccatacgagcagtctacatatgcagctaaaactgactggcgcgtgagagcaatttctgcgacaaatctctatctccgagtgaatcacatatatgttaattcggaggatataaaggagactggatatacttacatcatgccaaagaacattttgaagaagttcatatgcatcgcggacttgcggacgcaaattgcaggatatttgtatggagtgagccctccagacaatcctcaggttaaggagattcgatgtattgccatgccaccacagtgggggacgacccagctagtgaatcttccgtctactcttcccgagcatgacttcctaaatgatttggagcctctgggatggatgcatacccaaccgaatgaacttccacaattgtcacctcaggatttgactagccatgctcgagtcttagaaaacaacaggcagtgggatggagagaagtgcataattctaacttgcagctttacgccaggctcatgctctttgacagcatacaaactgtcaccctcaggttatgaatgggggcgggccaacaaggataatggaagcaatccacatggttacttgccaacacattatgagaaagtccagatgctcttgagtgaccgcttccttggtttctacatggtccctgataatggtccttggaattataactttatgggagtaaaacacactataagcatgaagtacggtgtgaagttaggaacaccaagggagttctatcacgaggatcataggccaacacatttcctcgagttcagcaacttggaagagggtgacactgcagaaggagaccgcgaggatacatttacgtaattttcaatatctggctgagatcggcagtggaagatctttagggtttaccagctcttcagtttgttcaccggaatttaacttttttgcagcaactttgtattagtttgaccagtttgtaagctttgttttagaaggcttagacattgtaaatatggtcttgagaatgtagatttgctgtataacgtggttggttaatattgtgaaatgcatgtcatcccatactgaactgtaaggttgggaggatttgggatttagagtccg

SEQ ID NO: 953 - DNA, 6629 bp, Vinca minor
tagtacgtggagtcttcggtagccgaataccagttggagatggagtgaggaagaagagttctgctgtatatactggtttatgatcctaagcgctggtgaagactaagcttatcaatggtcctagttacaggaagtggcatttgtcccttcctatcatggctacacttcacaggcttgctggacagctctttctgatctaattgatcgcaactacttctacctgtttgatatggagtcgtttttcacagctaaagcacttaatatgtgcatacctggtggaccaaagtttgagcctttgtaccgagacatggagaagggagatgaagattggaatgagttcaatgatatcaacaaactcatcattaggtcacctctcaggacagaatacaggattgctttccctcatctgtataataataggcctcggaaagtgaagcttggagtatatcacacaccaatgattatgtatataaaaactgaggatcccgacttacctgcgttttattatgatcctcttattcaccccataaccagcacgaataaggacaagcgggagaagaaaagtcacgaagaggatgcggatgatgatttttctttgcctgatggggtagaaccgttgctcagtgatgttccactctatactgatactactgctgctggtatctctttgttgtttgcacctcgtcccttcaacatgagatctggtcggatgcgtcgtgctgaagatatacctctggtttctgagtggtacaaggaacactgtcctccatcatatcccgtcaaagttcgtgttagttaccagaagctgttgaaatgttttgtgttaaatgaattgcatcacagaccaccaaaggcacagaaaaagaagcatctatttcggtctcttgcagctacgaagttcttccaaacaacggagcttgattgggctgaagctggtcttcaagtttgtaagcaagggtacaatatgcttaacttgttgattcacaggaagaatttgaattatctccatcttgattacaatttcaacttaaaacctgtgaagactctcaccaccaaggaacgtaagaagtcccgtttcggtaatgcttttcatctttgccgtgaaattctccggctgacaaagctggtagttgatgcaaatattcaattccgattgggtaatgtagacgcatttcagttggcagatggcttgcaatatatattttcccatgttggacagttgacgggtatgtacaggtacaagtacaggcttatgaggcaaatcagaatgtgcaaagatttgaagcacttgatttattaccggtttaacacgggaccagttgggaaaggacctgggtgtggtttctgggcacctatgtggcgtgtttggttattcttccttcgtggtatagtgcctttattggagcggtggttggggaatttgcttgcccgtcaatttgaggggagacattctaaaggagttgctaaaactgttaccaagcagcgtgttgagagccacttcgatctagagcttcgtgctgcagtaatgcatgatgttcttgatgctatgccagaaggtatcaagcagaacaaagcaagaacaatactgcagcatctgagtgaagcatggcgttgttggaaagcaaatattccttggaaggtgccaggtttacctgtaccaattgagaacatgatccttcggtatgtgaaatcaaaggctgattggtggacaaatgttgcccattataaccgtgaacgaattaggagaggtgcaactgtggataaaacagtgtgccggaagaatcttgggaggttaactcgtctttggctcaaagcagagcaagagcgtcaacataactacctgaaggacgggccttatgttacaccagaagaagctgttgcaatttacactactactgtgcactggttggaatcaagaaaattctcgcccattccattccctccactatcttataagcatgatacaaagcttctaattcttgctcttgagaggttgaaggaatcttacagtgtggctgtacgactaaatcaattgcaaagggaagagcttggtctcattgaacaagcctatgataatccacatgaggctttatcaaggatcaagcgccatctgcttacccaacgtgcctttaaagaagttggtattgaattcatggacttgtatagctatctgattcctgtttatgagattgaacctcttgagaagattactgatgcttatctagaccagtatctgtggtacgaaggtgacaaacggcatctattcccaaattggataaaacctgcagattccgagccacctccattattggtgtataaatggtgtcagggtataaataacttacaaggggtatgggacaccagtgaaggacagtgtgtcgtgatgcttcaaactaaatttgagaaatttttcgagaagatcgatttgaccatgttgaacaggctcctgcggctggtacttgatcacaatatagccgattatgtcacagcaaagaacaatgttgtgttgtcatacaaggacatgagccatacaaattcgtatgggcttatccgtggtcttcagtttgcgtcttttgttgtccaatactatggactagtactggatcttttgcttctcggcttgactcgagctagtgaaattgctggtcccccacagatgccaaatgagttcattacttactgggatactaaagtagagacaaggcatcccataagactatattcaagatacattgataaggtgcatatattgttccgattcactcatgaagaagcaagagatcttatccagcggtatcttactgagcatcctgatccaaacaatgagaatatggttggttataacaataagaagtgctggccaagagatgctcgaatgaggcttatgaagcatgatgtcaatcttggtagaagtgtcttctgggacatgaagaaccggcttccaagaagtatcacaactctggagtgggaaaatagttttgtctctgtctacagcaaagacaatcctaacctgcttttcagcatgtgtgggtttgaggttcgtatactgccaaaaattagaatgactcaggaagcattcagcaataccagagatggagtttggaatctgcaaaatgaacagacgaaagaacgtactgctgttgctttcttacgagttgatgatgagcacatgaaagtgttcgagaatcgtgtcaggcagattctcatgtcttcaggttctactacattcacgaagattgttaacaaatggaatacagctttgataggtctcatgacatatttccgcgaagcaacagtgcatacacaagaattgttagatttgctggtcaaatgtgaaaataagatccaaacccgtatcaagattggattaaattctaaaatgccaagcaggtttcctcctgttatcttttacacaccgaaggaaattggaggactgggaatgttgtcaatgggtcatattttgattccacagagcgaccttcgatacagtcagcagactgatgtgggtgtgacacacttcaggagtggaatgagtcatgaagaggatcagctgataccaaatctttaccgttacatacagccctgggaaagtgagttcattgactcccagcgagtttgggcagaatatgctttaaagagacaggaagctcaggcacagaataggaggttaacgcttgaagatcttgaggactcttgggatcgcggtatacctcgaatcaacacattattccagaaggataggcacaccctggcatatgataaaggatggagggttagaacagatttcaagcagtatcaagttctcaaacaaaatccattctggtggacacaccaaaggcatgatggtaagttgtggaacttgaataattataggacagatgtcatccaagctttgggaggagttgaagggattttggagcatacattattcaaaggaacatactttcctacttgggagggtctcttctgggagaaggcttcagggtttgaggaatccatgaagtacaaaaaactgacgaatgcacaaagatctggactcaaccaaattcctaatcgtaggtttacactttggtggtcacctactataaatcgagccaatgtctatgttggtttccaagtgcagttggatttaactgggatttttatgcatggcaagataccgactcttaagatatccttaatccagatattccgtgctcacttgtggcagaagatacacgagagtgttgtcatggatctttgccaggtcctagatcaagaacttgatgcattggaaattgagactgtgcagaaagaaacaattcatccaagaaagagttacaaaatgaacagttcctgtgctgacattcttctgttcgctgctcatagatggcctatgtcaaaacctagtctggttgctgagtcgaaagatgtttttgatcaaaaggctagcaacaagtactgggttgatgtgcagcttcgatggggtgattatgattcacacgatatagaaagatacacaagagcgaagttcatggattatacaacagataacatgtcaatttatccatcgccaactggggtgatgattggtctcgatcttgcttacaacctgcattctgcctttggaaactggttccctgggtccaaaccattgctcgctcaggctatgaacaagattatgaagtccaatccagcgttatatgttctgagggagcgtataagaaaagggttgcagttgtattcttcagaacccacagaaccctacttgtcatctcagaactatggagaaattttcagtaatcagattatttggtttgttgacgacacaaatgtgtatcgtgtcaccatacacaagacttttgaaggaaatcttacaactaaacccatcaacggtgctatatttattttcaatcccaggacagggcagctctttctcaaggtgattcacacaagtgtctgggcggggcaaaagcgtcttggtcagctggccaagtggaaaactgctgaagaagttgctgctttggtgcggtcgttacctgttgaagagcagcctaagcaaattattgttactcgtaagggcatgttggatcctttggaggttcacttgcttgattttcctaacatagtcatcaagggaagtgagctccaactgcctttccaagcatgcttgaagattgagaaatttggggatctgatactcaaagcgaccgagccacaaatggttttgttcaacatttatgatgattggctgaagagtatatcatcatacactgctttttctaggctgattttgattttgcgtgcgctacatgtgaataatgagaaggcaaaaatgttgctaaagcctgacaagacaattgtcactgaaccacaccatatttggccctccctctcggatgatcaatggatgaaggttgaagtggctttgagagatttgattttatctgattatgcaaagaagaacaatgtcaatacatccgctctgacacagtccgaaattcgtgatatcatccttggagctgagattactcccccttcacagcagcgacagcaaattgcagagatagagaaacaggctaaggaagcaagtcagctgacggcagtcactacaagaacaacaaatgtacatggtgatgaattgatagtcacaaccacaagtccatatgagcagtctacatatgctgctaaaactgactggcgtgtgagagcaatctctgcaacaaatctctatcttcgagtgaatcacatatatgttaattcggaggatataaaggagaccggatatacttacatcatgccaaagaacattttgaagaagttcatatgcatcgcggacttgcggacacaaattgcaggatatttgtatggagtaagccctccagacaatcctcaggttaaggagattcgatgtattgctatgccaccacagtggggaacgacccagctagtgaatctcccgtcagcccttcccgagcatgacttcctaaatgatttggagcctctgggatggatgcatacacaaccaaacgaacttccgcaattgtcacctcaggatttgactagccatgctcgaatcttagaaaacaacaggcagtgggatggagagaagtgcataattctaacttgcagctttacaccagggtcgtgctctttgacagcatacaagctgtcaccatcaggttatgaatggggtcgggccaacaaggataatggaagcaatccacacggttacttgccaacacattatgagaaagtccagatgctcttgagtgatcgcttcctcggtttctacatggtaccagataatggtccatggaattataacttcatgggagtaaaacacacgataagcatgaggtacggtgtgaagctaggtgcaccgagggagttctatcatgaggatcacaggccaacacatttcctcgagttcagcaacttggaagagggtgacactgcagaaggagaccgcgaggatacattctcataatttccaatatccgacctcttctgttctgtctgagatgggacagtggattatctttcgggttgacagctcttagtttgttattttggtattttgtaaatttttggtagtctaactttgttattaggttgtaagtagtttgttagtaagtcgtggtgttaag

SEQ ID NO: 954 - DNA, 7547 bp, Gossypium hirsutum
cactctcttcgcagagggaggagaaaaagtaagataaacccaaacgccagccctccaaaaccctaatttcaaaatcattttcatcgaacgaagttcgaaatcctcttcggtttcttccttcaagcttgcattggggtcgttagagtatatatttatcggccaaagttgtcatgtggaacaacaataataacaacgctcagatagcgccgccgggaaccgggggatccaccatcccaccgcctccagctgcccagccttcgtacacggttctagctccgcatatgactccgcaggaagcagaggcgaagctggaggagaaggctcggaaatggatgcaacttaactctaaacggtatggggataagaggaaatttggtttgtcgagacgcagaaggaggatatgcctcctgagcacgtcaggaagattatcagagaccatggggacatgtcttcaaaaaatatcgccatgataaacgtgtgtatcttggagcccttaaattcattcctcatgcagtttacaagctccttgagaatatgccaatgccttgggaacaggttcgagatgtgaaggttttgtaccatattacaggagcaatcacgtttgtgaatgaaataccgtgggttgctgaaccaatctatttagcacagtggggttcaatgtggatcatgatgcgaagggagaaaagagatcgtcgtcatttcaagagaatgcggtttccaccatttgatgatgaggagcctccattagactatgctgataatctgttagatgttgatcctctagagccgattcagttagagctggatgaagaagaagattctgctgtgtacgcttggttttatgaccataagcctcttgtaaaaacaaagcttatcaatggcccgagttacaggaaatggcatctttctcttccaattatggccactttgcaccggcttgctggacaacttctttctgatttgattgaccgtaattatttctacttgtttgacatggagtcattcttcacagctaaagcattaaacatgtgcatacctggtggtcctaagtttgaaccattataccgtgatatggagaaaggggatgaggactggaatgaatttaatgacataaacaaactcattatccggtcacctcttaggacagagtatcgaattgctttccctcatctttataacaatagaccaggaaagtaaagctttgtgtgtatcatactcccatggtcatgtacattaaaacagaagaccctgatttaccggcattctattatgatcctttgatacaccctataactgccacaaacaaggagcgacgagaaaagaaagtttatgatgacgaggacgaagatgattttgtcttgcctgaaggggtggaacctttgctgagtgacacacagctttacaccgatactactgctgctgggatttctcttttatttgctccacgcccttttaatatgagatctggtcgggtgcgacgtgctgaagatataccacttgtgtcagactggtacaaggagcactgtcctccatcttaccccgttaaagtgcgggttagttatcagaaattattgaaatgctttgtgctgaatgagttgcatcatagaccacctaaggctcaaaagaagaagcacttgttccggtctctccaggcgaccaagtttttccagacgacagagcttgattgggttgaagcaggtcttcaagtttgcaagcaagggtacaacatgttgaacctgttgatacataggaaaaatttgaactaccttcacctggattataacttcaacttgaagcctgtgaagactctcactacaaaagagcgcaagaagtcacgttttggcaatgcttttcatctttgtcgtgagattttgcgtttaacaaagcttgtggttgatgctaatgttcagtttcgacttggtaatgttgatgctttccaattggccgatggtctgcagtatacattttcccatgttggtcagttgactgggatgtaccgttacaagtaccggctcatgagacagattaggatgtgcaaagacttgaaacacttaatttattatcgcttcaacactgggccagtggggaaaggacctggatgtggattttgggcaccaatgtggagggtatggctctttttccttcgtggcattgtccctcttctagaaaggtggttaggaaatctgcttgcacgtcaatttgaagggcgtcattcaaaaggagtagccaagactgttaccaagcaacgtgttgagagccactttgatctggaacttcgagctgctgtcatgcatgatgttcttgatgccatgccagagggcattaagcaaaataaagctagaacaatattgcagcatctgagtgaggcatggcgctgttggaaggcaaacatcccatggaaggttccgggtttgccagttcccattgagaatatgattcttagatatgtcaagtcaaaagctgattggtggacaaatgttgctcattacaatcgtgagcgtatcagaaggggtgcaactgttgataaaacagtttgtaggaaaaacttaggcagattgacacgactctggctgaaagctgagcaggaacgacagcacaattatttgaaagatgggccatatgtcactccagaagaggcggttgcgatctatactacaactgtgcattggttggagtccagaaaattctcgcccattccatttcctcccttgtcttacaagcacgatacgaagttacttatccttgccctggagaggttgaaggaatcttacagtgtagctgtaagattaaatcaactccaaagagaagaattgggtctaattgaacaagcttatgataatcctcacgaggccttatcaaggatcaagcgccatttgcttacccagcgtgccttcaaagaagttggtatagagttcatggacttgtacagctatttgattccagtctatgaaattgagccccttgagaagattacagatgcttatcttgaccaatacctatggtatgaaggagacaagcgccatctgtttcctaattggattaagcctgcagattcagagccacctccacttttggtttacaaatggtgtcaaggtataaataatttgcaagggatatgggacacgagtgaggggcagtgtgtggtaatgcttcaaacaaaatttgagaagttctttgacaagattgacctgacaatgttaaacaggcttctacgattggttcttgatcacaacattgcagattatgttactgcaaagaataatgtggtgctgtcttacaaagatatgagccacacaaattcgtatggtcttatacgtggtcttcagtttgcttctttcgttgtccagtattatggacttgttctggatctcttgcttcttggattgactcgtgctagtgagattgctggtccaccccagatgccgaatgaattcatcacatactgggatacaaaagttgaaacccggcatccaattcgtctgtactctaggtacattgatagggtgcacatattgttcagatttactcatgaagaagcacgggaccttatccagcgatatcttactgagcaccctgatccgaacaatgaaaacatggttggatataacaacaagaaatgctggccaagagatgcgagaatgaggcttatgaaacatgatgttaatcttgggagaagtgtcttttgggacatgaagaatcgtctgcctagaagcatcactactttggaatgggagaacagctttgtttctgtctacagcaaggataatccgaaccttctttttagcatgtgtggttttgaagtccggatacttccaaaaataagaatgactcaagaagcgtttagcaatacaagagatggggtttggaatctgcagaatgaacagacaaaggagcgaactgcagttgctttcttacgggttgatgatgagcacatgaaggtgtttgagaatcgtgttaggcagattctcatgtcttctggatcaacaacatttacaaagatagtcaacaaatggaatactgccttaataggtcttatgacttacttccgtgaagcaactgtgcatacacaagagcttctagatctactcgttaaatgtgaaaataaaattcaaacccgtatcaagattggactgaattcaaaaatgcctagtcgattccctcctgtaattttttacactcctaaagagattggaggacttggcatgttatccatgggtcacatattgattccgcagagtgatctccggtacagtcagcagactgatgttggcgtaactcactttaggagtggaatgagtcatgaagaggaccaactgattcctaatctttatcggtacatacagccatgggagagtgagttcatagactcacagcgtgtttgggctgagtatgctctgaagaggcaggaagcacaggcacaaaataggcgcctaacccttgaggatttggaagattcatgggataggggaataccacgtataaataccttgtttcagaaggacaggcacacattagcatatgacaaaggatggagagtacgtacagactttaagcagtaccaagttttgaagcagaacccattctggtggactcaccaaaggcatgatggcaaattgtggaacttgaacaactatcgaactgatgttatccaagctcttggaggtgttgagggaattctagaacataccttgtttaaaggaacatactttccaacttgggagggtctgttttgggaaaaggcttcaggattcgaggagtcaatgaagtataagaagctcactaatgctcagagatctggtcttaaccagattcctaaccgtaggtttactctttggtggtcacctacaatcaaccgggctaatgtttacgtgggttttcaagtgcaactagatctaactggaattttcatgcatgggaagattccaaccttgaaaatatctttgattcagattttccgtgcccatctgtggcaaaaaaattcatgagagtgtggttatggatctttgccaagtcttagatcaggagttggatgctttagaaattgaaactgttcagaaggaaacaatccatccaaggaaaagttacaagatgaacagctcttgtgcggatattcttctctttgcagctcataggtggcctatgtcaaagcctagtcttgtggcagagtccaaggacatgtttgatcaaaaagcaagcaataaatattggatagatgtgcagctccggtggggtgattatgactcgcatgatattgagcgttacactcgagccaaatttatggactatacaacagataacatgtctatttatccatctcccactggggtaatgattggccttgatctggcttacaacttgcattctgcatttggtaattggttccctggttcaaagccattgctcgctcaggcaatgaataagatcatgaagtcaaatccagctttatatgtcttaagggagaggataaggaaaggtttgcagttatattcttctgagcctactgagccgtatctgtcatcccagaactatggggagatcttcagcaaccagatcatttggtttgttgatgacaccaatgtgtatcgtgtgacaatacataagacatttgaagggaatctcacgacaaaacccattaatggtgccatctttattttcaatccacggactggacagttgttcctaaaggtcattcacaccagtgtctgggcaggtcaaaagcgtcttggtcagcttgccaaatggaaaactgctgaagaagttgctgctcttgtgcggtctttgcctgttgaagaacaaccaaagcagatcattgttactcgaaagggaatgcttgatcctttggaggttcacttactggatttccctaacatagttatcaagggaagtgagctgcaactcccattccaggcttgcttgaaaattgagaaatttggtgatctaattctgaaagctacagagccacaaatggttttgttcaacatctatgatgactggttgaagagtatctcatcatacactgcattctcccgactcattctgatccttcgtgcgcttcacgtgaacaatgagaaggctaagatgttactgaaacctgataagacaatcgttactgagcctcaccatatttggccttctctaactgatgatcaatggatgaaggtcgaagttgctttaagagatctgatactttccgactatgccaaaaagaacaatgtgaatacatcagccctgacacagtctgagattcgtgacatcatccttggagctgagattactccaccctctcaacagaggcagcagatagcagagattgagaaacaggcgaaggaggcaagccagctaacagctgtgacaactaggactacaaacgtgcatggtgatgagctcattgtcaccaccacaagtccctatgaacaagcagcatttgggtccaagacagattggcgtgttagagcaatatcagctactaatctttatcttcgagtcaatcatatatatgtgaactcagaggacataaaggaaactgggttcacatatatcatgccaaagaacattttaaagaagttcatctgtatagcagatctcaggactcaaattgctggatacttgtatggaataagccctcctgataatccccaggttaaggaaatccgatgcattgccatgccaccgcaatggggtactcatcagcaagtcaatcttccatcagctcttcctgaacatgatttcttgaatgatctggagcctttgggatggctccacacacagccaaatgagcttcctcaattatcgccacaggatgtgacatcccattctcggatattagagaataacaaacagtgggatggagagaagtgcataatcttgacatgcagtttcactcccggttcttgctcattaacagcctacaagcttaccccaagtggttatgagtggggacgggttaacaaagatacaggaagcaaccctcatggttacctcccaacgcattatgagaaggtgcagatgctcctaagtgatcggttccttggattttatatgatacctgacaatggtccgtggaattacaatttcatgggagtgaagcatacagtgagcatgaaatacggggtgaagctggggacaccgaaagagtactacaatgaggagcataggccgacacatttcctggagttcagcaacttggaagaaggtgatactgcggaaggagatcgggaggatacttttacttaaatccctaaatctgtttttaccaaagactccaaatcctacaatgtatgaaatgaaggaaaaagaatatttgcattgcatactcgttttagtgctgaacccgcaacatggatagaggaggcttaaagcttgtttgttgaatagttgcatgtactaaatcccaattgtaagaatgctttttggagttgtaaatatgagtaagaactaggatttgaatatgttcttcaatgttctaacacctcaaatgttggggtaaacacaatatgtgcccaagaagctctgctcaggttaggtttcaatagtaacagacttatttg

SEQ ID NO: 955 - DNA, 6967 bp, Medicago truncatula
ggatcatggcgatatgtcctctaagaaatttcgtcacgacaagcgtgtgtatcttggagcactgaagtttataccacatgctgtttataagctcctggaaaatatgcctatgccttgggagcaggttcgagatgtgagggtcttgtaccatatttctggtgcgatcacttttgtcaacgaaataccgtgggttgttgagcccatttatcttgctcagtggggtacaatgtggataatgatgagaagggagaaaagggatcgtcgtcattttaagaggatgaggtttcctccatttgatgatgaggagcctccacttgactatgctgataatctcttagatgttgatcctctagagccgattcagctggagcttgacgaagaggaagattctgccgtgtatacttggttttatgatcataagcctcttgtgaaaacaaagcttataaatggtcctagttaccgaaaatggcatctttctcttcctataatggcaactttgcatcggcttgctgggcagcttctgtctgatctaagtgacagaaattatttctacttgtttgacatggagtccttttttacagcaaaggctttgaacatgtgcatacctggtgggcctaaatttgagcctctctaccgtgatatggagaaaggagatgaagactggaacgagtttaatgacatcaacaaactcattataaggtctccacttcggacagaatatagaatcgcctttccccatctttataacaacaggcctcgtaaagtaaggctttgtatttaccatacacccatggttatgtacataaaaactgaagatcccgatctacctgcattttattatgatcccttgatacacccaataaccagtgctaacaaagagcggcgggagaagaaaatctatgatgaggaggatgatgatgactgggtccttccagatggtgttgagccttttcttaaagatacacaactttataccgacaccacagctgctggaatttccttgctttttgctcctcgtccttttaacatgagatctggccgcatgaggcgtgcagaagacattcctcttgtgtcggaatggtacaaggagcattgtcctccttcatatccagttaaagtccgagttagttatcaaaaattgctcaagtgttttgtgttgaatgagctgcatcacagacctcccaaggctcaaaaaaagaaacacttattcagatcacttcaagcaacaaagtttttccagaccacagaacttgattgggttgaagcaggtcttcaagtctgtcgacaggggtacaatatgttgaatctgttaattcacaggaaaaatttgaactatcttcaccttgattataatttcaatttaaagcctgtcaaaaccttgactacaaaagagcgtaagaaatcacgatttggtaatgcttttcatctttgccgtgagatccttcgtttgacaaaacttgtggtggatgccaatgttcagttccgtttgggtaacgttgatgctttccagctggcagatggcctccaatatactttctctcatgttggtcaattgaccggtatgtatcgttacaaatataggcttatgcggcaaattaggatgtgtaaagatttgaagcacttgatttactaccgtttcaacactggtcctgtcgggaagggaccaggctgtgggttttgggcaccaatgtggagggtttggttattctttcttcgtggtattgtgccccttcttgaacgatggcttggaaatttacttgcacggcagtttgagggacgtcattctaaaggagtggccaagaccgttactaagcagcgtgttgagagtcatttcgacttagagcttcgggcagctgttatgcatgatgtgcttgatgctatgccagagggtataaagcagaataaggcaagaactatattgcagcatttgagtgaagcttggcgatgctggaaggcaaatattccttggaaggttcctggtctgcctgttcccatagagaacatgatccttcgatatgtgaagtcaaaagcagattggtggacaaatgttgctcattataatcgtgaacgtataagaagaggtgcaactgttgataagacggtttgtcgcaagaatcttggaagattgacacgtctttggctgaaggcagaacaggagcgccaacacaattatttgaaagatggcccatatgttactcctgaagaagctgttgctatctacacaactacagtccattggttggaatctaggaagttctcccctattccatttccacctctatcatacaagcatgatacaaagttgcttatccttgcacttgagaggttgaaggaatcctacagcgttgcagtaagattaaatcaactgcaaagagaggagttagggctgattgaacaagcttatgataatccacacgaggcattatcgcgaatcaagcggcacctcctcacccaacgcgccttcaaagaggttggaatagagtttatggatttatatagctacttgattccggtttatgagatagagcctcttgagaaaattacagatgcatatcttgatcaatatctgtggtatgaaggcgacaaacgtcatctctttcccaactggatcaagcctgcagattctgagccaccgcctcttctggtttacaaatggtgtcaaggtatcaataatttgcaaagtgtctgggacaccagcgatggtcagtgcgttgtgatgctgcagaccaagtttgagaaatttttcgagaagattgatttaacaatgttaaataggcttctccgtttggttctagaccacaacattgctgattatgtcacggcaaaaaacaatgttgtgctgtcatataaggacatgagccacacaaattcatatggtcttatacgtggactgcagtttgcatcttttgttgttcaatattacggcttagtattggatcttttgcttcttggattgactcgagcaagtgagattgctggtccaccgcagatgcctaacgagtttattacttattgggacaccaaagtggagaccaggcatccaattcggctgtattctcgatacatagaccgagttcacatcttatttcgcttcacacatgaggaggcccgggatctcattcagcgatatctcaccgagcatcctgatcctaacaatgagaacatggtggggtacaataataagaagtgttggccaagagatgcaagaatgaggctcatgaagcatgatgtgaatcttgggaggagtgtcttttgggatatgaagaatcgtcttcctagaagcatcacaactctggaatgggaaaacagctttgtttctgtttatagcaaggataatccaaacttgctttttagcatgtgtggatttgaagtgaggatacttccaaaaattagaatgactcaagaagcattcagtaacacaagagatggtgtctggaatctccagaatgaacagacaaaagaaagaacagctgttgccttcttaagagttgacgatgaacacatgaaggtgtttgagaatcgtgtgagacagattcttatgtcttcgggttctactacattcacaaaaattgtcaataagtggaatacagctttaataggactcatgacttatttccgagaggcaactgtacacactcaagagctgttggatttgcttgttaaatgtgaaaataaaattcagactcgtatcaagattggactcaactcaaagatgcctagcaggtttccacctgtcattttctacaccccaaaggaaattggaggacttggaatgttgtctatgggtcacattttgattccacaaagtgatctacggtacagtcagcagacagatgttggtgtaacccactttagaagtggtatgagtcacgaggaggaccagttgattcccaatctttatcgctatatacagccttgggagagtgagtttgttgattcacagcgtgtctgggctgaatatgcattgaaaaggcaggaagcacaagcacaaaatagacgcttgacccttgaggatttggaagactcatgggacagaggaataccacgtatcaacactttgtttcagaaggatagacacactttggcttatgataaaggatggagggtgcgtacagacttcaagcaatatcaagttctaaaacaaaatcccttctggtggacacaccagaggcacgatgggaagttgtggaacttgaataattaccgaactgatgttattcaagcccttgggggagttgaaggaattcttgaacacacattattcaaaggaacatattttccaacttgggagggtctcttctgggaaaaggcatcaggttttgaggaatctatgaagtataagaagctcaccaatgcacagagatctggtctcaaccagatacccaaccgtagatttacactgtggtggtcaccaaccattaaccgagccaatgtttatgttggtttccaagtgcaacttgatctgactggtattttcatgcatgggaaaattccaactttgaagatatctcttatccagatattcagagctcacttgtggcagaagatccatgagagtgttgtcatggatctttgtcaggttttggatcaagagttggacgctttggagattgagactgtccagaaggaaacaatccatcctaggaaaagttacaaaatgaacagttcttgtgccgacatccttctctttgctgcccacagatggccaatgtcaaagcctagtcttgtagctgaatctaaggatgtttttgatcagaaagcaagcaataagtactggattgatgttcagctaagatggggtgattatgattctcacgacattgagcgttatacccgggccaaatttatggattacacaacagataatatgtctatatacccatctcctactggggttatgattggccttgatttggcatataacctgcattctgcatttgggaattggttccctggatcaaagccactacttcagcaggccatgaataagattatgaagtcaaatcctgcattgtatgttttgagggaacgcatcaggaaaggtttgcagttgtactcttctgagcccactgaaccatatttgtcttcccaaaactatggagagatattcagcaaccaaatcatatggtttgttgatgacactaatgtgtatcgggttacaattcataagacttttgaaggaaatcttacaacaaaacccatcaatggtgccatttttattttcaatccaaggactggacagttgtttcttaaggttattcatacgagtgtatgggctggtcaaaagcgtcttggccaactggctaagtggaaaacagcagaagaagttgcagctctagtaaggtctttgcctgtagaagagcagcccaagcagattattgttactcgtaaaggaatgttggacccattggaggttcacttgctggatttccccaatattgttatcaaaggaagtgagctgcagcttcctttccaagcttgtttgaaaattgagaaatttggggatctcattttgaaggccacagaaccacaaatggttttattcaacatttatgatgactggctgaagagcatttcctcatacactgcattctccaggctgattctgattctgcgtgcacttcatgtgaataatgaaaaggcgaagatgttactgaagcctgacaaaactatcgtcactgaacctcatcacatctggccttctctaagtgatgaccagtggatgaaggtggaggttgcattaagagatctcatactttctgattatgcaaagaaaaacaacgtgaatacttctgctttgactcagtctgagattcgtgatattatactcggggctgagattactccaccttcacaacagcggcaacagattgcagagattgaaaaacagtcacatgaagcaaaccaggtgacagctgtaacaacaaggaccacaaatgttcacggtgaagaacttattgtgaccaccactagtccctacgagcaaggtgcttttgcttcgaagactgattggcgtgtcagagcaatatcagccacaaatttataccttcgagtaaaccacatatatgtgaactccgaggatataaaggaaacgggctatacctatatcatgccaaagaacattttgaaaaagtttatatgcatagctgatcttcgaacacagatttctgggtacttgtatggtataagtcctcctgacaatcctcaggttaaggaaatccggtgcattgtgatgccaccacaatgggggactcatcaacaagtacatctcccatcagctctcccagagcatgatttcttgaatgatttggaacctttgggatggatgcatactcaaccaaatgaacttccacagctggcgcctcaggatctcacttcacatgccaaggtcctagagaacaataaacaatgggatggggagaagtgtattatcttgacttgcagttttactccgggttcatgttctttaactgcatataaactgacgccatctggttatgaatggggacgtattaacaaggatactggaagcaacccgcatggttaccttcccactcattatgagaaggttcagatgctcctcagtgatcgcttccttggtttctacatgattcctgataatggtccatggaattacaacttcatgggagtgaggcatgcatcggggatgaagtatggagtgaagcttgggacccctagggagtattaccacgaagatcatagaccaactcatttcttagagttcagcaatatggaggaaggggagacaattaccgagggagatcgagaggatacattctcttaagatataaattgttcagtttatcttgagatacaaaacaagtggcagatcctttaatttttgaaacttatcataagatgttgtattgtctattgtaatgtacgctctgatgattttgtagcaaaagtatcaaagttttgtaaataataattacagtcagtcagg

SEQ ID NO: 956 - DNA, 7677 bp, Amsonia hubrichtii
ttcgggagagtttactgctcaaaaaccctaacctcagtgagaaaaccccatacgaatctgataacattaacacgattcagtttagtcattcaggaatcattaattttcagcttgaatgagttaggcttttgtattttgtatatattttgaaggatgtggagcggtaattcacaagaaatgtggggcgggaattcacaagatatgtggagtaacagtgctaacggaggcaatggtgggaatatgccaccaatagctcctcccggtaccagtggaattatgccgccggggacaagcggtgcaggtggtgcgggacccagtggcccgactcctcctccgccaccaccgccttcatatacggttttgccaactgaggcgcagctcgaggagaaagctaggaagtggatgcaacttaattccaagcggtatagtgataagaggaagtttggctttgttgaaactcagaaggaagatatgcctccagagcatgttaggaagattatcagggatcatggggacatgtcatccaaaaaatatcgccatgacaaacgtgtgtatctgggagcattaaagtttgtgcctcatgctgtttacaagctccttgagaacatgccgatgccttgggagcaggtccgtgatgtgaaggtcctgtaccatattactggtgctattacatttgtgaatgaaataccatgggtggttgaaccaatctatctagcacagtggggtacaatgtggattatgatgcgaagggagaagagggatagacgacatttcaagaggatgcggttccctccttttgatgatgaggaacctccattggattatgctgataatcttctagatgtggatccattggagccaatccagctagagttggatgaggaagaagattctgctgtatatacttggttttatgatcataagccattggtgaaaactaagcttattaatggtcctagctataggaaatggcatttatcccttcccatcatggcaacactacaccgtcttgctggacaacttctttccgatctgattgatcgtaactacttctacttgtttgatatggagtcattttttacagctaaagcacttaatatgtgcatacctggtggtcccaagttcgaacctttgtatcgagacatggagaagggtgatgaagattggaatgagtttaatgatatcaacaaacttatcattaggtcacctctgaggacagaatacaggattgcatttcctcatttgtataataataggcctcggaaagtgaagcttggagtttatcataccccaatggttatgtatataaaaacggaggatcctgatctacctgcattttattatgatcctctcattcaccccataaccagcacgaataaggacaggcgagagaagaaaaattatgaagaggatgacgatgatgatttttctttgcctgaaggggtagaaccattgctaaaaaatgttccaatctacactgatactacagctgctggtatttctcttttgtttgcaccacgtcctttcaacatgagatctggtcggatgcgtcgtgctgaagacatacctcttgtttcagagtggtacaaggaacactgtcctccatcatatcctgtcaaagttcgtgttagttaccagaaactgttgaaatgctttgtgttaaatgaactgcatcacaggccaccaaaggctcagaaaaagaagcatctgtttcggtctcttgcagctacaaagttcttccaaactacagagcttgattgggctgaagctggtcttcaagtttgtaaacaagggtacaatatgctgaatttgttaattcaccgaaagaatctgaattatcttcatcttgattacaatttcaacttgaaacctgtgaagactctcactaccaaggaacgtaagaagtctcgttttggtaatgcttttcatctctgccgtgagattctccggttgacaaagctggtagttgatgcaaatatccagttccgtttgggtaatgtggatgcatttcagttggcagatggcctgcaatatatattttcccatgttggccagttgacaggtatgtacaggtacaaatacaggctcatgcggcaaatcagaatgtgcaaagatttgaagcacttgatttattaccggtttaacacgggaccagttggcaaaggacctggatgtggtttctgggctcctatgtggcgggtttggttgttcttccttcgtggcatagtgcctttactagagcggtggttgggaaatttacttgcaaggcaatttgaggggcgacactctaagggggttgctaaaactgttactaaacagcgtgttgagagccactttgatctagaacttcgtgctgctgtaatgcacgatgtacttgatgctatgccagaaggtatcaagcagaataaagcaagaacaatcttgcagcatttgagtgaagcatggcgttgttggaaagcaaatattccatggaaggtgccaggtttacctgttccaatcgagaacatgatccttcggtatgtgaaatcaaaggctgattggtggacaaatgttgctcattataatcgtgaacgaataaggagaggtgctacagtggacaaaacagtgtgccgaaagaaccttgggagattgacccgtctttggctgaaagcagaacaagagcgtcaacataactacttgaaggatggtccgtatgttacacctgaagaagcagttgcaatttacacaaccactgtgcactggttggaatcaaggaagttttcacccattccgttccctccactgtcatataagcatgacacaaagcttctcattcttgcacttgagaggttgaaagaatcttacagtgtggctgtgaggctaaatcaattgcaaagggaagagcttggtctcattgaacaagcttatgataatccacatgaggctttatcaaggattaagcggcatctcctcacccaacgtgcctttaaagaagttggtattgagttcatggatttgtacagttatcttattcctgtttatgagattgaaccgcttgaaaagattacagatgcttatttggaccagtatctttggtatgaaggtgacaaacggcatctgtttccaaactggataaaacctgcagattctgagccaccaccattgttggtctataaatggtgtcagggtataaataacttacaagggatatgggacacgagtgaaggacagtgtgttgtgatgcttcaaacaaaatttgagaaattctttgaaaagattgatttgaccatgctaaacaggctcctgcgactggtacttgatcacaatatagctgattatgtcacagccaagaacaatgttgtgctgtcatacaaggacatgagccatactaattcgtatgggcttattcgtggtcttcaatttgcatcttttgttgtacagtactatggactagtactagatcttttgcttcttggcttgactcgggccagtgaaattgctggtcctccacagatgccaaatgagttcattacatattgggacactaaagtagaaacaaggcatcccataagactctattccagatacatagataaggtgcacatattgtttcgcttcactcatgaagaagcgagagatctcatccagcggtatcttactgagcatccggatcccaacaatgagaatatggttggttataacaacaagaagtgctggccgagagatgctcgaatgaggcttatgaagcacgatgtgaatcttgggagaagtgtcttctgggacatgaaaaaccggcttccaagaagtatcacgactttggagtgggaaaatagctttgtgtctgtctacagcaaagacaatcctaacttgctcttcagtatgtctggatttgaggttcgtatactaccaaagattagaatgactcaagaagcattcagcaatacaagagatggagtttggaacctgcagaatgaacagaccaaagagcgcactgctgttgccttcttgcgagttgatgacgaacacatgaaagtgtttgagaatcgtgttaggcagattctcatgtcttcaggttctactacatttacgaagattgttaacaaatggaatacagctttaataggtctcatgacatatttccgggaagcaacagtgcatacccaagaattgttggatttgctggtcaaatgtgaaaataagattcaaacacgtattaagattggattaaattctaaaatgccaagcaggttccctcctgttattttttacacaccaaaggaaattggaggtctgggaatgttgtcaatgggtcacatattgattccacagagtgacctccggtatagtcaacagacagatgtgggtgtgacacatttcaggagtggaatgagtcatgaagaggaccagttgataccaaatctttatcgctacatacaaccatgggaaagcgagttcattgattcccagcgagtttgggcagaatatgcattaaagagacaggaagcgcaggcacagaataggcgtttaacactcgaagatcttgaggattcttgggatcgtgggatacctcgaatcaacactttgttccagaaggatcgacacacccttgcatatgataaaggatggagggtgaggacagatttcaagcagtatcaagttcttaaacagaatccgttctggtggacccaccagaggcatgatgggaagctgtggaacttgaataactataggacagatgttattcaagctttgggaggtgttgaaggaattttggagcatacattatttaaaggaacatactttcctacttgggagggtcttttctgggagaaggcttcaggttttgaagaatccatgaagtacaagaaattgactaatgcacaaagatctgggctcaaccaaattcctaaccgtaggtttacactttggtggtcacctaccataaatcgagccaatgtctatgttggtttccaagtgcagttggatttaactgggatatttatgcacggaaagataccaactctcaagatatctttaattcagatattccgtgcacacttgtggcaaaagatacatgagagtgttgtcatggatctttgccaggtcttagatcaagaacttgatgcattggaaattgagactgttcaaaaagaaactattcatccaagaaagagttacaaaatgaacagttcctgcgctgacattctcctgtttgcagcccatagatggcctatgtcaaaacctagtcttgttgctgagtcaaaagatgtttttgatcaaaaggccagcaacaagtattggattgatgtgcagctacgatggggtgactatgactctcatgatatagaacggtacacgagggcaaagttcatggattatacgacagacaacatgtcgatttacccgtcacccactggggtgatgattggcattgatcttgcttacaacttgcattctgccttcggaaattggttcccggggtcaaaaccattgcttgctcaggctatgaacaagattatgaagtctaacccagcattatatgttctgagggagcggataaggaaagggttgcagttgtattcttcagaacctacagaaccttatttgtcatctcagaactatggtgaaattttcagtaatcagattatttggtttgttgatgacacaaatgtgtatcgtgtcactatacacaaaacttttgaaggaaatcttacaacaaaacccatcaatggtgcaatatttatcttcaatcccaggacagggcagctctttcttaaggtgattcacacgagtgtctgggctgggcagaagcgtcttggtcagctggccaagtggaaaactgctgaggaggtagctgctctggtgcggtctttacctgttgaagaacaaccgaaacaaatcattgttactcgtaaaggcatgttagatcccttggaggttcacttgcttgattttcctaacatagtcatcaagggcagtgagctccaactgcctttccaagcatgcttgaagattgagaaatttggtgatctgatattgaaagccacagagccgcaaatggttctattcaacatttatgatgattggctgaagagtatatcatcatatactgctttctcgaggctcattttgattttacgtgcgctacatgtgaataatgagaaggcaaaaatggtgctcaagcccgacaaatctgttgttactgaaccacaccatatttggccttctctcacagatgatcaatggatgaaggttgaggtggcattgagggatttgattttatctgattatgcaaagaagaataatgtcaatacatcggcactgactcagtcagaaattcgtgatatcatccttggagctgaaatcactccgccatcgcagcagcggcagcaaattgcagagatagagaaacaagctaaggaggcaagtcagctgacagcagtgactacaagaacaacaaatgtgcatggtgatgaactgatagtcactactacaagtccgtacgagcagtctacatatgcatctaaaactgactggcgtgttagagcaatttctgccacaaatctttatctccgagtgaatcacatatatgtcaattcagaggatataaaggagactggctttacctacattatgcccaagaatattttgaagaagttcatatgcattgcagacttgaggactcaaattgcaggatacttgtatggcataagccctccagataacccacaggttaaggagattcgatgtattgccatgccgccacagtggggaacacatcagcaagtgaatctgccatcagctcttcctgagcatgacttcctaaatgatttggagcctctaggatggatgcatactcaaccaaatgaacttccacaattgtcacctcaggatttgacaagccatgctcggatcttagaaaacaacaagcagtgggatggagagaagtgcatagttctgacttgcagctttacaccagggtcatgctctttgacggcatataagctgacaccatcggggtatgagtggggacgggccaacaaagatacaggaagcaatccgcatggttacttgccaacacattacgagaaggtccagatgctcctgagtgatcgtttccttggtttctacatgatcccagataatggtccatggaattataattttatgggagtaaaacatacagtaagcatgaggtatggagtcaagctaggaaccccaagggagtactatcatgaggatcacaggccaacacatttcctcgagttcagcaacttggaagagggtgagactgcggaaggggaccgcgaagatacattctcgtaaagtccagtatccacccttttctggctgtgaccggctgtagaagatctttcttgtttcagatccaagtttttttttttggtccgactcctacctctctgcaattactttgtacttagataaattgttctgacctgtgcattagaaggcttttgacattgtaaatatgttatcaaatctgtagaatatgattctcctttatacatgattagctaccgtgacatgcatgtcccccactaaaaacaacaaaaaggttagggtgtgcggttttattttgtagtacatcttccttcgtttaccttgctgttgttgtcgattatactttgctgtttgatgagagctttggttaatcttcttcggagtaaagggcacggt

SEQ ID NO: 957 - DNA, 6228 bp, Euphorbia peplus
ttaattcaccctataacctccattaacaaggaacgtcgtgagagagactcatgatgatgatgaggatgatcgattttcttccagcctgaaggagttgaaccattgctggaagaaactcagctttatacagacaccacagctgctggcatttcactgttgttgctccaaggcctttcaacatgagatcaggtcgtatgcgacgagctgaagatatacccctcgtgtctgagtggtataaggagcattgtcctccatcttatccggtgaaagttagggtgagctatcagaagttgttgaaatgttttgttttaaatgaactgcatcatcgaccgcccaaagcacagaaaaagaagcatttgtttcggtcgctagcagcaaccaagttcttccaaactactgaacttgattgggccgaagcaggattgcaagtttgtaagcaggggtacaatatgttgaatctgttgattcacaggaaaaatttgaactacctccatcttgattacaattttaaccttaagcctgtgaaaacacttactacaaaggagcgcaagaaatcacgatttggtaatgcttttcatctgtgccgtgagattctgcgtttgacaaaacttgtggtggatgcaaatatccagtttcgtctgggtaatgttgatgcattccaattggctgatggtttgcaatacatattttctcatgttggccagttgactggaatgtatcggtacaagtacaggctgatgcgacagattcgaatgtgcaaagacttgaagcatctgatatattaccgcttcaacactggtccagttggtaaaggacctggatgtggattttgggcaccaatgtggagggtatggctgtttttttacgtggtattgtgcctcttctagaacgttggttaggaaatcttcttgcccggcaatttgaagggcgccattcaaaaggcactgcaaagactgttactaagcaacgtgttgagagccactttgacctggagctccgtgctgctgtaatgcatgacgttcttgatgctatgccagagggtatcaagcaaaataaagctagaaccatattgcagcaccttagcgaggcttggcgttgctggaaggcgaatattccctggaaggttcctggtttacctgttcctattgaaaatatgattcttcgttacgtcaagtcaaaagcagactggtggacaaatgttgctcactacaatcgtgagcgtataaggagaggagcaactgttgataagacagtttgccgaaaaaatcttggaagattgactcgcctttggctcaaggctgaacaggagcgtcaacataactatttgaaagatggtccatatgtcaccccagaagaagcagttgctatttatacgacaactgtgcattggctcgagtccaggaagttctccccaattccatttcctcctttatcatacaagcatgatactaagctgcttatccttgcactggaaaggttaaaagaatcatacagtgtagctgtgagattaaatcaacttcaaagggaagagttgggtcttattgaacaggcatatgataatccacatgaagctttgtcaagaatcaagcgtcacctgcttactcaacgtgcctttaaagaagttggaatagagttcatggatttgtacagtgctttaattccagtatatgagattgaacctcttgagaagataacagacgcttatcttgaccaatatctgtggtatgaaggtgacaagcgccacctctttccgaactggattaagcctgcagattcagagcctccaccgctgcttgtttataagtggtgtcaaggtattaacaatttgcagggtatttgggacacgagtgaagggcagtgtgttgtaatgcttcagaccaagtttgaaaagttctttgaaaagattgatttgacaatgcttaacaggcttctccgattggttcttgatcacaacatagctgattatgtcactgcaaagaacaatgttgtcttgtcttacaaagacatgagtcataccaactcatatggtttaatacgtggtctgcaatttgcctcctttgttgtccaatattatggacttgtgctggatctgctacttcttggactgactcgagctagtgagattgctggaccaccccagatgcctaatgaattcatcacttattgggatacaaaagttgagacacgacacccaattcgattgtattctaggtatattgatagggtccatataatgtttcgtttcactcatgaagaggctcgagatcttatccagcggtatctcactgagcatcctgatcccaacaatgaaaacatggttggataccagaacaagaaatgctggcccagagatgcaagaatgaggctcatgaaacacgatgttaaccttggaaggagtgtattctgggatatgaagaaccgtctccctcgaagcattactactttggagtgggagaacagctttgtttctgtttacagcaaggacaatccgaacttgctttttagcatgtgtggatttgaagttcggatactccctaaaataaggatgactcaggaggcattcagcaatacaagagacggggtctggaatttgcagaatgagcagacgaaggagcggacagctgttgctttcctacgggttgacgatgagcatatgaaggtgttcgagaatcgtgtgaggcagattcttatgtcatcagggtccactacttttaccaaaattgtcaacaaatggaatacggcccttataggtttgatgacttatttccgcgaagccactgtgcatactcaggaacttttggatttgttggttaagtgtgaaaataaaattcaaactaggatcaagattggtttgaactcgaaaatgcccagccgattccctcctgttattttctatacaccgaaagaaattggaggacttggaatgctgtcaatgggtcacatattgatcccacaaagtgaccttcgctatagccagcagacagatgttggtgtaacccatttcaggagtggaatgagtcacgaggaagaccagctaataccaaatctttaccgttacattcagccatgggagagtgaattcatagattctcagcgcgtctgggcagagtatgcccttaaaagacaagaagctcaagcacaaaataggcgtttaactcttgaagatctggaagattcttgggataggggaattccacgtatcaacacattatttcagaaggaccgtcacacactagcatatgataaaggatggagagtgcgtacagatttcaaacaatatcaagttctgaaacagaatcctttctggtggactcaccagaggcacgacggaaaattatggaacttgaacaattaccgaactgatgtcatccaagctcttggtggtgttgagggaattctggagcataccctattcaaaggaacatatttccccacttgggaaggtctcttctgggagaaagcatctggttttgaagagtcaatgaagtacaagaagcttacaaatgcacagagatctggtttgaaccagattcccaacaggagattcactctctggtggtcacctacaatcaatcgagcaaatgtgtatgttggtttccaagtgcagttggatctgactggcatctttatgcacggaaagattccaaccttgaagatctcactgattcagatattccgagctcacttgtggcagaagattcatgagagtgttgtaatggatctctgtcaagtcttggatcaggagcttgatgctctagaaattgaaactgtgcagaaggaaacaattcatccaagaaagagttacaagatgaacagctcctgtgcagacattctcctgtttgctgctcacaggtggcctatgtcaaagcctagtcttgtggccgagtcaaaagatgtctttgatcagaaggctagcaataaatactggatagatgtgcaactccgatggggtgactatgactctcatgatattgagcgatatacaagggcaaaatttatggattacacgacggataacatgtcgatatatccatctccaactggggttatgattgggcttgatctggcgtacaatttacattctgcatttggcaactggtttcctggatcaaaaccattactagctcaggcaatgaataaaataatgaagtcaaatccagctttgtatgtcttgagggagcgtataaggaaaggtttgcagttgtattcttctgagccaacagaaccatacttgtcatcccagaactatggtgagattttcagcaatcagatcatatggtttgttgatgatacaaatgtgtatcgtgtgacaatccacaagacgtttgaaggaaatcttactacaaaacccataaatggtgcaatttttatcttcaatccaagaactggccagctgtttttgaaggtcatccacaccagtgtatgggctggacagaagcgtctcggtcaactggcaaagtggaaaacagctgaagaagttgcagctcttgtccggtctttgcccgttgaagaacaacctaagcagattattgtcactcgtaaaggaatgcttgatccattggaggttcatttgcttgatttcccaaacattgttattaaaggaagtgagttacagttgccattccaggcatgcttgaaaatagagaaatttggggatctgattctgaaggcaactgaaccacagatggttctattcaatatttatgatgactggttgaagagcatttcatcttacactgcattttctagactcattttgatcctccgagcactccatgtgaataacgaaaaagcaaagatgctattgaaaccggacaaaagcattataactgagccacaccatatctggccctcactcacagacgatcaatggatgaaagttgaggttgctttgagagatctcatcctttctgactatgctaaaaagaacaacgtgaacacatcagctctgacgcaatccgagatccgtgatataattttgggagctgagatcacgcctccttcccaacaaagacaacagattgcagagattgagaaacaggccaaagaagcaagccagctcacagcagttaccacaaggaccacaaatgtccatggtgatgaacttattgtcactacaacaagtccctatgagcaaggtgcttttggttccaagacagattggcgtgtccgagcaatatcagctacaaatctctatcttcgagttaatcacatatatgtaaattcagaggatatcaaggaaactggatatacatatatcatgccgaagaacattttgaagaagttcatttgcatagcagatctgagaacccaaattgctggatacttgtatggtataagtcccccagacaaccctcaggtgaaagagatccggtgtattgcaatgccaccacaatggggcactcatcagcaagttcatttaccatcagctcttcctgaacatgatttccttaatgatctggagcctcttggatggatgcacacccaaccaaatgagcttcctcagctctcaccacaggatctgacagcacatgctcgggttttagagaacaacaagcaatgggatggggagaagtgcattatcttgacttgcagtttcactccagggtcgtgctcattaactgcttataagcttactcctagtgggtacgagtggggacgtgtgaacaaggatacaggaagcaatcctcatggttacttgccaactcattatgagaaggtccagatgttattgagtgaccgcttcctcggtttctacatgactccagataatggtccttggaactacaatttcatgggagtgaaacatacagtaagcatgaagtatggaataaagctagggacaccgagagagtactatcacgaggatcacagaccaactcactacctggaatttagcaacttggaggaaggtgacattgcagagggtgaccgggaggacacattcaactaatttgagttcattgctgttcctttttgtagttaaattttcagccagcaaactttgggtgaaagtaattgatgtagtgtttttgtacactggggatgtatatctctaactacctatgagctgtaaatatttttgctgtagaaatgaaagtccctatagattttgactagcacacttctatttttacttttctttttcacatgggcaagcaatatacttgtcttccccttcatttggataaaatttaatgttaatgacttatttctgtattgaaaatt

SEQ ID NO: 958 - DNA, 3184 bp, Pinus pinaster
aggattttgaggattcatgggacagaggcattcctcgcattaatacgctttttcaaaaagatagacacacactggcttatgacaaaggttggagggtacggacagacttcaaacagtatcaggttctgaaacaaaatccattttggtggactcatcagcgacatgatgggaaactgtggaatctgaataactatcgaacagatgttattcaggctcttggaggagtggaaggcattctggagcacactctatttaaaggaacttattccacatggaaggtctgttctgggagaaggcttctgggtttgaggagtctatgaagtataaaaagcttacaaatgcacagagatcagggttgaatcaaattcccaatcgacgatttacactttggtggtctcctaccatcaatcgtgccaatgtttatgtgggttttcaagtgcagttggatttgactggaattttcatgcatggaaaaattccaacactgaagatatcattgatacaaatatttagggctcatctgtggcagaaagtgcacgaaagtgttgtaatggatctctgccaggtacttgatcaggagctggatgctttggaaattgagactgttcaaaaagagacgatacatcccaggaaaagttacaagatgaacagctcttgcgctgatattcttctttttgcagcatataaatggccaatgtgcaagcccagccttgtggcagagtctaaggatgtttttgatcagaaggcaagtaataaatattggattgatgtgcaacttcggtggggagactatgattctcatgacattgaacggtatacgagagccaaattcttagactatacaacagataatatgtcaatttatccatcacccactggtgttatgattgcaatcgatcttgcttacaatttacattctgcatttggtaattggtttcctggttcaaagcctcttttggcccaagctatgaataaaataatgaagtcaaatcctgccttgtatgtgttaagggagcgcataagaaagggcctgcaactttattcttcggagccaacagaaccgtatttgtcatctcaaaactatggagagattttcagcaaccaaattatatggtttgtggatgatacaaatgtgtatcgtgtcacaatccataaaacttttgaaggaaatcttacaacgaagcctatcaatggagcaattttcatattcaacccgaggacagggcaactattttaaaggttatccatactagtgtgtgggcaggacagaagcgtcttggtcaactggctaaatggaagacagctgaagaagtagctgcattggtacgttcattgcctgttgaggagcagccaaaacagataattgtaactcgtaagggaatgcttgatccactggaagttcacttgctcgactttcctaacattgtcattaaggcagtgagcttcagttaccattccaagcgtgcttaaaaattgagaaatttggtgaccttattctaaaggccacagaaccgcaaatggttcttttcaatatatatgatgattggttaaagactatctcatcatacacggcattttctcgtcttatactaatccttcgtgcccttcatgtgaacaatgagaaagcaaagatgttgttgaaaccagacaagactattgttactgaggcgcaccacatttggcctagccttaatgatgaccagtggatgaaggtagaagttgctttgagagaccttatactctccgattatgccaagaagaataatgtcaatacatcagcattaacccaatcagaaatccgtgatattatacttggagctgagataactcctccttctcaacaaaggcaacagattgctgaaattgaaaagcaggcaaaggaagcaagccagctcactgcggttaccacgaggactacaaatgtgcacggtgatgagttgattgtcaccacaactagcccatatgagcaggctgcttttggttctaaaacggattggcgtgtaagggcaatatctgccacaaatctctatctccgagtcaatcatatatatgttaactctgatgatatcaaggaaactggttatacatacattatgccaaagaacatattgaaaaaattcatttgcatagctgaccttaggactcagatttcggggtatatttatggtataagccctccagacaatccacaggtgaaggaaattcgctgtatagctatgcctccacaatggggaacgcatcagcaagttcatttgcctttggctttgccggagcacgaatttttgaatgatttagagcctttgggatggatgcatacacaacccaacgagcttcctcaattatcacctcaggacttaacatgccatgctcgaatcttggagaataataagcagtgggatggagagaaatgtatcattcttacatgcagtttcactcccggctcctgctccttaactgcatataagcttactccaacaggttatgaatgggggcggctcaacaaagacactggaagcaatccacatggttatctgcctactcattatgagaaagtacaaatgcttctcagtgaccgttacctgggattttacatggtaccagataatggtccttggaattacaacttcatgggtgttaagcatacagtcagtatgaagtatggaattaagcttggagctcctcgtgacttttatcacgaggatcaccgtcctactcactttttggagttcagcaatctcgaagagggtgaccatgcagagggagatgctgaagatgtattttcttagcttcggttatctggcaaatcgtggatatttaactttccaatccaccgagaaatatgagaaatgctgctaagatataactagcatgactaatgagtaaatgcttttgttttagcagctgtccaattgttgtataaatatcctctccaacgtttggaaaaagcaatctatctccgtttctggagaacacaagccaggaaaacccttcctcgaatgcatgtgtataaaatatgaaactagtgagtcgctagaagttggaatcatatatgcttggcacgacttctttctatctacacatctttcattgcttgttttcattcctcattacttgttttattccccctcattatgagtggaaagtggaaaatttaggtgttaaattttgttcatttggctacttt

SEQ ID NO: 959 - DNA, 2842 bp, Actinidia deliciosa
  misc_feature (7)..(7): n is a, c, g, or t
  misc_feature (15)..(15): n is a, c, g, or t
  misc_feature (35)..(35): n is a, c, g, or t
  misc_feature (136)..(136): n is a, c, g, or t
  misc_feature (193)..(193): n is a, c, g, or t
  misc_feature (196)..(196): n is a, c, g, or t
  misc_feature (214)..(214): n is a, c, g, or t
  misc_feature (236)..(236): n is a, c, g, or t
  misc_feature (274)..(274): n is a, c, g, or t
  misc_feature (301)..(301): n is a, c, g, or t
  misc_feature (860)..(860): n is a, c, g, or t
  misc_feature (1279)..(1279): n is a, c, g, or t
  misc_feature (1600)..(1600): n is a, c, g, or t
  misc_feature (1897)..(1897): n is a, c, g, or t
  misc_feature (1912)..(1912): n is a, c, g, or t
  misc_feature (2011)..(2011): n is a, c, g, or t
  misc_feature (2020)..(2020): n is a, c, g, or t
  misc_feature (2401)..(2401): n is a, c, g, or t
  misc_feature (2440)..(2440): n is a, c, g, or t
  misc_feature (2443)..(2443): n is a, c, g, or t
  misc_feature (2479)..(2479): n is a, c, g, or t
  misc_feature (2482)..(2482): n is a, c, g, or t
  misc_feature (2491)..(2491): n is a, c, g, or t
  misc_feature (2503)..(2503): n is a, c, g, or t
  misc_feature (2588)..(2589): n is a, c, g, or t
  misc_feature (2591)..(2591): n is a, c, g, or t
  misc_feature (2599)..(2599): n is a, c, g, or t
  misc_feature (2608)..(2608): n is a, c, g, or t
  misc_feature (2613)..(2613): n is a, c, g, or t
agcactnggaggggntgaaggaattcttgagcatncattattcaagggaacttacttccctacttgggagggtctcttttgggagaaggcttccggttttgaggagtccatgaagtataagaagctgactaatgcncagagatctgggctcaatcaaatccctaaccgtaggtttaccctgtggtggtcaccnacnataaatcgagccaacgtntatgttggtttccaagtgcagntagatttgactggaatattcatgcatggaaagataccnactttgaagatctcactcattcagatnttccgtgctcatttgtggcagaaggttcatgagagtgttgtcatggatctgtgccaggtgttagatcaagagttggatgcactggaaattgaaactgttcagaaggaaaccatccatccaaggaagagttataaaatgaacagctcttgtgctgacattcttctatttgctgctcatagatggcccatgtcgaagcctagtctagtggcagaatcaaaggatgtgtttgatcaaaaagcaagcaataaatactggatagatgtacaactccgttggggagattatgactctcacgatattgagcggtatactcgggcaaagtttatggactacactacagacaatatgtctatctatccatcgccaactggggtaatgattggacttgatcttgcatataacttgcattctgcatttggaaactggtttcctggttcaaagccactgcttgcacaggccatgaataaaattatgaagtcaaatccagctttgtatgttttgagggagcgaataaggaaagggttgcagttgtattcttctgagcctacagagccatacntgtcgtctcagaactatggagagatattcagcaatcagataatatggtttgtcgatgacacaaatgtgtatcgtgtcacaattcataagacatttgaaggaaatctcacgacaaaaccaattaatggtgccatctttatattcaatccaaggacggggcagctgtttcttaaggtcattcacacaagtgtctgggctggccaaaagcgtttgggtcagctggccaagtggaagacagctgaagaagtggctgctcttgtgcggtccttgcccgttgaagaacagccaaagcaaattattgtgacccgtaaaggaatgctggatcctttagaggttcacttgctggacttccccaatatagttatcaaaggaagtgagctgcaacttccattccaagcttgcttgaagatagagaaattnggtgatctcattctgaaggcgacagagccacaaatggtcttattcaacatatatgatgattggttgaaaagtatttcatcctacacagcattctcgagacttattttgattctgcgtgctcttcatgtgaacaatgagaaagcaaagatgttactaaagcctgataagacaattatcactgagccccatcacatttggccttctcttacggatgaccagtggatgaaggttgaggttgctttgagagatcttatactctccgactatgccaaaaagaacaatgtgaacacatcagcattgacacaatctgagattcgtganataatacttggagctgagataactccaccctcacagcaacgtcaacaaattgcagagatcgagaaacaggcaaaagaagcaagtcaattgacagcagtgactacaaggacaacaaatgttcatggtgatgaactcattgtcactaccacaagtccctacgaacaagctgcatttggttctaaaacagattggcgtgtcagagcaatttcagccacaaatctttatctgcgagtaaatcatatatatgtgaattcagaggatataaaggaaacgggctacacatacatcatgcccaanaacattttgaagaanttcatatgcattgcagatctgcggactcaaatttcagggtacttgtatggcgtaagtcctccggacaatcctcaggttaaggaaattcggtgtattgcnatgccaccncaatggggtactcatcagcaagtgcatctcccatcagctcttcccgagcacgatttcctaaatgatttggagcctctgggatggatgcacactcaaccaaatgagcttcctcaattgtcaccgcaggatctcacttcccatgctcggatcctagagaataacaagcaatgggatggggagaggtgtattatcctgacttgcagttttactccgggctcctgttcattaactgcgtataagcttacccccaccgggtatgaatggggacgggccaacaaagacactggaagcaatcctcatggctatttgccaacacattacgagaaggtccagatgctcctgagtgaccgcttcctaggtttctacatgattccagatacnggcccatggaattacaacttcatgggggtgaagcatacngtnagcatgaaatatgggatcaagctggggacacctcgngantactatcangaggaccacagnccgactcactacttggagttcagcaacttggaggagggcgagactgcggaagcagacagggaagatacattcacataagagtcgnnantggcattngttaccgtnttctnaataccactttgaaaagaaaaccctgcggatattggaatgacgtattgatacaaggtaatacttttgttgtaataatgtgcatcttaacttgtttcaatgagttgtaaatatatgtttcggaaatgattggttcaatttgaacttggattggctacaaaaaaaatttagggcccagtttgggataatttttaccccatttgaattaattgtcggtagcaaaaaaaaaaa

SEQ ID NO: 960 - DNA, 7427 bp, Glycine max
atgtggaacaacggccagattctgccgcctggaacttccgttcctccgattcctccgcctccggccgcgcaaccctcctacacggtgcttccaccgccgcctccacctccagctcccatggagaccgaggccgatgcagaggcgcgcctcgaggagaaggctagaaaatggcagcagctgaattccaagcggtacagcgacaagaggaaattcgggtttgtcgagacgcagaaagaggacatgcctcccgaacatgtcaggaaaatcatcaggcaattgtttggttttgctggtgtgaggatgctgcgttataatactactacaatttatggtgctgatagtttgttagggttagctgatagcttattagaaactatgttattccgtgttgcgaaccgtgaaaaaggatctccgagactatttattttccaatctaattatgggatcatggtgacatgtttcagttcctcatgttttgatcgatctttgctgtctggttttccttctcttcatttgattcactgtactgtccgagatgtgaaggtcttgtaccatatttctggggctatcacatttgtcaatgaaataccatgggtcgttgagcctatttatcttgctcagtggggtaccatgtggatcatgatgcgaagggagaaaagagatcgtcgtcattttaagaggatgcggtttcctccatttgatgatgaggagcctccactagactatgctgataatcttttagatgttgatcctctagagccaattcagctggagctagatgaggaggaagattctgccgtgtatacttggttttatgaccataaaccgcttgtgaaaacaaagctcataaatggtcctagttaccggaaatggcatctttcccttcctataatggcaactttgcatcggctagctgggcagcttctttctgatttaattgaccgcaattatttctacttgtttgacatggaatcattttttacagcaaaggcattgaacatgtgcatacccggtggacctaaatttgagcctctctaccgtgatatggaaaagggagatgaggactggaatgaatttaatgacatcaataaactcattataaggtcaccacttcggacagagtatagaattgcttttcctcacctttataacaacaggcctcggaaagtaaagctttgtgtgtatcatactcccatgatcatgtttataaaagctgaagatcctgatctacctgcattttattatgatcccctgatacatccaataaccagtgctaacaaggagcggcgtgagaagagagtttatgaagaggatgacgatgatgattggatattgccagatggtgtggagcctttgcttaaagatacacaactttatacagacaccacagctgctggtatctctttgctgtttgctcctcgtccttttaacatgagatctggtcgcatgaggcgggcagaggatattcctcttgtgtcagagtggtataaagagcattgtcctccgtcatatccagttaaagttcgagttagttatcaaaagttgctgaaatgttttgtgttgaatgagctgcatcatagacctcccaaggctcaaaaaaagaagcacttgttccgatctctccaagcaacaaagtttttccaaaccactgaacttgattgggttgaggcaggtcttcaagtttgtcggcaggggtataacatgctgaatctgctgatacacaggaaaaatttgaactaccttcaccttgattataattttaatctaaagcctgtgaaaaccttgactacaaaagagcggaagaaatcacgatttggtaatgctttccatctctgtcgtgagatcctccgattgacgaaacttgtggttgatgccaatgttcagttccgtttggggaatgttgatgcttttcagctggcagatggtctgcagtatactttttcacatgttggacagttgactggtatgtatcggtacaagtacaggcttatgcggcaaataaggatgtgcaaggatctgaagcacttgatttactaccgctttaacactgggcctgttgggaagggacctgggtgtgggttttgggcaccgatgtggagggtttggttattctttcttcgtggtattgtgccccttcttgaacgatggttgggcaatttacttgcacggcagtttgaggggcgccattcaaaaggagtggctaagactgtaactaaacagcgtgttgagagccactttgacttagagcttcgggcagcagttatgcatgatgtgcttgatgccatgccagagggtataaagcaaaataaggcaagaactatattgcaacatttgagtgaggcatggcgatgctggaaagcaaatattccttggaaggttcctggtctgcctgttcccattgagaacatgattcttcgatatgtgaaatcaaaagcagactggtggacaaatgttgctcattataatcgtgagcgtataagaagaggtgcaactgtggataagactgtttgtcgtaagaatcttggaagattgacacgactctggctgaaggcagaacaggaacgccaacacaattatttgaaagatggtccatatgttactcctgaagaagctgttgccatctatacaacaactgtacattggttggaatctaggaagttctcccctattccctttccacctttatcatataagcatgataccaagctgcttatccttgcgcttgagaagttgaaagaatcctatagtgttgctgtgaggttaaatcaactgcaaagagaagagttggggctgattgagcaagcttatgacaatccacatgaggcattatcgcgaatcaagcggcacttgctcacccagcgtgcattcaaagaagttgggatagagtttatggatttatatagctacctgattccagtttacgagatagagcctcttgagaaaattacagatgcatatctggatcaatacctgtggtatgaaggtgacaagcgtcatctcttccccaactggatcaagccagcagattcagagcctcctccccttttagtttacaaatggtgtcaaggtataaacaatttgcaaagtatatgggacaccagtgagggtcagtgtgttgtgatgctgcaaactaagttcgagaaattctttgagaagattgatttaacaatgctaaacaggcttctgcgactggttctagaccataatattgctgattatgtcactgcaaagaacaatgttgtgttgtcatacaaggatatgagccatacaaattcatatggtcttatacgaggcctgcagtttgcttcctttgttgttcagtattatgggctggtattagatcttttacttcttggactgactcgagccagtgagattgctggcccaccacagatgccaaacgaattcattacttactgggatacaaaagttgagactaagcatccaatcaggctttattctcggtacatagatcgggttcatatattatttcgtttcactcatgaggaggctcgggatctcattcagcggtatctgactgagcaccctgatcctaacaatgagaacatggtggggtacaataataagaagtgttggccaagagatgctagaatgaggctcatgaaacatgatgtcaatcttggaaggagtgtcttttgggatatgaagaatcgtcttcctcgaagcatcacaacattggagtgggagaacagttttgtttctgtttacagcaaggataatccaaacttgctttttagcatgtgtggatttgaagtaaggatacttcctaaaattagaatgactcaagaagcattcagtaacacaagagatggtgtctggaatctccagaatgaacagacgaaagaaaggacagctgttgctttcttacgagttgatgatgagcacatgaaagtgttcgagaatcgtgtgagacagattcttatgtcttccggttctactacattcacaaaaattgtcaataagtggaatacagctttaataggactcatgacttatttccgggaggcaactgtgcatacccaagagttgttggatttgctagtcaaatgtgaaaataaaattcagactcgtattaagattggactcaactcaaagatgcctagcaggtttccacctgtcattttctacacccctaaagaaattggagggcttggaatgttgtccatgggtcacattttgattccacaaagtgatctccgatacagtcagcagacagatgttggagtaacccacttcaggagtgggatgagtcatgaggaggaccaactgattcccaacctttatcgttatatacagccttgggagagcgagttcattgattcacagcgtgtctgggctgaatatgctttgaagaggcaggaagcacaggctcaaaacagacgtttgacccttgaagatctggaagattcatgggatagaggtataccacgtataaacactttgtttcaaaaggacagacacaccttggcttatgataaaggatggagggtgcggactgatttcaagcagtaccaagttctaaaacaaaatcccttctggtggacacatcagaggcatgatgggaaattgtggaacctgaacaattaccgtactgatgttattcaagcccttggaggagttgaaggaattcttgaacatactttattcaaaggaacatattttccaacctgggaaggtcttttctgggaaaaggcatctggttttgaggaatctatgaagtataagaagctcaccaatgctcagaggtctggtctaaaccagatacccaaccgaagatttacactatggtggtcgccaaccattaaccgagccaatgtttatgtgggtttccaagtgcagctagatctgactggtattttcatgcatggaaaaataccaactttgaagatatcccttattcagatattcagagctcacttgtggcagaagatccacgagagtgttgttatggatctctgtcaggttttggatcaagagttggatgctttggagattgaaactgttcagaaggaaacaatccatccaaggaaaagctacaaaatgaacagttcttgtgcggacattcttctctttgctgcccatagatggccaatgtcaaagcctagtcttgtaggtgaatctaaggatgtttttgatcagaaggcaagcaataagtactggattgatgttcagctgcgatggggtgattatgactctcatgatattgagcgttacactcgggccaaatttatggactacacaacagataacatgtctatatacccatctcctactggggtgatgattggccttgatttggcatataacttgcattctgcgtttgggaactggttcccagggtcaaaaccactacttcagcaggccatgaataagatcatgaagtcaaatcctgcactgtatgtgttgagggaacggatcaggaaaggtttgcagttgtactcttctgagcctactgaaccatatttgtcttcccaaaactatggagagatattcagcaaccaaataatatggtttgttgatgatactaatgtgtatcgtgttacaattcacaagacttttgaaggaaatcttacaactaagcccatcaatggtgctatatttattttcaatccaaggactgggcagttgtttctcaaggttattcataccagtgtgtgggctggtcagaagcgacttgggcagttggcgaagtggaaaacagcagaagaagttgctgctcttgtaaggtctttgcctgttgaagaacaaccaaagcaaattatcgtcactcgtaaaggaatgttggatccattggaggttcacctgctggacttccccaacattgttattaaaggaagtgaactgcaacttcctttccaggcatgtttgaaaattgagaaatttggggatcttatcttgaaggccacagaaccccaaatggttttgttcaacatctatgatgactggctgaagagtatttcttcatacactgcattctccaggctgattctgattcttcgtgcacttcatgtgaataatgaaaaggcaaaaatgttgcttaagcccgataaaactatcatcacggaacctcatcacatctggccttctctaagtgatgatcaatggatgaaggtggaggttgcattaagagatcttatactatcagattatgcaaagaaaaacaatgtgaatacttcagctttgactcagtctgagattcgtgatattatacttggagctgagattactccaccttctcaacagcggcaacagattgcagagattgagaaacaggcccatgaagcaaatcaggtgacagctgtgacaacaaagactacaaatgttcatggtgaagaacttatagtaaccaccactagtccttatgagcaagctgcttttggttccaagactgattggcgtgtccgagcaatatcagccacaaatttataccttcgtgtgaaccatatatatgtgaactctgaggatataaaggaaactggatacacctatattatgccaaagaacattttgaaaaagtttatatgcatagcagatcttcgaacacaaatttctgggtacatgtatggcgtaagtcctccagataatcctcaggttaaagaaattcgctgcattgtgatgccaccacaatgggggacacatcaacaagttcatctgccatcagctcttccagagcatgatttcttgaatgatttggagcctttaggatggatgcatactcaaccaaatgaacttcctcagttgtcgcctcaggatctcacttcacatgccaagatcctagagaacaataagcaatgggatggggagaaatgtattatcttgacttgcagctttactcctggttcttgttctttaactgcatataagctcactccatctggttacgaatgggggcgtgtaaataaggatacgggaagcaatccacatggttaccttcccacccattatgagaaggttcagatgctccttagtgatcgcttccttggtttctacatggttcctgataatggtccatggaattacaacttcatgggggtgagacacgcatcagggatgaaatatggagtgaagctcgggactcctagggaatattaccacgaggaccatagaccaacccatttcttagagttcagcaatatggaggaagtggagacagctgctgagggagatcgagaggatacattctcttgagagataaaaatatttttgtttgagatatataagtggcaagtcctttaattttttaaacttgtcataatatgttgtatcatctactgtttgttcatcctagggattttgtaacaacggtataatagctctgtacataattactatctgcttctgtatttctaccgagctgagtttttggccaagcaaaagcaactacatgagttgatttactttgcagc

SEQ ID NO: 961 - DNA, 7021 bp, Glycine max
gatcatggtgacatgtcctcaaagaaatatcgtcatgacaaacgtgtttatcttggagcacttaaattcataccacatgcagtttacaaacttctggaaaatatgcctatgccgtgggagcaggtccgagatgtgaaggtcttgtaccatatttctggggctatcacatttgtcaatgaaataccatgggtcgttgagcctatttatcttgctcagtggggtaccatgtggatcatgatgcgaagggagaaaagagatcgtcgtcattttaagaggatgcggtttcctccatttgatgatgaggagcctccactagactatgctgataatcttttagatgttgatcctctagagccaattcagctggagctagatgaggaggaagattctgccgtgtatacttggttttatgaccataaaccgcttgtgaaaacaaagctcataaatggtcctagttaccggaaatggcatctttcccttcctataatggcaactttgcatcggctagctgggcagcttctttctgatttaattgaccgcaattatttctacttgtttgacatggaatcattttttacagcaaaggcattgaacatgtgcatacccggtggacctaaatttgagcctctctaccgtgatatggaaaagggagatgaggactggaatgaatttaatgacatcaataaactcattataaggtcaccacttcggacagagtatagaattgcttttcctcacctttataacaacaggcctcggaaagtaaagctttgtgtgtatcatactcccatgatcatgtttataaaagctgaagatcctgatctacctgcattttattatgatcccctgatacatccaataaccagtgctaacaaggagcggcgtgagaagagagtttatgaagaggatgacgatgatgattggatattgccagatggtgtggagcctttgcttaaagatacacaactttatacagacaccacagctgctggtatctctttgctgtttgctcctcgtccttttaacatgagatctggtcgcatgaggcgggcagaggatattcctcttgtgtcagagtggtataaagagcattgtcctccgtcatatccagttaaagttcgagttagttatcaaaagttgctgaaatgttttgtgttgaatgagctgcatcatagacctcccaaggctcaaaaaaagaagcacttgttccgatctctccaagcaacaaagtttttccaaaccactgaacttgattgggttgaggcaggtcttcaagtttgtcggcaggggtataacatgctgaatctgctgatacacaggaaaaatttgaactaccttcaccttgattataattttaatctaaagcctgtgaaaaccttgactacaaaagagcggaagaaatcacgatttggtaatgctttccatctctgtcgtgagatcctccgattgacgaaacttgtggttgatgccaatgttcagttccgtttggggaatgttgatgcttttcagctggcagatggtctgcagtatactttttcacatgttggacagttgactggtatgtatcggtacaagtacaggcttatgcggcaaataaggatgtgcaaggatctgaagcacttgatttactaccgctttaacactgggcctgttgggaagggacctgggtgtgggttttgggcaccgatgtggagggtttggttattctttcttcgtggtattgtgccccttcttgaacgatggttgggcaatttacttgcacggcagtttgaggggcgccattcaaaaggagtggctaagactgtaactaaacagcgtgttgagagccactttgacttagagcttcgggcagcagttatgcatgatgtgcttgatgccatgccagagggtataaagcaaaataaggcaagaactatattgcaacatttgagtgaggcatggcgatgctggaaagcaaatattccttggaaggttcctggtctgcctgttcccattgagaacatgattcttcgatatgtgaaatcaaaagcagactggtggacaaatgttgctcattataatcgtgagcgtataagaagaggtgcaactgtggataagactgtttgtcgtaagaatcttggaagattgacacgactctggctgaaggcagaacaggaacgccaacacaattatttgaaagatggtccatatgttactcctgaagaagctgttgccatctatacaacaactgtacattggttggaatctaggaagttctcccctattccctttccacctttatcatataagcatgataccaagctgcttatccttgcgcttgagaagttgaaagaatcctatagtgttgctgtgaggttaaatcaactgcaaagagaagagttggggctgattgagcaagcttatgacaatccacatgaggcattatcgcgaatcaagcggcacttgctcacccagcgtgcattcaaagaagttgggatagagtttatggatttatatagctacctgattccagtttacgagatagagcctcttgagaaaattacagatgcatatctggatcaatacctgtggtatgaaggtgacaagcgtcatctcttccccaactggatcaagccagcagattcagagcctcctccccttttagtttacaaatggtgtcaaggtataaacaatttgcaaagtatatgggacaccagtgagggtcagtgtgttgtgatgctgcaaactaagttcgagaaattctttgagaagattgatttaacaatgctaaacaggcttctgcgactggttctagaccataatattgctgattatgtcactgcaaagaacaatgttgtgttgtcatacaaggatatgagccatacaaattcatatggtcttatacgaggcctgcagtttgcttcctttgttgttcagtattatgggctggtattagatcttttacttcttggactgactcgagccagtgagattgctggcccaccacagatgccaaacgaattcattacttactgggatacaaaagttgagactaagcatccaatcaggctttattctcggtacatagatcgggttcatatattatttcgtttcactcatgaggaggctcgggatctcattcagcggtatctgactgagcaccctgatcctaacaatgagaacatggtggggtacaataataagaagtgttggccaagagatgctagaatgaggctcatgaaacatgatgtcaatcttggaaggagtgtcttttgggatatgaagaatcgtcttcctcgaagcatcacaacattggagtgggagaacagttttgtttctgtttacagcaaggataatccaaacttgctttttagcatgtgtggatttgaagtaaggatacttcctaaaattagaatgactcaagaagcattcagtaacacaagagatggtgtctggaatctccagaatgaacagacgaaagaaaggacagctgttgctttcttacgagttgatgatgagcacatgaaagtgttcgagaatcgtgtgagacagattcttatgtcttccggttctactacattcacaaaaattgtcaataagtggaatacagctttaataggactcatgacttatttccgggaggcaactgtgcatacccaagagttgttggatttgctagtcaaatgtgaaaataaaattcagactcgtattaagattggactcaactcaaagatgcctagcaggtttccacctgtcattttctacacccctaaagaaattggagggcttggaatgttgtccatgggtcacattttgattccacaaagtgatctccgatacagtcagcagacagatgttggagtaacccacttcaggagtgggatgagtcatgaggaggaccaactgattcccaacctttatcgttatatacagccttgggagagcgagttcattgattcacagcgtgtctgggctgaatatgctttgaagaggcaggaagcacaggctcaaaacagacgtttgacccttgaagatctggaagattcatgggatagaggtataccacgtataaacactttgtttcaaaaggacagacacaccttggcttatgataaaggatggagggtgcggactgatttcaagcagtaccaagttctaaaacaaaatcccttctggtggacacatcagaggcatgatgggaaattgtggaacctgaacaattaccgtactgatgttattcaagcccttggaggagttgaaggaattcttgaacatactttattcaaaggaacatattttccaacctgggaaggtcttttctgggaaaaggcatctggttttgaggaatctatgaagtataagaagctcaccaatgctcagaggtctggtctaaaccagatacccaaccgaagatttacactatggtggtcgccaaccattaaccgagccaatgtttatgtgggtttccaagtgcagctagatctgactggtattttcatgcatggaaaaataccaactttgaagatatcccttattcagatattcagagctcacttgtggcagaagatccacgagagtgttgttatggatctctgtcaggttttggatcaagagttggatgctttggagattgaaactgttcagaaggaaacaatccatccaaggaaaagctacaaaatgaacagttcttgtgcggacattcttctctttgctgcccatagatggccaatgtcaaagcctagtcttgtaggtgaatctaaggatgtttttgatcagaaggcaagcaataagtactggattgatgttcagctgcgatggggtgattatgactctcatgatattgagcgttacactcgggccaaatttatggactacacaacagataacatgtctatatacccatctcctactggggtgatgattggccttgatttggcatataacttgcattctgcgtttgggaactggttcccagggtcaaaaccactacttcagcaggccatgaataagatcatgaagtcaaatcctgcactgtatgtgttgagggaacggatcaggaaaggtttgcagttgtactcttctgagcctactgaaccatatttgtcttcccaaaactatggagagatattcagcaaccaaataatatggtttgttgatgatactaatgtgtatcgtgttacaattcacaagacttttgaaggaaatcttacaactaagcccatcaatggtgctatatttattttcaatccaaggactgggcagttgtttctcaaggttattcataccagtgtgtgggctggtcagaagcgacttgggcagttggcgaagtggaaaacagcagaagaagttgctgctcttgtaaggtctttgcctgttgaagaacaaccaaagcaaattatcgtcactcgtaaaggaatgttggatccattggaggttcacctgctggacttccccaacattgttattaaaggaagtgaactgcaacttcctttccaggcatgtttgaaaattgagaaatttggggatcttatcttgaaggccacagaaccccaaatggttttgttcaacatctatgatgactggctgaagagtatttcttcatacactgcattctccaggctgattctgattcttcgtgcacttcatgtgaataatgaaaaggcaaaaatgttgcttaagcccgataaaactatcatcacggaacctcatcacatctggccttctctaagtgatgatcaatggatgaaggtggaggttgcattaagagatcttatactatcagattatgcaaagaaaaacaatgtgaatacttcagctttgactcagtctgagattcgtgatattatacttggagctgagattactccaccttctcaacagcggcaacagattgcagagattgagaaacaggcccatgaagcaaatcaggtgacagctgtgacaacaaagactacaaatgttcatggtgaagaacttatagtaaccaccactagtccttatgagcaagctgcttttggttccaagactgattggcgtgtccgagcaatatcagccacaaatttataccttcgtgtgaaccatatatatgtgaactctgaggatataaaggaaactggatacacctatattatgccaaagaacattttgaaaaagtttatatgcatagcagatcttcgaacacaaatttctgggtacatgtatggcgtaagtcctccagataatcctcaggttaaagaaattcgctgcattgtgatgccaccacaatgggggacacatcaacaagttcatctgccatcagctcttccagagcatgatttcttgaatgatttggagcctttaggatggatgcatactcaaccaaatgaacttcctcagttgtcgcctcaggatctcacttcacatgccaagatcctagagaacaataagcaatgggatggggagaaatgtattatcttgacttgcagctttactcctggttcttgttctttaactgcatataagctcactccatctggttacgaatgggggcgtgtaaataaggatacgggaagcaatccacatggttaccttcccacccattatgagaaggttcagatgctccttagtgatcgcttccttggtttctacatggttcctgataatggtccatggaattacaacttcatgggggtgagacacgcatcagggatgaaatatggagtgaagctcgggactcctagggaatattaccacgaggaccatagaccaacccatttcttagagttcagcaatatggaggaagtggagacagctgctgagggagatcgagaggatacattctcttgagagataaaaatatttttgtttgagatatataagtggcaagtcctttaattttttaaacttgtcataatatgttgtatcatctactgtttgttcatcctagggattttgtaacaacggtataatagctctgtacataattactatctgcttctgtatttctaccgagctgagtttttggccaagcaaaagcaactacatgagttgatttactttgcag

SEQ ID NO: 962 - DNA, 4023 bp, Tripterygium wilfordii
ggattgacccgagccagtgagattgctggtccaccgcagatgcctaatgagttcattacttattgggacacgaaagttgaggctaggcatcccatacgactgtattcaaggtacattgataaggtgcatatattgttccgcttcacccatgaggaggctcgagaccttatccagcgttatcttaccgagcatcctgatcccaacaatgaaaatatggttggttacaataacaagaagtgctggccaagggatgccagaatgaggctcatgaaacatgatgtcaatcttggaaggagtgtattttgggatatgaagaaccgtctccctcgaagcattacaacattagagtgggaaaatagttttgtgtcagtttacagcaaagacaatcctaaccttcttttcagcatgtgtggatttgaggtccgtatccttccaaaaataaggatgactcaagaagcattcagcaatacaagagatggagtttggaatttgcagaatgaacagactaaagagcgaactgctgttgctttcttaagagtcgatgatgaacacatgaaggtgttcgagaatcgtgtgagacaaatacttatgtcttcagggtccacgacatttactaaaattgtcaacaaatggaatactgctttgataggtctgatgacttatttccgtgaagcaactgtgcatactcaagagctgctagatttgctggttaagtgtgaaaacaaaattcaaactcgtattaagatttgggtttaaattacaaaaatgccgagcagatttcctcctgtcatcttttacactccgaaggaaattggaggacttggcatgttatcaatgggtcacatattgatcccccagagtgatctacgatacagtcagcagactgatgttggtgtaacccactttaggagcgggatgagtcatgaagaggaccagctgattccaaatctttatcgctacatacagccatgggaaagtgagttcattgattctcaacgagtatgggctgagtatgcactgaagaggcaggaggctcaggcacagaatagacgcttgactcttgaggatctggaggattcttgggataggggaattccacgtataaatactctattccagaaggaccgacataccttggcatatgataaaggatggcgagtgcggacagacttcaagcagtaccaagttctgaaacagaatcctttctggtggacacaccagaggcatgatgggaaactctggaacttgaacaactaccgaactgatgttatccaagctctcggaggtgttgagggaattcttgaacataccttattcaaaggaacatactttccaacctgggaaggtctattctgggagaaagcatctggctttgaggagtctatgaagtacaagaagctgactaatgcacaaagatctggtctcaaccaaattcctaatcgcagattcactctctggtggtcaccaactataaatcgggcaaatgtttatgttggtttccaagtgcaattggacctgactggaattttcatgcatggaaagattccaactttgaagatctctcttattcagatattccgagctcatctgtggcagaagattcatgagagtgttgtcatggatctatgtcaagttctggatcaggagttggatgcattagaaattgaaaccgtgcagaaagagactattcatccaagaaaaagttacaaaatgaatagctcttgtgcagatattcttctctttgctgcccataggtggcccatgtcaaagcctagtcttgtggctgagtcaaaggatgtttttgatcaaaaaggtagcaataagtattggattgatgtacagctccgctggggagactatgactctcatgatattgagcgttatactcgggctaagtttatggattacacaacagacaacatgtctatatatccctctccaacgggagttatgattggccttgatctggcatacaatctgcagtctgcatttggcaattggtttcctgggtctaaaccactacttgcccaagcgatgaacaagatcatgaagtcaaatccagctttatatgtcctgagggagcgtataaggaaaggtttgcagttgtattcttctgagcctacggaaccatatttgtcatcccagaattatggagaaatcttcagcaaccaaattatttggtttgttgatgatacaaatgtctatcgtgttacaattcacaagacatttgaaggaaatctcactacaaaacccatcaatggtgccatttttatattcaatcctaggacagggcagctgtttttgaaggttatccacacaagtgtctgggctgggcagaagcgtcttggccagctagcaaagtggaaaactgctgaagaagttgctgctcttgttcggtctttgcccgttgaggaacagcctaaacagattattgttactcgtaagggaatgctggatcctctggaggttcacttgctggatttccctaacatagtcattaaaggaagtgagctgcagcttccattccaggcttgcttgaagattgagaaatttggtgatttgattttgaaggctactgaaccacaaatggttttgttcaacatttatgatgattggttaaagagtatttcctcttacacagcattctcccgtctcatcctgattctccgtgcacttcatgtgaacaatgagaaggcaaagatgttattgaagccagacaaaacagtcgttactgagccacatcatatctggccttctttgactgatgatcagtggatgaaggttgaggttgctttaagagatctcatactctcagattatgccaagaagaacaatgtgaatacatctgcactcacacaatctgagattcgtgatattatacttggagcagagattaccccaccttctcaacagagacagcagattgcagagattgagaaacaggccaaagaagcaagtcaactgactgcagtaacaacaaagactacaaacgtccacggggatgaactcattgttacaacaacaagtccatatgagcaatctgcatttagttctaaaacggattggcgtgttagagctatatctgcaacaaatctctatcttcgagtcaatcatatatatgtgaactcggaggacattaaggaaactggatacacttatatcatgcccaagaatattttgaagagatttatctgcatagcagatttacgaacacaaattgctgggtacttgtatggtataagcccccctgacaaccctcaggtcaaggagattcgttgtattgccatggtacctcagtggggtactcatcaacaagtacatcttccttcagcacttcctgagcatgattttctaaatgatctggagcctttaggatggatgcacacacagccaaacgagcttcctcagttatcgccacaggatctaacaagtcacgctcgagttctggagaacaacaaacaatgggatggagagaagtgcatcattttgacttgcagttttactccaggttcctgctcattgactgcatataagcttacaccaagtggttatgaatggggacgtctcaacaaggacacgggaagcaatcctcatggttaccttccaacacattacgagaaggtccagatgcttttaagtgatcgcttcctaggtttctacatggttcctgataacggtccatggaattacaacttcatgggggtgaagcatactgtaagcatgaagtacggcgtcaagctggggacccctcgagagtattacaatgaagaccacaggccaacccattttctggaattcagcaacctggaagaggtggagaccgccgagggtgatcgggatgatacattcacttagtctgatatttactcgggcttggattagatcagcaatgtcgtatgtagtattgatgcttcgaagtggaagcagtacggaattttgttgtattgatacatgcatcctggtgactaatgttgcaagtccaacagacttctttccatatcagttgtaaatagtgaatgtgtg

SEQ ID NO: 963 - DNA, 3276 bp, Lotus japonicus
tgacttattcttgatttattttgcaggactcgtgggatagaggaataccacgtattaacactttgtttcagaaagatagacacactttggcttatgataaaggatggagggtgcgtacagacttcaagcagtaccaagttctgaaacaaaatccgttctggtggactcaccaaaggcatgatgggaagttgtggaacttgaacaattaccgaactgatgttattcaagcccttggaggagttgaaggaattcttgaacacacattattcaaaggaacatattttccaacttgggaaggtctcttctgggaaaaggcatcaggctttgaggaatctatgaagtataagaagctcaccaatgctcagagatctggtctcaaccagatacccaaccgtagatttacactttggtggtcacctactattaatcgagccaatgtttatgtgggtttccaagtgcagctagatcttactggtattttcatgcatgggaaaataccaactttgaagatatctcttattcagatattcagagctcacttgtggcagaagatccatgagagtgttgtcatggatctttgtcaggttttggatcaagagttggatgctctggagattgaaactgttcagaaggaaacaattcatcctaggaaaagttacaaaatgaacagttcttgtgcagacattcttctctttgctgcgcatagatggccaatgtcaaagcctagtcttgtcgctgaatctaaggatgtttttgatcagaaggcaagcaataagtactggattgatgttcagcttcgatggggtgattatgactctcatgatattgagcgttacactcgagccaaatttatggactacacaacagataatatgtcaatatatccgtctcctactggggtgatgattggtctcgacttggcgtacaacttacattctgcttttgggaactggttccctgggtcaaagccactgcttcagcaagccatgaataagatcatgaagtcaaatcctgcgttgtatgttttgagggaacgtataaggaaaggtttgcagctgtactcttctgagccgactgaaccatatttgtcttcccaaaactatggagagatattcagcaaccaaattatttggtttgttgatgacactaatgtgtatcgtgttacaattcacaagacttttgaaggaaatcttacaacaaaacccatcaatggtgccatatttattttcaacccaaggactggacagttgtttcttaaggttattcatacaagtgtctgggctggtcagaagcgtcttggccagttggccaagtggaaaacagctgaagaagttgctgctctagtaaggtctttgcctgtagaagaacagccaaagcagattattgtcactcgtaaaggcatgttggatccattggaggttcacttgctggatttccccaacattgttatcaaaggaagtgagctgcagcttcctttccaggcatgtttgaaaattgagaaatttggggatcttattttgaaggccacggagccacaaatggtcttgttcaacatttatgatgactggctgaagagtatttcatcatacactgcattctctagactgattctgattctccgagctcttcatgtaaataatgaaaaggcaaagatgttactgaagcctgacaaaactatcatcaccgagcctcatcacatctggccttctctaagtgatgaccagtggatgaaggtggaggttgcattaagagatcttatactttcagattatgccaagaaaaacaatgtgaacacttcagctctgactcagtctgagattcgtgatattattcttggagctgaaattactccaccttcacaacagcggcaacagattgcagagattgagcaacaggctcatgaagctaatcaggcgacagctgtaacaacaaagaccacaaatgttcatggtgaagaacttatagtaactaccaccagtccctatgagcaagctgcatttggttctaagactgactggcgtgtcagagcaatatccgccactaatttataccttcgtgtaaaccatatatatgtgaattccgaggatataaaggaaaccggctacacctatattatgccaaagaacattttgaagaagttcatttgcatagcagatcttcgaacacaaattgctgggtacttgtatggcataagtcctccggacaatcctcaggtgaaggaaattcgctgcattgtgatgacaccacaatatgggactcatcaacaagtccatctcccatcagctcttccagagcatgatttcttgaatgatttggagcccttgggatggatgcatactcaaccaaatgagcttccccagttgtcgcctcaggatctcacttcacatgctaagatcctagagaacaataagcaatgggatggggagaaatgtattatcttgacttgtagctttactcctggttcctgttctttaaccgcgtacaaactcactccatctggttatgaatggggccgtatcaacaaggatacaggaagcaatcctcatggttaccttcccactcattatgaaaaggttcagatgctcctcagtgatcgcttccttggtttctacatgattcctgataatggtccatggaattacaacttcatgggggtgagacacgcaccatcgatgaagtatggagtgaaacttgggacacctagggagtactacaacgaggaccatagacccacccatttcttagagttcagcaacatggaggaaaaaggggaaacagttgttgagggtgatcgtgaggatacattctcttgagctacaaattgtcttttaacttttgaaacttttcatagtatgttgtatcttgtatgatctaatcatggtactagtaggtatcttgtagcaacggtatcatggctctgtaaataatagccaacagcatttctcatctttccttacctctgcttctgcaatcaagttgtctgaggtttcggatattccactgtgttgagttttctgccaagcagaagcaactgccttaactaattggttatgaaacaattttgctatgtagcacaagccattccccattttttttcatgggtgtagaagtcaacttggaattgaatccattatttgcttacttgtatgacccggactgatagttcgggtgatcgtaggttgaatagttgaatcagtaagttatcattttttttttggaaagaatatggacttcgtgtttttttattaagaagtgtctcttgaagatgctttatat

SEQ ID NO: 964 - DNA, 7600 bp, Glycine max
gttcgagttcttcctctactactcgttactcagtactcagtactcactactcactactaaagctctgttcattttatcttccactcataaacccaaaccctagaacgaacctacgaatactcgtgcagagcccgccaaggctcttcgttcaatccaccaagaacatgctctgaaactatccccaataattccaatttcaatttcccaaggatagagtagagtctcttcaagatgtggaacaacggccagattctgccgcctggaacttccgttcctccgattcctccgcctcccgctgcgcaaccctcctacacggtgcttccgccgccgcctccaactccggtgcctatggagaccgaggccgatgcggaggcgcgcctcgaggagaaggctagaaaatggcagcagctcaattccaagcggtacagcgacaagaggaaattcgggtttgtcgagacgcagaaagaggacatgcctcccgaacatgtcaggaaaatcatcaggcaagtgtttttcccttcagaatctgaatcttgttcgtgcgtgaaatacagttgcttgatgaacctatttatttaggatcatggtgacatgtcctcaaagaaatatcgtcatgacaaacgtgtttatcttggagcacttaaattcataccacatgcagtttacaaacttctggaaaatatgcctatgccgtgggagcaggtccgagatgtgagggtcttgtaccatatttctggggctatcacatttgtcaatgaaataccatgggtcgttgagcctatttatctcgctcagtggggtaccatgtggatcatgatgagaagggagaaaagagatcgtcgtcattttaagaggatgcggtttcctccatttgatgatgaggagcctccactagactatgctgataatcttttagatgttgatcctctagagccaattcagctggagctagatgaagaggaagattctgctgtgtatacttggttctatgaccataaacctcttgtgaaaacaaagctcataaatggtcctagttaccggaaatggcatctttccctccctataatggcaactttgcatcggctagctgggcagctactttctgatttaattgaccgcaattatttctacttgtttgacatggagtcattttttacagcaaaggctttgaacatgtgcatacccggtggacctaaatttgagcctctctaccgtgatatggaaaagggagatgaggactggaatgagtttaatgacatcaataaactcattataaggtcaccacttcgcacagagtatagaattgcttttcctcacctttataacaacaggcctcgcaaagtaaagctttgcgtgtatcatactcccatgatcatgttcataaaagctgaagatcctgatctacccgcattttattatgatcccttgatacatccaataaccagtgctaacaaggagcgccgtgagaagagagtttatgaggatgatgatgatgatgattggatattgccagatggtgtggagcctttgcttaaagatacacaactttatacagacacgacagctgctggtatctctttgctgtttgctcctcgtccttttaatatgagatctggtcgcatgaggcgggcagaggatattcctcttgtgtcagagtggtataaagagcattgtcctccatcatatccagttaaagttcgggttagttatcaaaagttgctgaaatgttttgtgttgaacgagctgcatcatagacctcctaaggctcaaaaaaagaagcacttattccgatctctccaagcaactaagtttttccaaaccactgaacttgattgggttgaggcaggtcttcaagtttgtaggcaggggtataacatgctgaatctgctgatacacaggaaaaatttgaactaccttcaccttgattataattttaatctaaagcctgtgaaaaccttgactacaaaagagcggaagaaatcacgatttggtaatgctttccatctctgtcgtgagatcctccgattgacgaaactcgtggttgatgccaatgttcagttccgtttggggaatgttgatgcttttcagcttgcagatggtttgcagtatactttttcacatgttggacagttgactggtatgtataggtacaagtataggcttatgcggcaaataaggatgtgcaaggatttgaagcacttgatttactaccgctttaacactggacctgttgggaagggacctgggtgtgggttttgggcaccaatgtggagggtttggttattcttccttcgtggtattgtgccccttcttgaacgatggctgggcaatttacttgcacggcagtttgaggggcgccattcaaaaggagtggccaagactgtaactaaacagcgtgttgagagccactttgacttggagcttcgggcagcagttatgcatgatgtgcttgatgccatgccagagggtataaagcaaaataaggcaaggactatattgcaacatttgagtgaggcttggcgatgctggaaagcaaatattccttggaaggttcctggcctgcctgttcccattgagaacatgattcttcgatatgtgaaatcaaaagcagactggtggacaaatgttgctcattataatcgtgagcgtataagaagaggtgcaactgtggataagactgtttgtcgtaagaatcttggaagattgacacgactctggctgaaggcagaacaggaacgtcaacacaattatttgaaagatggtccatatgttactcctgaagaagctgttgctatctatacaacaactgtacattggttggaatctaggaagttctcccctattccctttccacctttatcatataagcatgataccaagctgcttatccttgcacttgagaggttgaaagaatcctatagtgttgcagtgagattaaatcaactgcaaagagaagagttggggctgattgagcaagcttatgacaatccacatgaggcattatcgcgaatcaagcggcacttgctcacccagcgtgcattcaaagaagttgggatagagtttatggatttatatagctacttgattccagtttacgagatagagcctcttgagaaaattacagatgcatatcttgatcaatacctgtggtatgaaggtgacaagcgtcatctctttcccaactggatcaagccagcagattcagagcctcctccccttttagtttacaaatggtgtcaaggtataaacaatttgcaaagtatatgggacaccagtgagggtcagtgtgttgtgatgctgcaaactaagtttgagaaattctttgagaagattgatttaacaatgcttaacaggcttctgcgactggttctagaccataatattgctgattatgtcactgcaaagaacaatgtggtgttgtcatacaaggatatgagccatacaaattcctatggtcttatacgtggcctgcagtttgcttcctttgttgttcagtattatgggctggtattagatcttttacttcttggactgactcgagccagtgagattgctggtccaccacagatgccaaacgaattcattacttattgggatacaaaagttgagactaagcatccaatcaggctttattctcggtacattgatcgggtccatatattatttcgtttcacccatgaggaggctcgggatctcattcagcggtatctgaccgagcaccctgatcctaacaatgagaacatggtggggtacaataataagaagtgttggccaagagatgctagaatgaggcttatgaaacatgatgtcaatcttggaaggagtgtcttctgggatatgaagaatcgccttcctcgaagcatcacaacattggagtgggagaacagttttgtttctgtttacagcaaggataatccaaacttgctttttagcatgtgtggatttgaagtgaggatacttcctaaaattagaatgactcaagaagcattcagtaacacaagagatggtgtctggaatctccagaatgaacagacgaaagaaaggacagctgttgctttcttacgagttgatgatgaacacatgaaagtgttcgagaatcgtgtgaggcagattcttatgtcttccggttctactacattcacaaaaattgtcaataagtggaacacagctttaataggactcatgacttatttccgggaggcaactgtgcatactcaagagctgttggatttgctagtcaaatgtgaaaataaaattcagactcgtattaagattggactcaactcaaagatgcctagcaggtttccacctgtcattttctacacccctaaagaaattggagggcttggaatgttgtccatgggccacattttgattccacaaagtgatcttcgatacagccagcagacagatgttggagtaacccacttcaggagtgggatgagtcatgaggaggaccaactgattcccaacctttatcgttatatacagccttgggagagcgaattcattgattcacagcgtgtctgggctgaatatgctttgaagaggcaggaagcacaggctcaaaacagacgtttgacccttgaagatctggaagattcatgggatagaggtataccacgtataaacactttgtttcaaaaggatagacacactttggcttatgataaaggatggagggtgcgtactgatttcaagcagtatcaagttctcaaacaaaatcccttctggtggacacatcagaggcatgatgggaaattgtggaacttgaacaattaccgtactgatgttattcaagcccttggaggagttgaaggaattcttgaacatactttattcaaaggaacatattttccaacttgggagggtcttttctgggaaaaggcatctggctttgaggaatctatgaagtataagaagctcaccaatgctcagagatctggtctaaaccagatacccaaccgaagatttacactatggtggtccccaaccattaaccgagccaatgtttatgtgggtttccaagtgcagctagatctgactggtattttcatgcatggaaaaataccaactttgaagatatcccttattcagatattcagagctcacttgtggcaaaagatccatgagagtgttgttatggatctctgtcaggttttggatcaagagttggatgctttggagattgaaactgttcagaaggaaacaatccatccaaggaaaagctacaaaatgaacagttcttgtgcagacattcttctctttgctgcccatagatggccaatgtcaaagcctagtcttgtagctgaatctaaggatgtttttgatcagaaggcaagcaataagtactggattgatgttcagctacgatggggtgattatgactctcatgatattgagcgttacactcgggccaaatttatggactacacaacagataacatgtctatatacccatctcctactggggtgatgattggtcttgatttggcatataatttgcattctgcgtttgggaactggttcccagggtcaaaaccactacttcagcaggccatgaataagatcatgaagtcaaatcctgcactgtatgtgttgagggaacggataaggaaaggtttgcagttgtactcttctgagcccactgaaccatatttgtcttcccaaaactatggagagatattcagcaaccaaataatatggtttgttgatgacactaatgtgtatcgtgttacaattcataagactttcgaaggaaatcttacaacgaagcccatcaatggtgctatatttattttcaatccaaggactgggcagttgtttctcaaggttattcataccagtgtgtgggctggtcagaagcgtcttgggcagttggcgaagtggaaaacagcagaagaagttgctgctcttgtaaggtctttgcctgttgaagaacagccaaagcaaattattgtcactcgtaaaggaatgttggatccattggaggttcacctgctggatttccccaacattgttattaaaggaagtgaactgcaacttcctttccaggcatgtttgaaaattgagaaatttggggatcttatattgaaggccacagaaccccaaatggttttgttcaatatctatgatgactggctgaagagtatttcttcatacactgcattctccaggctgattctgattctgcgtgcactccatgtgaataatgaaaaggcaaaaatgttgctgaagcctgataaaactatcatcactgaacctcatcacatctggccttctctaagtgatgatcaatggatgaaggtggaggttgcattaagagatcttatactatcagattatgcaaagaaaaacaatgtgaatacttcagctttgactcagtctgagatccgtgatattatacttggagctgagattactccaccttctcaacagcggcaacagattgcagagattgagaaacaggcccatgaagcaaatcaggtgacagctgtgacaacaaagactacaaatgttcacggtgaagaacttatagtaaccaccactagtccttatgagcaagctgcttttggttctaagactgactggcgtgtcagagcaatatcagccacaaatttataccttcgcgtgaaccatatatatgtgaactctgaggatataaaggaaacgggatacacctatattatgccaaagaacattttgaaaaagtttatatgcgtagcagatcttcgaacgcaaatttctgggtacatgtatggcataagtcctccagataatcctcaggttaaagaaattcgctgcattgtgatgccaccccaatgggggacacatcaacaagttcatctgccatcagctcttccagagcatgatttcttgaatgatttggagcctttaggatggatgcatactcaaccaaatgaacttcctcagttgtcgcctcaggatctcacttcacatgccaagatcctagagaacaataagcaatgggatggggagaagtgtattatcttgacttgcagctttactcctggttcttgttctttaactgcatataagctcactccatctggttatgaatgggggcgtgttaataaggatacgggaagcaatccacatggttaccttcccacccattatgagaaggttcagatgctccttagtgatcgcttccttggtttctacatggttcctgataatggtccatggaattacaacttcatgggggtgagacacgcatcagggatgaaatatggagtgaagcttgggactcctagggaatattaccacgaggaccatagaccaacccatttcttagagttcagcaatatggaggaagtggagataactgctgagggagatcgagaggatacattctcttgagataaaaatatttttgtttgagatatataagtggcaggtcttttaattttttaaacttgtcagagtatgttgtattatctactgttttttcatcctagggattttgcaacaacggtatcatagctttgtatataattacgaatcaacaattctacttctacaaatatctgcttctgcatttactatatatccaattttagcaaattatgaaaggacg

SEQ ID NO: 965 - DNA, 7099 bp, Glycine max
cttttttttcccaatctaattatgttgctattaccattgtttcaaattgtaactctctttgccattctttatttcagggatcatggtgacatgtcctcaaagaaatatcgtcatgacaaacgtgtttatcttggagcacttaaattcataccacatgcagtttacaaacttctggaaaatatgcctatgccgtgggagcaggtccgagatgtgagggtcttgtaccatatttctggggctatcacatttgtcaatgaaataccatgggtcgttgagcctatttatctcgctcagtggggtaccatgtggatcatgatgagaagggagaaaagagatcgtcgtcattttaagaggatgcggtttcctccatttgatgatgaggagcctccactagactatgctgataatcttttagatgttgatcctctagagccaattcagctggagctagatgaagaggaagattctgctgtgtatacttggttctatgaccataaacctcttgtgaaaacaaagctcataaatggtcctagttaccggaaatggcatctttccctccctataatggcaactttgcatcggctagctgggcagctactttctgatttaattgaccgcaattatttctacttgtttgacatggagtcattttttacagcaaaggctttgaacatgtgcatacccggtggacctaaatttgagcctctctaccgtgatatggaaaagggagatgaggactggaatgagtttaatgacatcaataaactcattataaggtcaccacttcgcacagagtatagaattgcttttcctcacctttataacaacaggcctcgcaaagtaaagctttgcgtgtatcatactcccatgatcatgttcataaaagctgaagatcctgatctacccgcattttattatgatcccttgatacatccaataaccagtgctaacaaggagcgccgtgagaagagagtttatgaggatgatgatgatgatgattggatattgccagatggtgtggagcctttgcttaaagatacacaactttatacagacacgacagctgctggtatctctttgctgtttgctcctcgtccttttaatatgagatctggtcgcatgaggcgggcagaggatattcctcttgtgtcagagtggtataaagagcattgtcctccatcatatccagttaaagttcgggttagttatcaaaagttgctgaaatgttttgtgttgaacgagctgcatcatagacctcctaaggctcaaaaaaagaagcacttattccgatctctccaagcaactaagtttttccaaaccactgaacttgattgggttgaggcaggtcttcaagtttgtaggcaggggtataacatgctgaatctgctgatacacaggaaaaatttgaactaccttcaccttgattataattttaatctaaagcctgtgaaaaccttgactacaaaagagcggaagaaatcacgatttggtaatgctttccatctctgtcgtgagatcctccgattgacgaaactcgtggttgatgccaatgttcagttccgtttggggaatgttgatgcttttcagcttgcagatggtttgcagtatactttttcacatgttggacagttgactggtatgtataggtacaagtataggcttatgcggcaaataaggatgtgcaaggatttgaagcacttgatttactaccgctttaacactggacctgttgggaagggacctgggtgtgggttttgggcaccaatgtggagggtttggttattcttccttcgtggtattgtgccccttcttgaacgatggctgggcaatttacttgcacggcagtttgaggggcgccattcaaaaggagtggccaagactgtaactaaacagcgtgttgagagccactttgacttggagcttcgggcagcagttatgcatgatgtgcttgatgccatgccagagggtataaagcaaaataaggcaaggactatattgcaacatttgagtgaggcttggcgatgctggaaagcaaatattccttggaaggttcctggcctgcctgttcccattgagaacatgattcttcgatatgtgaaatcaaaagcagactggtggacaaatgttgctcattataatcgtgagcgtataagaagaggtgcaactgtggataagactgtttgtcgtaagaatcttggaagattgacacgactctggctgaaggcagaacaggaacgtcaacacaattatttgaaagatggtccatatgttactcctgaagaagctgttgctatctatacaacaactgtacattggttggaatctaggaagttctcccctattccctttccacctttatcatataagcatgataccaagctgcttatccttgcacttgagaggttgaaagaatcctatagtgttgcagtgagattaaatcaactgcaaagagaagagttggggctgattgagcaagcttatgacaatccacatgaggcattatcgcgaatcaagcggcacttgctcacccagcgtgcattcaaagaagttgggatagagtttatggatttatatagctacttgattccagtttacgagatagagcctcttgagaaaattacagatgcatatcttgatcaatacctgtggtatgaaggtgacaagcgtcatctctttcccaactggatcaagccagcagattcagagcctcctccccttttagtttacaaatggtgtcaaggtataaacaatttgcaaagtatatgggacaccagtgagggtcagtgtgttgtgatgctgcaaactaagtttgagaaattctttgagaagattgatttaacaatgcttaacaggcttctgcgactggttctagaccataatattgctgattatgtcactgcaaagaacaatgtggtgttgtcatacaaggatatgagccatacaaattcctatggtcttatacgtggcctgcagtttgcttcctttgttgttcagtattatgggctggtattagatcttttacttcttggactgactcgagccagtgagattgctggtccaccacagatgccaaacgaattcattacttattgggatacaaaagttgagactaagcatccaatcaggctttattctcggtacattgatcgggtccatatattatttcgtttcacccatgaggaggctcgggatctcattcagcggtatctgaccgagcaccctgatcctaacaatgagaacatggtggggtacaataataagaagtgttggccaagagatgctagaatgaggcttatgaaacatgatgtcaatcttggaaggagtgtcttctgggatatgaagaatcgccttcctcgaagcatcacaacattggagtgggagaacagttttgtttctgtttacagcaaggataatccaaacttgctttttagcatgtgtggatttgaagtgaggatacttcctaaaattagaatgactcaagaagcattcagtaacacaagagatggtgtctggaatctccagaatgaacagacgaaagaaaggacagctgttgctttcttacgagttgatgatgaacacatgaaagtgttcgagaatcgtgtgaggcagattcttatgtcttccggttctactacattcacaaaaattgtcaataagtggaacacagctttaataggactcatgacttatttccgggaggcaactgtgcatactcaagagctgttggatttgctagtcaaatgtgaaaataaaattcagactcgtattaagattggactcaactcaaagatgcctagcaggtttccacctgtcattttctacacccctaaagaaattggagggcttggaatgttgtccatgggccacattttgattccacaaagtgatcttcgatacagccagcagacagatgttggagtaacccacttcaggagtgggatgagtcatgaggaggaccaactgattcccaacctttatcgttatatacagccttgggagagcgaattcattgattcacagcgtgtctgggctgaatatgctttgaagaggcaggaagcacaggctcaaaacagacgtttgacccttgaagatctggaagattcatgggatagaggtataccacgtataaacactttgtttcaaaaggatagacacactttggcttatgataaaggatggagggtgcgtactgatttcaagcagtatcaagttctcaaacaaaatcccttctggtggacacatcagaggcatgatgggaaattgtggaacttgaacaattaccgtactgatgttattcaagcccttggaggagttgaaggaattcttgaacatactttattcaaaggaacatattttccaacttgggagggtcttttctgggaaaaggcatctggctttgaggaatctatgaagtataagaagctcaccaatgctcagagatctggtctaaaccagatacccaaccgaagatttacactatggtggtccccaaccattaaccgagccaatgtttatgtgggtttccaagtgcagctagatctgactggtattttcatgcatggaaaaataccaactttgaagatatcccttattcagatattcagagctcacttgtggcaaaagatccatgagagtgttgttatggatctctgtcaggttttggatcaagagttggatgctttggagattgaaactgttcagaaggaaacaatccatccaaggaaaagctacaaaatgaacagttcttgtgcagacattcttctctttgctgcccatagatggccaatgtcaaagcctagtcttgtagctgaatctaaggatgtttttgatcagaaggcaagcaataagtactggattgatgttcagctacgatggggtgattatgactctcatgatattgagcgttacactcgggccaaatttatggactacacaacagataacatgtctatatacccatctcctactggggtgatgattggtcttgatttggcatataatttgcattctgcgtttgggaactggttcccagggtcaaaaccactacttcagcaggccatgaataagatcatgaagtcaaatcctgcactgtatgtgttgagggaacggataaggaaaggtttgcagttgtactcttctgagcccactgaaccatatttgtcttcccaaaactatggagagatattcagcaaccaaataatatggtttgttgatgacactaatgtgtatcgtgttacaattcataagactttcgaaggaaatcttacaacgaagcccatcaatggtgctatatttattttcaatccaaggactgggcagttgtttctcaaggttattcataccagtgtgtgggctggtcagaagcgtcttgggcagttggcgaagtggaaaacagcagaagaagttgctgctcttgtaaggtctttgcctgttgaagaacagccaaagcaaattattgtcactcgtaaaggaatgttggatccattggaggttcacctgctggatttccccaacattgttattaaaggaagtgaactgcaacttcctttccaggcatgtttgaaaattgagaaatttggggatcttatattgaaggccacagaaccccaaatggttttgttcaatatctatgatgactggctgaagagtatttcttcatacactgcattctccaggctgattctgattctgcgtgcactccatgtgaataatgaaaaggcaaaaatgttgctgaagcctgataaaactatcatcactgaacctcatcacatctggccttctctaagtgatgatcaatggatgaaggtggaggttgcattaagagatcttatactatcagattatgcaaagaaaaacaatgtgaatacttcagctttgactcagtctgagatccgtgatattatacttggagctgagattactccaccttctcaacagcggcaacagattgcagagattgagaaacaggcccatgaagcaaatcaggtgacagctgtgacaacaaagactacaaatgttcacggtgaagaacttatagtaaccaccactagtccttatgagcaagctgcttttggttctaagactgactggcgtgtcagagcaatatcagccacaaatttataccttcgcgtgaaccatatatatgtgaactctgaggatataaaggaaacgggatacacctatattatgccaaagaacattttgaaaaagtttatatgcgtagcagatcttcgaacgcaaatttctgggtacatgtatggcataagtcctccagataatcctcaggttaaagaaattcgctgcattgtgatgccaccccaatgggggacacatcaacaagttcatctgccatcagctcttccagagcatgatttcttgaatgatttggagcctttaggatggatgcatactcaaccaaatgaacttcctcagttgtcgcctcaggatctcacttcacatgccaagatcctagagaacaataagcaatgggatggggagaagtgtattatcttgacttgcagctttactcctggttcttgttctttaactgcatataagctcactccatctggttatgaatgggggcgtgttaataaggatacgggaagcaatccacatggttaccttcccacccattatgagaaggttcagatgctccttagtgatcgcttccttggtttctacatggttcctgataatggtccatggaattacaacttcatgggggtgagacacgcatcagggatgaaatatggagtgaagcttgggactcctagggaatattaccacgaggaccatagaccaacccatttcttagagttcagcaatatggaggaagtggagataactgctgagggagatcgagaggatacattctcttgagataaaaatatttttgtttgagatatataagtggcagatcctttaatttttgaaacttgtcagaatatgttgtattatctactgttttttcatcctagggattttgcaacaacggtatcatagctttgtatataattacgaatcaacaattctacttctacaaatatctgcttctgcatttactatatatccaattttagcaaattatgaaaggacg

SEQ ID NO: 966 - DNA, 3671 bp, Chelidonium majus
agataagaatgactcaggaggcttttagcaatacaaagatggagtgtggaacttgcagaatgaacagacaaaagagcgaactgctgtagcgtttttacgtgttgatgatgaacacatgaaagtgtttgagaatcgtgtaaggcagattcttatgtcatcagggtcaacgacatttacaaagattgtgaacaaatggaatactgctcttataggtcttatgacatatttccgtgaagcaactgtacatacccaggaacttctagatttgctagtcaagtgtgagaacaaaattcaaacccgtatcaagatcgggttaaattcaaaaatgccgagcaggttccctcctgtcatattctacacgccgaaagaaattggaggactcggcatgttatcgatgggtcacatattgattccacaaagtgatctcagatacagccaacagactgatgtcggagtaactcatttccggagtggaatgagtcatgaagaagaccagttgattccaaatctttatcgttacatacagccatgggagagtgaattcatagattcacagcgtgtttgggctgagtatgcattgaagaggcaggaagcacagtctcaaaacaggcggttaacactagaggatcttgaggattcttgggacaggggaatacctcgaatcaacactttgtttcagaaggaccggcacaccctggcatatgacaagggctggcgagtgcgtactgactttaagcagtatcaagttctaaaacagaatcctttttggtggactcaccagaggcatgatgggaaattgtggaacttgaacaactacaggacggatgtcatccaggctcttggaggagtagagggaattctcgagcataccttgtttaaaggaacatactttccaacttgggaaggtcttttctgggagaaagcgtctggtttcgaggaatccatgaagtacaagaagttgaccaacgcacaaagatctgggctcaaccaaatccctaaccgtaggtttaccctttggtggtcacctaccataaatcgtgctaatgtttacgtgggttttcaggttcaacttgacctaacaggaatctttatgcatggaaagattcctactttaaagatatctttgattcagattttccgtgctcatttgtggcaaaaggtacacgagagtgtagttatggatctctgtcaggttttggatcaagagttggatgctttggaaattgagactgttcagaaggagacaatacatccaaggaagagttataagatgaacagttcctgtgctgacattcttctgtttgctgcccatcggtggcctatgtcgaagcctagtttggtagcagagtcgaaggatatgtttgatcagaaagcgagcaataaatattggattgatgtgcagctccgctggggagactatgattctcatgatatagaacgttatactcgggccaaatttatggattacacaacagataacatgtccatctatccatctccaactggagtgatgattgggattgatttggcgtataacttgcattctgcatttgggaactggttccctggatcaaagccacttctggctcaagctatgaataagatcatgaagtcaaacccagctttgtatgttctgagggagcgaataaggaaaggtttgcagttgtattcatctgagcccacagaaccatatctatcgtcccaaaactatggagagattttcagcaaccagatcatatggtttgtcgatgacacaaatgtctaccgggttaccatccacaaaacgtttgaagggaatctcaccacaaaacccatcaatggtgctatttttatatttaatccaagaacgggtcaattgtttctaaaggtcatccatacgagtgtgtgggcaggacaaaagcgtcttggtcagctggccaagtggaaaacagcagaagaagtcgctgctttggtgcggtccttgcctgttgaagagcaaccaaagcaaatcatcgtcactcgtaagggaatgcttgatcctttggaggtgcacttgctcgatttccccaatgtagttatcaagggtagtgagttgcagttgccattccaggcgtgcttgaagatcgagaagttcggtgatttgattctcaaggctactgagccacaaatgcttcttttcaatctctacgacgattggttgaagagtatatcatcttacacagcattttcccgtcttattttgatcttgcgtgctcttcacgtgaataatgagaaagcaaaaatgctattgaagcctgatgctaagatcattactgagccacaccacatatggccttctctcactgatgatcaatggatgaaggttgaagttgctttgagagatctcatactctcagactatgcgaagaagaataacgtgaacacctcggcactgacccaatctgagatacgtgatattattcttggagctgagatcactccaccctcacagcagcggcaacaaatagctgaaattgaaaagcagaacaaggaagctagccagttgacggctgtcacaacaaggacgacaaatgtgcatggagatgaacttattgtcaccaccacaagtccttatgagcaagcggcattcgggtctaaaactgactggcgtgtgagagcaatctcagctacgaacctttatctccgagtcaatcacatctatgtaaattcagaggacattaaggagacaggctacacttatatcatgcccaaaaacattttgaagaaatttatctgtgtagcagatcttcgaactcaaattgcaggttacttgtatggtgttagtcccccagacaaccctcaagttaaggagatccgttgtatcgccatgccaccacagtggggacacatcagcaggttcatctcgtcagcacttccggaacacgacttcttaaatgatctagagccacttgggtggatgcatacacaaccaaatgaacttcctcaattgtcgccacaggatctaactagccatgcccggattcttgaaagcaacaagcagtgggatggggagaagtgtatcgtcttaacttgcagtttcactccaggctcgtgttcattaactgcgtataagcttacccctacaggttacgagtggggtcgtgtcaataaggacactggaagcaatccacacggttacctcccaactcattatgagaaggtccaaatgctcctcagtgaccgcttccttggattttacatggttcctgataatggtccgtggaattacaacttcatgggagtgaagcatactgtgagtatgaagtacggaattaagctggggacgcctcgagagtactatcatgaggaccacaggccaactcatttcctggagttcagtaacttggaggatggagagactgctgagggagaccgagaggatacattcagttaggcgaggtggatttgctatattgtattttgatgctcttaacatctttgtactttaggggctgctgctaatgaattagctcttttttttgttgtaaagaacttttgttaccatgctgtgcaattagcagcagcctatcttgtcagctggctggctgaagggtagagagtgaacacacacacaacccttctaagcctcctttgtaaaaaagagaaagtggatagtagttttaatgtctgatgaatggaaaatgatatattaa

SEQ ID NO: 967 - DNA, 3298 bp, Euonymus alatus
gccgagcagatttcctcctgtcatattttacactccaaaggaaattggaggacttggcatgttgtcaatgggtcacatattgatcccccagagtgatctacgatatagtcagcagactgatgttggtgtaacccactttaggagtgggatgagtcatgaagaggaccaactgattccgaatctttattcgctacatacagccctgggaaagtgagttcattgattctcaacgagtatgggcagagtatgcactgaagaggcaggaggctcaggcacagaatagacgcttaactcttgaggatctggaggattcttgggataggggaatcccacgtataaatactctgttccagaaggaccgacatactttggcatatgataaaggatggcgagtgcggacagacttcaagcagtaccaagttctgaaacaaaatcctttctggtggacgcaccagaggcatgatgggaaattgtggaacttgaacaactaccgaactgatgtcatccaagctctcggaggtgttgagggtattcttgagcataccttattcaaaggaacatactttccaacctgggaaggtctattctgggagaaagcatctggtttcgaggagtctatgaagtacaagaagctgactaatgcacaaagatctggtctcaaccaaattcctaatcgtagattcaccctctggtggtcaccaacaataaatcgggcaaatgtttatgttggtttccaagtgcagttggacctgactggaattttcatgcatggaaaaattccaactttgaagatctctcttatacagatattccgagctcatctgtggcagaagatccatgagagtgttgtcatggatctatgtcaagttctggatcaggagctggatgcattagaaattgagactgtgcagaaagagactattcatccacgaaaaagttacaaaatgaatagctcttgtgccgacgttcttctctttgctgcccataggtggcccatgtccaagcctagtcttgtggccgagtcaaaggacgtttttgatcaaaaagctagcaataagtattggatagatgtacagcttcgctggggcgactatgactctcatgatattgagcgttatactcgggctaagtttatggattacacgacagacaatatgtccatatatccctctccaaccggagtgatgattggccttgatctggcatacaatctacattctgcatttggcaactggtttcctggctctaaaccgctacttgccacagcaatgaacaagatcatgaagtcaaatccagctttatatgtcctgagggagcgtataaggaaaggtttgcagttatattcttctgagcctacggaaccatatttgtcatcccagaattacggagagatcttcagcaaccaaattatttggtttgttgatgatacaaatgtctatcgtgttacaattcacaagacatttgaaggaaatctcacgacaaaacctatcaatggtgccatttttatattcaatcctaggacagggcagctgtttttgaaggttatccatacaagtgtctgggctgggcagaagcgtcttgggcagctagcaaagtggaaaacagctgaagaagttgctgctcttgttcggtctttgcccgttgaggaacagcctaaacaaattattgttactcgtaaaggaatgctggatcctctggaggttcacttgctggatttcccaaacatagtcattaaaggaagtgagctgcagcttccattccaggcttgcttgaagattgagaaatttggtgatttgattttgaaggctactgaaccgcaaatggttttgttcaacatttacgatgattggttaaagagtatttcatcttacacagcattctctcgtctcatcctgattctccgtgcccttcatgtgaacaatgagaaggcaaagatgttattgaagccagacaaaacagttgttactgagccacatcatatctggccttctctgaatgatgatcagtggatgaaggttgaggttgctttaagagatctcatactctcagattatgccaagaagaacaatgtgaatacatctgctctcacccaatctgagattcgtgatattatacttggagcagagattaccccaccttctcaacagaggcaacagattgcagagattgagaaacaggccaaagaagcaagtcaactgactgcagtaacaacaaagactacaaatgtccacggtgatgaactcatcgtcaccacaacaagtccatatgagcaatctgcattcagttctaaaactgattggcgtgttagagctatatctgcaacaaatctctatcttcgagtcaatcatatatatgtaaactcggaggatataaaggaaactggatatacttacatcatgcccaagaatattttgaagaaatttatctgcatagcagatttacgaacacaaattgctgggtacttgtatggtataagcccccctgacaaccctcaggtcaaggagattcgttgtatcgcaatggtacctcagtgggggactcatcagcaagtacatcttccttcagctcttcctgagcatgattttctaaatgatctggagcctttaggatggatgcacacacagccaaacgaacttcctcagttatcaccacaggatctaacaagtcatgctcgaattctggagaacaacaaacaatgggatggagagaaatgcatcattttgacatgcagttttactccaggttcctgctcattgactgcatataagcttacaccaggtggctatgaatggggacgtctcaacaaggacacaggaagcaatcctcatggttatcttccgacacattatgagaaggtccagatgcttttaagtgatcgcttcctaggtttctacatggtacctgatactggtccatggaattacaacttcatgggggtgaagcatactgtaagcatgaagtacggcgtcaagctggggactcctcgagagtattacaatgaagaccacaggccgactcattttctggaattcagcaacctggaagagggcgatattgccgagggtgatcgggatgatacattcacttaatcagatgtcactagggttgggatttgatcattaatgtcacatgtattatacatattcaaattggtcgcaataccgaagttgtgttgatacatgttgcaaggaagttgtgttgatacatgttgcaagtcgaacatttttttcatctcggctgtagatagtgtgtttacaatgcaagtttttgcagagtttttgtttcgtatttttgtcct

SEQ ID NO: 968 - DNA, 7762 bp, Malus domestica
ttgtgggcttaaatacaatttgggtccttcaaatgctcacaccagagtccaactaccgaaacaagcccatcggtaaggcgttcttctgatcctcacccctcaactaccgtcacgctctcactctctctatcactctgagagaaaagacgagagccaaaccccgcaaaaccctagaaaccgcgaaccgccattgaagctcctcaaaagcttcttcgagtggaaacacaagcaggaaagctctctgtcacaagccttgtgcagggtttggcattcgattcggtttctggttccgcagtatgtggaacaacggccagattgcgccgcctggcaccggcggttcgtctattccgccaccgccggcggctcagccatcttacacggtgttgccttctccagctgatgccgaggctaagcttgaagagaaggcccggaaatggcagcagcttaattccaagcggtatagcgataagcgcaagttcggcttcgtcgagtcgcagaaggaggacatgcctcctgaacatgtcaggaagatcattaggttagtttttatctgctccactgtgatgtatatatctttgtatgtatttaatttggtgtcttttgacagggaccatggagatatgtcctcaaagaaatttcgtcatgataaacgagtgtatctcggagcacttaagtttgtcccccatgccgtttacaagctccttgagaacatgccaatgccatgggagcaggtccgggatgtgaaggttttgtaccatataactggggcaattacatttgtaaatgaaataccttgggttgttgaacccatctatttggctcagtggggttcaatgtggattatgatgagaagggagaagagggatcgtcggcatttcaaaagaatgcggtttccaccatttgatgatgaggaacctccgttagactatgctgataatctgttagacgttgatcccctagagccaattcaattggagttggatgaagaagaagattctgctgtgtatacatggttttatgaccataaacctcttgttaagacaaagctcataaacggcccaagttataggaagtggcatctgtcgcttcccatcatggcaactcttcatcgactagctggacaactgctttctgatcttattgaccgcaattatttctaccttttcgacatggagtctttttttacagccaaagcactcaatatgtgcattccaggtggacctaaatttgaaccattgtatcgggatatggagaaaggggatgaggactggaatgagtttaatgacatcaacaaactcattattcggtcacctctcagaacggagtacaggattgcattccctcatctctacaacaatagacccaggaaggtcaagctttgtgtgtatcacacacccatggtgatgtacataaaaaccgaggatcctgatctacctgcgttttattatgatccgttgatacacccaatacccagcagtaataaggataggcgtgagaagaaaacttctgatgaggaggaagatgatatctttacattgccagatgtggtggaaccatttctcaacgatactcagctttatactgacaccacagctgccggaatctctcttttgtttgccccacgcccttttaacatgagatctggtcggacccgtcgagcagaagatataccccttgtgtctgagtggtacaaggaacattgtcctccttcatatccagttaaagttcgggtcagctatcagaaattgctgaagtgttttgtattgaacgagctgcatcatagaccacccaaagctcaaaagaagaaacatttgtttcgatctcttcaagctaccaagttcttccaaactacagaacttgattgggctgaagcgggtcttcaagtctgtaagcagggttataacatgcttaatctgttgatccacaggaaaaatttgaattaccttcaccttgattataatttcaatctgaagcctgtgaagactttgacaacaaaagagcgtaagaaatctcggtttggtaatgcttttcatctgtgccgtgaaatcttgcggttgacaaagcttgtagttgatgccaatatccagttccgtttgggtaatgttgatgcctttcaattggctgatggcctacaatacacattttctcatgttggtcagttgactggaatgtaccgttacaagtacaggttgatgaggcagattagaatgtgcaaagatttgaagcacttgatttactaccggttcaatactgggccagtgggaaaaggaccaggatgtgggttctgggcaccaatgtggagggtgtggttgtttttccttcgtggcatagttcctcttctggaacggtggctgggaaatttacttgcacgacagtttgaagggcgccattcaaaaggagtggcaaagactgttactaagcagcgtgttgaaagccatttcgacttggagcttcgagctgctgtgatgcatgatgttcttgatgccatgccagagggtatcaagcaaaataaagccagaactatcttgcaacatctcagtgaggcatggcgctgctggaaagctaacatcccttggaaggttcctggtttgcctgttcctattgaaaatatgattcttcgttatgtgaaatcgaaggcagactggtggacaaatgttgctcactacaatcgtgaacgtataagaagaggtgctactgtagataagacagtttgtcggaagaatctaggaagattaactcgtctctggctaaaggcagagcaggagcgtcagcacaattatttgaaagatggtccatatgttacaccagaagaggcagttgcaatttacaccacaaccgtgcactggttggaatcaagaaagtttacacccattccgttccctccattgtcatacaaacatgacaccaagcttctgatccttgctctggagaggttaaaggagtcttatagtgtggctgtaagattgaaccagcttcaaagagaagagttgggtctcattgaacaagcctatgacaatcctcacgaggcattgtcacgaattaagcgccacttgctcactcagcgtgcattcaaagaagttggtatagagttcatggatttgtatagctatctgattccagtttatgagatagaacctcttgagaagattacggatgcatatcttgatcaatatttatggtatgagggtgacaaacgtcatctctttccaaactggattaagcctgcagattcagagccacctccactcttggtttataaatggtgtcagggaataaacaatttacagagcatatgggacacgagtgaggggcagtgtgtggtgatgcttcaaacgaagtttgagaagttttttgaaaagattgacttgacaatgctaaataggctcctgcgtcttgttcttgaccataatattgctgattatgtcactgcaaagaacaatgtggtactgtcttacaaagatatgagtcatacaaattcgtatggtctcatacgtggtcttcagtttgcatcttttgtagtgcaatattatgggcttgtgttggatctgttacttcttgggttgactcgggccagtgaaattgccggtccaccccagatgccaaatgaattcatcacctattgggacacaaaggttgagacacggcatcctatcaggctgtattctagatacatagacagggtgcatatcttgttccgcttcacccacgaggaggctcgtgatcttattcagcgatatcttactgagcatccggaccccaataatgaaaatatggttggatacaataataagaaatgctggccaagagatgccagaatgaggctcatgaaacatgatgtcaatcttgggaggagtgttttctgggatatgaagaaccgtctccctcgaagcatcacaactttggagtgggagaacagctttgtttctgtttacagcaaggataatccaaatttgcttttcagcatgtgtggatttgaagttcggatacttcccaagataagaatgagtcaagaagcattcagcaacactagggatggggtttggaatttgcagaatgagcagacaaaggagaggactgcagttgctttcttacgtgttgatgatgaacacatgaaggtgtttgagaatcgtgtgaggcagattcttatgtcctcagggtctacaacttttacaaaaattgtcaacaagtggaatacagcgcttattggtctaatgacttacttccgtgaagcaactgttcatacacaagaactgttggatttgcttgtcaaatgtgaaaataagattcagacccgtattaagattgggttgaattcaaagatgcctagcaggtttccacctgtcatcttttacacaccaaaggaaattggagggcttggcatgttatctatggggcacatattgattccacaaagtgacctccgcttcagtcagcagactgatgttggtgtgagtcattttaggagtggaatgagtcatgaaggggaccagctgattccaaatctttaccgttacatacaaccatgggagagtgaatttatagattcacaacgtgtttgggcagaatatgcactgaaaaggcaggaagctcaggcacaaaataggcgtctgactcttgaagatttggaagattcatgggataggggaataccacgcataaatactttgttccaaaaggatcggcatactttagcatatgacaaaggttggagagttcggacagattttaagcagtaccaagtgttgaaacaaaatcctttctggtggacacaccagaggcatgatggtaaattgtggaacttaaacaactaccgaactgatgtgattcaagcccttggaggtgttgaaggaatccttgagcatacgttattcaaaggaacatactttcctacctgggaggggctcttctgggagaaagcatctggttttgaggagtcgatgaagtataaaaagttgacaaatgcacagagatctgggctcaatcaaatccccaatcgtaggtttactctctggtggtcacctaccataaatcgggccaatgtatatgttggtttccaagtgcagctagatttaactggaatatttatgcacgggaagattccaaccttgaagatatcactgattcagatattccgtgctcacttgtggcagaagattcatgaaagtgttgtcatggatctctgtcaggttttggatcaagagttggatgctttagaaattgaaactgtgcagaaggaaacgatacatcccaggaagagttacaaaatgaacagctcttgtgctgacattcttctgtttgctgcccatagatggccaatgtcgaaacctagtcttgttgctgagccaaaggatgtgtttgaccagaaagcgagcaataagtactggatagatgtacaactccgttggggagattatgattctcacgatattgagcgttacacccgagctaagtttatggactataccactgacaacatgtccatctatccatctcccacaggggtgatgattggtcttgatttggcatataatttgcattctgcatttggtaactggtttcctggttcaaaaccgctgcttcaacaggcaatgaacaagatcatgaaatcaaatccagccttgtatgtcctgagggagcgaataaggaaaggattgcagctatattcttccgagcctacagagccatatttgtcatcccaaaactatggggagatcttcagcaatcaaatcatttggtttgtcgatgataccaatgtgtatcgtgttacaatccataagacatttgaaggaaatctcactacgaaaccaatcaatggtgctatcttcatattcaatccaaggacggggcagctattcctgaaggttatccacacaagtgtgtgggcaggacagaagcgtcttggtcagttggctaaatggaaaactgcagaagaagttgctgcacttgtgcgttctttgccagtggaagaacagccaaaacaaattattgtgactcgcaagggaatgttggatcccttagaggttcatttgctcgatttccccaacatagtcataaaaggaagtgagctccagcttcctttccaagcgtgtttgaagatcgagaaatttggtgatctgatattgaaggctactgaaccacagatggttcttttcaatatttatgatgattggttgaagagtatttcatcatacactgcattctctcggttaattttgattcttcgtgcacttcatgtgaacaatgagaaggcaaagatgttactgaagcctgataaaacggtcattaccgagccacatcacatctggccttctctttctgatgatcaatggatgaaggttgaggttgctctaagggatctcatattgtcagactacgcaaaaaagaacaatgtgaatacatcagccctaacacaatctgagatccgtgacattatactcggagctgagatcaccccaccttctcaacagagacagcaaattgcagaaatagaaaaacaggccaaagaagccagtcagctgacagcagtcacaacaaggactacaaatgtgcatggtgatgaactcattgtcaccactacaagtccctatgagcaaagtgcatttggctccaaaactgattggcgtgtgagagcaatatcagctacaaatctatatcttcgtgtcaatcatatatatgtgaattcagaagatataaaggaaacgggttacacctatattatgcctaagaacattttgaaaaagttcatctgcattgcggatctgaggacgcaaatagctggttacttgtatggcataagcccaccggacaaccctcaggtcaaggaaatccgctgcattgcaatgccaccacaatgggggacccaccaacaagttcatcttccatcagctcttcctgatcatgatttcctcaacgatttggagcctctgggatggatgcacacccagccaaatgagcttcctcagctttctcctcaggatctcacttctcatgccaagattttagagaacaccaagcaatgggatggggagaaatgcatcattttaacctgcagtttcactccaggttcctgctctttaaccgcatacaaacttactccatctggttatgaatggggacgtgtcaataaagacacaggaagcaatcctcatggataccttcccactcattacgagaaggttcagatgcttctcagtgaccgcttccttggtttctatatgattccggacaccggtccatggaactacaacttcatgggggtgaagcatacacctagcatgaagtacggcatcaagcttggaacgcccagggagtactatcacgaggaccacaggccgacccattaccttgagttcagcaacctggaggagggtgacacggtggaaggagatcgcgatgacactttcacataaacttgtgtcgcaagatgtaatgcaaaagtgacgggagtactttggcattcagaaaaaccaattctgtttttttctatggagctttttgttgtaagaatccatttgtggatgaaaatgctagtgcacctgtaaagctacgtgtgacgttagtatgttcgtgttttcagacgaggcctgtaaatatttgatttggtagcaaagtactagttttgttgctgaaagatgaaatttcctagtcatactcataagctcccctccttgaagtggtagaaagtagaatgcttgtagttcaagtattcacaaatctttagcaaagacaatgaggatgcgtcctgtaaattacttgagttaca

SEQ ID NO: 969 - DNA, 2401 bp, Malus domestica
aaagaaacgatacatcccaggaagagttacaaaatgaacagctcttgtgctgacattcttctgtttgctgcccatcgatggccaatgtcaaaacctagtcttgtagctgagcccaaggatgtctttgaccagaaagtgagcaataagtactggatagatgtacaactccgttggggagattatgattctcacgatattgagcgttacacccgagctaagtttatggactataccactgacaacatgtccatctatccatctcccacaggggtgatgattggtcttgatttggcatataatttgcattctgcatttggtaactggtttcctggttcaaaaccgctgcttcaacaggcaatgaacaagatcatgaaatcaaatccagccttgtatgtcctgagggagcgaataaggaaaggattgcagctatattcttccgagcctacagagccatatttgtcatcccaaaactatggggagatcttcagcaatcaaatcatttggtttgtcgatgataccaatgtgtatcgtgttacaatccataagacatttgaaggaaatctcactacgaaaccaatcaatggtgctatcttcatattcaatccaaggacggggcagctattcctgaaggttatccacacaagtgtgtgggcaggacagaagcgtcttggtcagttggctaaatggaaaactgcagaagaagttgctgcacttgtgcgttctttgccagtggaagaacagccaaaacaaattattgtgactcgcaagggaatgttggatcccttagaggttcatttgctcgatttccccaacatagtcataaaaggaagtgagctgcagcttcctttccaagcgtgtttgaagatcgagaaatttggtgatctgatattgaaggctactgaaccacagatggttcttttcaatatttatgatgattggttgaagagtatttcatcatacactgcattctctcggttaattttgattcttcgtgcacttcatgtgaacaatgagaaggcaaagatgttactgaagcctgataaaacggtcattaccgagccacatcacatctggccttctctttctgatgatcaatggatgaaggttgaggttgctctaagggatctcatattgtcagactacgcaaaaaagaacaatgtgaatacatcagccctaacacaatctgagatccgtgacattatacttggagctgagatcaccccaccttcgcaacagagacagcaaattgcagaaatagaaaaacaggccaaagaagccagtcagctgacagcagtcacaacaaggactacaaatgtgcatggtgatgaactcattgtcaccactacaagtccctatgagcaaagtgcatttggctccaaaactgattggcgtgtgagagcaatatcagctacaaatctatatcttcgtgtcaatcatatatatgtgaattcagaagatataaaggaaacgggttacacctatattatgcctaagaacattttgaaaaagttcatctgcattgcggatctgaggacgcaaatagctggttacttgtatggcataagcccaccggacaaccctcaggtcaaggaaatccgctgcattgcaatgccaccacaatgggggacccaccaacaagttcatcttccatcagctcttcctgatcatgatttcctcaacgatttggagcctctgggatggatgcacacccagccaaatgagcttcctcagctttctcctcaggatctcacttctcatgccaagattttagagaacaccaagcaatgggatggggagaaatgcatcattttaacctgcagtttcactccaggttcctgctctttaaccgcatacaaacttactccatctggttatgaatggggacgtgtcaataaagacacaggaagcaatcctcatggataccttcccactcattacgagaaggttcagatgcttctcagtgaccgcttccttggtttctatatgattccggacaccggtccatggaactacaacttcatgggggtgaagcatacacctagcatgaaatacggcatcaagcttggaacgcccagggagtactatcacgaggaccacaggccgacccattaccttgagttcagcaacctggaggagggtgacacggtggaaggagatcgcgatgacactttcacataaacttgtgtcgcaagatgtaatgcaaaagtgacgggagtactttggcattcagaaaaaccaattctgtttttttctatggagctttttgttgtaagaatccatttgtggatgaaaatgctagtgcacctgtaaagctacgtgtgacgttagtatgttcgtgttttcagacgaggcctgtaaatatttgatttggtagcaaagtactagttttgttgctgaaaga

SEQ ID NO: 970 - DNA, 7293 bp, Manihot esculenta
tggatcgtgaactgaccactatgtggaacaataatgcggaggcgcatatcgtgccaccgggaactggcggtccctctataccgccacctcctgctcccgcacagccatcttatactgtgcttgctccgcaaatacctccgacgcaggccgaggcggaggcaaagctcgaagagaaggctcgtaaatggcagcagcttaatacgaagaggtatagcgataagaggaagtttgggttcgtcgagacgcagaaagaggacatgcctcctgaacatgtcagaaaaattatcagagaccatggggacatgtcctccaagaaatttcgacatgataagcgtgtgtatcttggagctcttaaattcattccacatgctgtttacaagcttcttgagaatatgccaatgccctgggagcaggttcgtgatgtgaaggttctttaccatatcactggggctatcacttttgtgaatgaaattccctgggttgttgaacccatttacttggctcagtggggtacaatgtggatcatgatgcgaagagagaagagggatcggcggcattttaagcgaatgagatttccaccatttgatgatgaggaacctccattggactatgctgataatttgttagatgttgatcctctagagcctatccaattggagatggacgaagaagaagattctgccgtatacacttggttctatgaccataagccccttgtcaaaacaaagcttatcaatggtccaagttataggaagtggcatctctcccttcccatcatggcaactcttcatcggttggctggacaacttttatctgatctaattgatcgcaattatttttacttgtttgacatggagtccttctttacggctaaagcattgaacatgtgcatacctggtggtcctaagtttgaacctctgtatcgtgacatggagaaaggggatgaggattggaatgaattcaatgacattaacaagctcattattcggtcacctctccggacagaatacagaattgcattcccacatctttataacaataggcccagaaaagtaaagcttggtgtgtatcacacgcccatggtcatgttcattaaagccgaggatcctgatttacctgctttctattatgatccattgatacaccctataacatccactaacaaggaacgacgagaaaagaaggctcatgatgatgatgaggatgatgatttccttttaccggaaggagtagaacctttgctgcaagacactcagctttacacagacaccacagctgctggcatttccctgttgtttgcaccccggccttttaacatgagatctggccggatgcgacgagcagaggatataccccttgtgtccgagtggtataaggagcattgtccaccaacatatccagtgaaagttagggttagctaccagaagttgttgaaatgttttgttttgaatgagctgcatcatagaccacccaaagcacagaagaagaagcacttgtttcggtctctggctgcaaccaagttcttccaaacaacagaacttgattgggctgaagcaggcctgcaagtttgtaagcaggggtataatatgctgaacctgttgatacacaggaaaaatttaaattacctccatcttgattataattttaacttgaagcctgtgaaaacccttactacgaaggaacgcaagaaatcccgatttggtaatgcttttcatctctgccgtgagatcttgcgtttgacaaagcttgtggttgatgccaatatccagttccgactgggtaatgttgatgcattccaactagctgatggtctccaatatacattttcccatgttggccagttgactggcatgtaccgatataagtacaggctgatgcgacagattcgaatgtgcaaagacttgaaacatttgatatattaccgcttcaatacaggtccagttgggaaaggacctggctgtggattctgggcgccaatgtggagagtgtggttgtttttccttcgtggcattgtgcctcttctagaacggtggttagggaatctccttgcgcgacagtttgaagggcgtcattcaaaaggaacggccaagactgttacaaagcaacgggtggaaagtcacttcgatttggagcttcgtgctgctgtcatgcacgatgttcttgatgccatgccagagggtattaagcaaaataaagctagaaccatattgcagcacctcagtgaggcctggcgttgttggaaagccaacattccctggaaggttcctggtttgccagtgcctattgagaacatgatccttcgttacgtcaagtctaaagcagactggtggacaaatgttgctcactataatcgagagcgtataagaagaggtgcaactgttgataagacagtttgtcgaaaaaatcttggaagactgactcgcctttggctaaaggcagagcaggaacgacaacacaattatttgaaagatggtccatatgtcactccagaagaagcagttgccatttatacaacaactgtgcattggttggagtccagaaagttctctcccattcctttccctccactttcttacaagcatgacaccaagctattaattcttgctctagaaaggttgaaggaatcatatagtgtggctgtcagattgaaccaactgcagagggaagagctgggtctcattgaacaggcttatgataacccacacgaagctttgtcgcgaattaaacgtcacctgcttactcagcgtgccttcaaagaagtgggcatagagttcatggatttgtacagtgcattgattccggtttatgaaattgaacctcttgaaaaaataacagatgcatatcttgaccaatatttgtggtatgaaggtgacaagcgccatctatttcctaactggattaagcctgcagattctgagccaccaccactgcttgtttataaatggtgtcaaggtataaacaatttgcagggtatctgggatacgagtgaggggcagtgtgtagtgatgctacaaacaaagtttgagaagttctttgaaaagattgatttgacaatgttaaataggcttcttcgtttggtgcttgaccacaacattgctgattatgtcactgcaaagaataatgtggtgctgtcctacaaagatatgagccacacaaattcatatggtttgatacgtggtttgcagtttgcttcttttgttgtacagtattatggtcttgtgctagatctcttacttcttggattgactcgagccagtgagattgctggtccaccacaaatgccaaatgaattcatcacttattgggatacaaaagttgagacaaggcacccaattcggttatattctaggtatatagacagggtgcatatattgttccgcttcactcatgaagaggctcgagatctcatccagcgttatcttactgagcatcctgatcccaacaatgaaaacatggttgggtaccaaaacaagaaatgctggcctagagatgcaagaatgaggctcatgaaacatgatgtaaatcttgggaggagtgtattttgggatatgaagaatcgtctcccgcgaagtggtgtgggtttgaagttcgaatacttcctaaaataaggatgactcaggaagcattcagcaataccagagacggcgtttggaatttgcagaatgagcagactaaagagcgaacagccgttgctttcctacgggttgatgatgagcacatgaaggtgtttgagaaccgtgtgaggcagattcttatgtcttcagggtcaacgactttcacaaaaatagtcaataaatggaatacagccctgataggtttgatgacttatttccgtgaagcaactgtgcatactcaagagctattagatttgctggttaaatgtgaaaataaaatccaaactcgtatcaaaattggtttgaactcaaagatgccaagccggcaagtccttattcatgcattgactttgatttgatttcctcctgtcatcttttatacaccaaaagaaattggaggactcggcatgctatcaatgggtcacatattgatcccacaaagtgacctccgatatagccagcagacagatgttggtgtaacccacttccgcagtggaatgagtcatgaagaggaccagctgattccaaatctctatcgctacattcaggcatgcttaaagatgctgccttttttttcgtatttaccatgggagagtgagttcatagattcacagcgtgtatgggcagagtatgcccttaagcggcaggaagcacaggcacaaaacaggcgcttaaccctggaagacttggaagattcttgggacaggggaattccacgtatcaatactttatttcagaaagatcgccatactcttgcatatgacaaaggatggagagtgcgtacagatttcaagcaatatcaagttctaaaacagaatcctttctggtggactcatcagaggcatgacgggaaactttggaacttgaacaattacagaacagatgttatccaagctctaggtggtgttgagggaattcttgagcataccttgttcaaaggaacttatttcccgacttgggaaggtctcttttgggagaaggcatctgggtttgaagagtcaatgaagtataagaagctcactaatgcacagagatctggtctaaatcaaattcccaatcgaagatttactctttggtggtcacccacaataaatagggccaatgtctatgtgggtttccaagtgcagttggatctaactggcatcttcatgcatggaaagatcccaaccttgaaaatttcactgattcagatattccgagctcatctttggcaaaagattcatgagagtgttgtcatggatctgtgccaagtcttggatcaggaactggatgctctggaaattgaaactgttcagaaggaaacaattcatccaaggaagagttacaagatgaacagctcctgtgcagacattcttctctttgctgctcacaggtggcctatgtcaaagcctagtcttgttgctgagtcaaaagatgtgtttgatcagaaagccagtaacaaatattggatagatgtacagctcagatggggtgactatgactcccatgatattgagcgttacacaagggccaaatttatggattatacaacagataacatgtctatatatccatctccaactggggtgatgattggacttgatctggcatacaatttgcattctgcatttggtaactggtttcctggatcaaaaccgcttctagctcaggcaatgaacaagataatgaagtcaaacccagctttatatgtcttgagggaacggataaggaaaggtttgcagttgtattcttctgagcctacagagccgtatctgtcatctcaaaattatggtgagatcttcagcaatcagatcatatggtttgttgatgacaccaatgtgtatcgtgtcactattcataagacatttgagggcaaccttacaacaaaacccattaatggtgcaatatttatattcaatcctagaactggccagctatttctgaaggtcatccacactagcgtttgggcaggacagaagcgtcttggtcaacttgctaagtggaaaactgctgaagaagttgcagctcttgtgcggtctctgcctgttgaagaacaaccaaaacaaattattgtaactcgtaaaggaatgcttgatccgttagaggttcacttacttgatttcccaaatatagttattaaaggaagtgaattgcagttgccattccaggcgtgcttgaagatagaaaaatttggtgatttgattttgaaggcaactgagccacaaatggttctatttaatatatatgatgattggctgaaaagtatttcatcatacactgcattttccagactcattttgatccttcgtgcacttcatgtgaataacgagaaggcgaagatgctactcaagcctgacaaaacaatcattactgagcctcaccacatctggccttctctcaatgatgatcagtggatgaaggttgaagttgctttaagagatctcatactttcggactatgccaagaaaaacaatgtgaacacatcagcactgacgcaatctgagatccgtgatattattcttggtgctgaaatcactcctccatctcaacagaggcaacagatagcagagattgagaaacaggccaaagaagcaagtcaattaacagcagtcacaacaaagacaacaaatgtgcatggtgatgaactcattgtcaccaccactagtccctatgagcaggctgcatttgggtccaaaacagattggcgagtcagggcaatatcagctacaaatctataccttcgggtcaaccacatatatgtgaattcagaagatatcaaggaaactggatatacctatatcatgcccaaaaatattttgaagaagtttatctgcatagcagatctgcggactcaaatagcaggttacctgtatggtattagtcccccagataaccctcaggtcaaggagatccgcggtattgtcatggtcccacagtgggggactcatcaacaagttcatctcccatcagctcttcctgagcatgatttcctcaatgatctagagcccctgggatggatgcacacacaaccaaatgagcttcctcagttgtcaccacaggatcttacaactcatgctcggattttagagaacaacaagcattgggatggggaaaaatgcatcatcttgacttgcagttttacgccaggatcgtgctcattaactgcatataaactcacctcaagtggatatgagtggggacgtgtcaacaaggacactggaagcaatcctcatggttacttgccaactcattacgagaaggttcagatgctattgagtgatcgtttccttggtttttatatgactcctgacaatgggccatggaattacaattttatgggagtgaagcatacagtgagcatgaaatatgggctgaagctggggacgccacgggagtattatcatgaggatcatcgaccaactcattacctggaattcagcaacttggaggagggtgaaactgcagagggagaccgggaggataccttcacttgattttcaagtccgagtttaggcgctgcctttagttgtgtaaacaatgcttgatgaaaagacttttgtggtaatgcatgtatgccacatgttgatgtatatcagtgacgtgttcttaatgaactgtaaatactaaatacgtattctagaaattgaagcctacaaattgcaattatacaatgagctcttggtcgtctttatttttcgtg

SEQ ID NO: 971 - DNA, 4213 bp, Gnetum gnemon
gttgtgcagtactatggactggttttggacctgttggttctgggtttgacgcgagctagtgaaatagctggtcctccgcagatgccaaatgaatttattacttacagggatacaaaagtggaaacaagacatcctataagattatactctcgctacattgacaaagtacacattctctttcgatttactcatgaagaagctagggatctaatccagcgttaccttacagagcatccagatcctaacaatgagaacatggttggatacaataacaaaaaatgttggccacgagatgcccgaatgaggcttatgaaacacgatgttaaccttggaaggagtgtattctgggatattaaaaccaggctgccacgcagcattacgacacttgaatgggaaaacagttttgtatcggtttacagcaaggataatcctaatttgttgttcagcatgtgtggatttgaagtgagaatattaccaaagataaggatgactcaagaagcatttagcaatacaaaagatggtgtttggaacctgcagaatgaacaaaccaaagagcgtactgctgttgcattcttgcgtgtcgatgatgagcacatgaaggtttttgaaaatcgtgttagacagattcttatgtcatctgggtcaaccacgtttactaagattgtaaacaagtggaacactgctcttataggactcatgacctacttccgtgaagcaactgtacatacccaggagcttctagatttgcttgtgaaatgtgaaaataaaattcagacacgtattaagattggcttaaattccaaaatgcctagcaggtttcctcctgtcatattctatactccaaaaggaaataggaggattagggatgttgtcaatgggacatattttgattcctcagagtgacttacgttacagtcaacaaacggatgttggtgttacccacttccgaagtgggatgagccatgaagaagatcagcttataccaaatctttatagatatatccagccgtgggagagtgagttcatagattctcagcgtgtctgggcagagtatgcgctaaaaagatctgaagcgcaaacccaaaatagacgtttaactttagaagatcttgaggactcttgggacagaggaattcctcggatcaatactttgtttcagaaagatcgacacactcttgcctatgacaaagggtggagagtgcgcactgattttaaacaataccaagtgttgaaacaaaatccattctggtggacccatcaaaggcatgatggcaaactctggaacttgaacaattatcgcactgatgttattcaggctcttggaggagttgagggcattttggaacacacactttttaaaggaacctactttcctacttgggaaggtcttttctgggagaaggcctcagggtttgaggagtctatgaaatacaagaagcttacaaatgcccagagatcaggattgaatcaaattccgaatcgacgattcactctatggtggtctccaacaatcaatcgtgcaaatgtatatgttgggttccaagtgcagttggacttgacaggaattttcatgcatggaaaaattccgactctgaagatctcactgattcagatttttagagcccatttgtggcagaaagtgcatgaaagtgttgttatggatctttgtcaagtgcttgatcaagagttggatgcactggaaattgaaactgttcaaaaggagaccattcatccaaggaaaagttacaagatgaatagttcatgtgcggacattcttcttttgcagcattcaagtggccaatgtgcaagcctagtcttgtggcagaatctaaagatgttttgatcagaaacctagtaataaatactggatcgatgttcaacttcgatggggagattatgattcccatgatatagagagatacacgagagccaagttttggattacactacagacaacatgtcaatatacccatcacccaccggtgtgatgataggaattgatcttgcctataatttgcattctgcttttggtaactggtttcctggttccaagccacttcttgcacaagctatgggtaaaattatgaaggcaaatcctgcattgtatgtcttgagagagcgtataagaaagggtctgcagctgtattcttctgaaccaacagaaccttatctgtcatctcaaaattatggggagatcttcagcaatcaaatcatatggtttgtagatgatactaatgtgtatcgtgtcaccattcacaaaacatttgaaggaaatcttactacaaagccgataaatggagctattttcatcttcaatcctagaacaggacagctcttcctgaaggttattcacacaagtgtgtgggctggacagaagcgtcttggtcaattagcgaaatggaagacagctgaagaagttgctgccctggtacgatcgcttccagttgaggagcaaccaaaacaaattattgttactcgaaaagggatgcttgatccattggaagtccacttgcttgactttccaaacattgttattaaaggcagtgaattacagctgcccttccaggcatgtttgaaaattgaaaagtttggtgacctcattctgaaggcaacggaaccacaaatggttctttttaatatttatgatgattggctgaagtcaatctcttcttacacggccttttcacggttgatacttatccttcgagctttgcatgttaacaatgagaaagctaagatgcttctgaagccagacaagaccattgtcacagagccacatcatatatggccgagtctcacagatgatcaatggatgaaggttgaagtggcactcagagatcttatactttcagattatgcaaagaaaaaaaatgtgaacacgtctgctttaacgcaatcagagatccgtgatataatccttggagctgagatcacccctccttcacagcaaaggcaacaaattgcagaaattgagaaacaggccaaagaagcgagtcagcttactgcagttacaacgaggacaaccaatgtgcatggtgatgagctgattgtaaccacaaccagtccatatgaacaagctgcctttggttccaaaactgattggcgtgtgcgggcgatatcggcaactaacctgtatctcagagttaatcatatctatgttaactcagatgatatcaaggaaatgggatatacgtacattatgccaaagaacattttgaagaagttcatttgtattgctgatttaagaacccagattgcaggctatatctatggcataagcccccctgacaatccacaggtgaaggaaattcggtgcatagcaatgcccccacagtggggcacccatcagcaagtacacctgcctttggcgttgccagaacatgaatttttgaatgatttagaacccttgggatggatgcatacccaacccaatgagctaccgcagttatcacctcaggatctgacatctcatgcacgaattttggagaacaataaacaatgggatggagagaaatgtatcattctcacatgcagcttcacccctggttcttgctccttggccgcatacaagctcactcccacagggtatgaatgggggaggcttaacaaggattcaggcagcaaccctcatggttatctgccaactcattatgagaaagttcaaatgcttctgagtgatagattcctgggtttctatatggtcccggatagcggttcttggaattacaatttcatgggtgtcaagcacactgtcagtatgaggtatggagtgaagccaggaaatcctcgtgacttttatcatgaagagcatcggccaacacactttttggagtttagtaatttggaagagggtgatcatgtggagggagatgctgaggatgtgtttgtctgaagttaggctgaactgtcgacatggttatgattggagctagcttacacagcatatgaacttgtataattaaagaaaatacactttgtataggcggggacattttcttggcaacggtatgacatgcaaatacagcgcagttgttaagcctgagtattaatgctgtgcttcaattttattttattttctgttgtgagatgtattattttttgttaacttgattattaggtatttgccataattgcgtttagatctctctaagataattagtcagatttgtaagaatgacagttttatagcatctaataataccgctgctaattg

SEQ ID NO: 972 - DNA, 3040 bp, Zostera marina
aggatcttgaggattcatgggacaggggtattcctcgcatcaataccctctttcaaaaagaccgtcataccttggcatatgataaaggctggagggtgcgcacagattttaagcagtatcaggttttgaaacaaaatcctttttggtggactcaccagagacatgatggaaaattatggaatttgaataattaccgtactgatgtcattcaagcactcggaggagttgagggaatactttgtaactattactatttatttctaaaggtaactattattttccaacctgggaaggtcttttttgggagaaagcttctggttttgaggaatctatgaagtataaaaaactaaccaatgcccagcgctcaggtttaaatcaaattccgaaccgtcgatttacactctggtggtctcctaccatcaatcgagccaatgtttatgtagggtttcaagtgcagttagatctcacaggaatatttatgcatggcaaaattccaaccttgaagatatctttgattcagatattccgtgctcatctttggcagaaggttcatgagagtgttgtcatggatctttgccaggttttagatcaggagttggatgctttagaaatcgagacagtgcaaaaagaaacaatacatcctaggaagagttataaaatgaatagttcttgtgcagacatccttcttttcgcggcacatagatggcctatgtccaaacctagtttagtagctgaatcaaaggatgtatttgatcagaaagcaagcaacaagtattgggttgatgttcaacttcgatggggtgattatgattctcatgacattgagcgttacaccagggccaaattcatggactacactacagacaatatgtctatttatccatctcccactggagttatgattggaattgatctagcatacaatttgcattctgcatttggtaattggtttcctggttcaaaaccattattggctcaggctatgaataagatcatgaaatctaatccagctttatacgtcttgagagaaagaataagaaaaggtctacagctttattcatctgaaccaacagagccatacctatcatctcaaaattatggagagattttcagtaaccaaataatatggttcgtcgatgatacaaatgtatatcgggtaacaatccacaaaacgtttgaaggaaaccttaccacgaaacctataaatggtgctatctttatatttaaccctagaacaggacagcttttcttgaaggttattcacactagcgtatgggcagggcaaaagcgtttgggtcagctagctaagtggaaaacggcagaagaagttgctgcccttgtgcgttcacttcctgttgaagagcagccaaagcaaattattgtgactcgtaaaggaatgttggatcctttagaggttcatttgcttgattttccaaatattgtaatcaaaggtagtgagcttcagttgccattccaagcttgcctgaaaattgaaaaatttggtgatttaatactgaaggcaacagaacctcagatggttcttttcaatatatttgatgattggttaaaaagcatttcgtcatatactgcatttagccgtctagttttgatattgcgtgctcttcatgtaaataatgagaaagccaaaatgctgttgaaacctgataaaacaattgtcaccgagccacaccatatatggccttctctcaatgatgatcaatggatgaaggttgaggttgcattgagggatcttattttatctgattatgcaaagaagaataatgtgaatacttcagccctgacacagtctgaaattcgtgatatcattcttggagccgagataactccaccatctcagcaaagacagcagattgcggaaattgagaaacaggctaaagaagctagtcagctaacagctgtcacaacaagaaccacaaatatccatggcgatgagctcattgttaccacaactagtccttatgagcaatcagcacatctttctaaaactgattggcgtgtcagagctatttcagcgacaaatttgtatctccgtgtcaatcatatatatgtgaattcagatgatataaaggaaacgggctatacttatatcatgcctaaaaatattctcaagaaattcatctgtgtagctgatcttcggactcagattgctggatatttatatggtttaagtcctcaggataatcctcaagtgaaagaaattagatgtatagtgatgcctcctcaatggggaacacatcaacaggtccatcttccatcttcacttccagatcatgactttttgaatgaccttgaacctcttggttggatgcacacccaacccaatgaattaccgcagctctctcctcaggatctcactagtcatgccaaggtgcttgagaataataaacagtgggatggggagaagtgcattattttaacttgcagtttcacacctgggtcgtgttctttaacagcctacaagctcacaccaacaggttatgaatggggccgtgttaataaagatactggaagtaatccacatggttatctgccaactcactatgagaaggttcagatgctcctcagtgatcgttttcttggtttctacatggttccagatactggcccatggaattacaacttcatgggtgtgaagcacacccaaagcatgaggtatggtgtgaaacttagcatacccagagactattaccatgaagatcacaggcctactcatttcctggaattcagtaatttggaggaggccaatcaggtggatggtgatcgggaagatactttcacataatctaagcttgatacttgatttaataataatttagtagtgtgggcacgaatatgatacctgcctgataatagtagctttgtactcattagtttgtgttggcagaacattctagtttttttgtatagtattattttgtacttgtacacgagttatgaaaaatgaggtcaagggttttcatctttctattccttttacattgggttaatattgctaattatcatccaggcttattatccc

SEQ ID NO: 973 - DNA, 7403 bp, Prunus persica
ctctcactctctctatctcactgagagaagagagccaaaccccgcaaaaccctagaaaactcgaaccgccattgaagctcggaaggcttcttcgcgcggaagcacaagcaggcaaactctatctatctctctctcacaatccttgtgcagagtttgatactcgattcggttttgtttccgcagtatgtggaacaacggccagattgcgccgcctggcaccggcggttcgtcgatcccgccaccgccggcggctcagccctcttacacggtattgccttccccggctgatgccgaggccaggctcgaagagaaggcccggaaatggcagcagctcaattccaagcggtacagtgataagcgcaagttcggctttgtcgagtcgcagaaagaggacatgcctcctgaacatgtcaggaagatcattaggttagttttcttctgtttaatttttgatgcatatagttttccttatctttgtgtttatgttgacagagaccatggggacatgtcttcgaagaaatttcgtcatgataaacgagtgtatctaggagcacttaaatttgttccacatgcagtctacaagctccttgagaatatgccaatgccatgggagcaggtccgtgatgtgaaggtcttgtatcatataaccggggcaattacatttgtgaatgagataccctgggttgttgaacccatctatttggctcagtggggtacgatgtggattatgatgagaagagagaagagggatcgtcgacatttcaaaagaatgcggtttccgccatttgatgatgaagaacctccattagactatgctgataatctgttagatgttgatcccctagagccaattcaactggagttagacgaagaagaagattccgctgtgtatacttggttttatgaccataaacctcttgttaagacaaagctcattaatggtccaagttatcggaagtggcatctttcgcttccaatcatggcaacccttcatcgacttgcaggacagctactttctgatttgattgaccgcaattatttttacttgtttgacatggagtccttttttacagccaaagcactgaatatgtgcatccctggtggacctaaatttgaacccttgtatcgggatatggagaaaggggatgaggactggaatgagttcaatgacattaataaactcattattcggtcacctctcagaacagagtacagaattgcattccctcatctctacaacaatagacccaggaaggtaaagctttgtgtgtatcacacacccatggtgatgtacataaaaaccgaggatcctgatctacctgcgttttattatgatccattgatacacccaatacccagcaccaacaaggagcggcgtgagaagaaaacttttgatgaggaggaagatgatgtttttggtttaccggagggggtgggaccatttctgcaagatactcagctttatactgacaccacagctgctggaatctccctcttgtttgcgccacgcccttttaacatgagatctggtcggacacgtcgagcagaagatataccccttgtgtcagagtggtataaggaacattgtcctccgtcgtatccagttaaagttcgggtcagctatcagaaattgctgaagtgttttgtgttgaatgagctacatcatagaccacctaaggctcaaaagaagaaacatttgtttcgatctcttcaagctactaaatttttccagactacagagcttgattgggctgaagcgggtcttcaagttagcgtaagaaatcccggtttggtaatgcttttcatctttgcccgtgaaatcttgcggttgacaaagcttgtagttgatgctaatatccagttccgtttgggtaatgttgatgccttccaattggctgatggcttgcaatacacattttctcatgttggtcagttgactggaatgtaccgttacaagtataggttgatgaggcagattagaatgtgcaaggatttgaagcatttgatttactatcggttcaatactgggccagttgggaaaggacccggatgcgggttctgggcaccaatgtggagggtatggttgttcttccttcggggcatagttcctcttctagaacggtggttgggaaatttacttgcaaggcaatttgaagggcggcattcgaaaggcgtggcaaagactgtaactaagcagcgtgtcgaaagccattttgacttggagcttcgagctgctgtcatgcatgacgttcttgatgccatgccggagggcatcaagcaaaacaaggcaagaactatcttgcaacatctgagcgaggcgtggcgttgctggaaagcaaatattccttggaaggttcctggtttgccagttcctattgagaatatgattcttcgttatgtcaaatcaaaggcagactggtggacaaatgttgcccactataatcgcgagcgcataagaagaggtgctacagtagataagacagtttgtcggaagaatcttggaagattaactcgcctttggctaaaggcagagcaggagcgacagcacaattatctgaaagatggtccatatgttacacctgaagaggcagttgcaatctacacgacaaccgtgcactggttggagtcgagaaagttcagccccattccgttccctccattgtcatacaaacatgatacaaagctacttatccttgctttggagaggctgaaggaatcttatagcgtggctgtaagattgaaccagcttcaaagagaggagctgggtctcattgaacaagcctatgataatccacacgaggcattgtcacgaattaagcgtcacttgctcactcagcgtgccttcaaagaagtcggtattgagttcatggatttgtatagctatcttattccagtttatgagattgaacctcttgagaagattacggatgcatatcttgatcaatatttatggtatgagggtgacaaacgtcatctctttccaaactggatcaagcctgcagattctgagccacccccgctcttggtttataaatggtgtcagggaataaacaatttacagagcgtatgggacacaagtgaggggcagtgtgtggtgatgcttcaaacgaagtttgagaagttctttgaaaagattgacttgacaatgctaaataggcttctacgtcttgtccttgatcataatattgctgattatgtcactgcaaaaaacaacgtggtattgtcttacaaagatatgagtcatacaaattcttatggtcttatacgtggtcttcagtttgcatcgtttgttgtacaatattatgggcttgtgttggatctgttgcttcttggattgactcgagccagtgagattgctggtccaccccaaatgccaaatgagttcatcacttattgggacacaaaggttgagactcggcatcctatcaggctgtattctcgatacatagacagggtgcatatcttgttccgcttcactcatgaagaggctcgggaccttatccagcgatatctgactgagcatccagatcccaataatgaaaatatggttggatacaataataagaaatgctggccaagagatgctcgaatgaggctcatgaaacatgatgtcaatcttggaaggagtgttttttgggatatgaagaaccgtcttcctcgaagtatcaccactttggagtgggaaaacagctttgtttctgtttacagtaaggataatccaaatttgcttttcagcatgtgtgggtttgaagttcgaatacttcccaagataagaatgagtcaagaagcatttagcaacacgagggatggggtctggaatttgcagaatgaacagacaaaggagaggactgcagttgctttcttacgggttgatgatgaacacatgaaggtgtttgaaaatcgtgtgaggcagattcttatgtcttcagggtctacaacatttacaaaaattgtcaacaaatggaatacagcacttattggtcttatgacttatttccgtgaagcaactgtacatacacaagagctgttggatttgctggtcaagtgtgaaaataaaatacagacccgtattaagattgggttgaattcaaagatgcctagcaggtttccgcctgtcattttctacacaccaaaagaaattggaggacttggtatgttatctatgggtcatatattgattccacaaagtgacctccgatacagtcagcagacggatgttggtgtgactcactttaggagtggaatgagtcatgaagaggaccagctgattccaaatctttaccggtacatacaaccatgggagagtgaatttatagattcacagcgtgtttgggcagaatatgcactgaaaaggcaggaagctcaggcacaaaataggcgtctaacgcttgaagatttggaagattcatgggataggggaattccacgaataaatactttgttccagaaggacaggcacactttagcatatgacaaagggtggagagttcgcacagattttaagcagtaccaagtcttgaaacagaatcctttctggtggacacaccagaggcatgatggaaaattatggaacttaaacaactaccgaactgatgttattcaagcccttggaggtgttgagggaatccttgagcatacattattcaaaggaacatactttcctacttgggaggggctcttctgggagaaggcatctggttttgaggagtcgatgaagtataagaagttgaccaatgcacaaagatctgggctcaaccaaatccccaatcgtaggtttactctttggtggtcacctaccataaatcgtgccaatgtttatgtcggtttccaagtgcagctagatttaactggaatcttcatgcatggcaagattccgaccttgaagatttcactgattcagatattccgtgctcacttgtggcagaagattcatgaaagtgttgtcatggatctctgtcaggttttggatcaagagttggatgcgttggaaattgaaacagtgcagaaggaaacaatacatcccaggaagagttacaaaatgaacagctcctgtgctgacattcttctgtttgctgctcatagatggccaatgtcgaaacctagtctagtagctgagccaaaggatgtgtttgatcagaaagctagcaacaagtactggatagatgtacaactccgttggggtgactatgattcccatgatattgagcgttacacccgagctaagtttatggactataccactgacaacatgtctatctatccttctcccacaggggtgatgattggtctcgatttggcttataatttgcattctgcatttggtaactggtttcctgggtcaaaacccctgcttcagcaagcaatgaacaagatcatgaaatcaaatccagccttgtatgtgctgagggagcgaataaggaaaggattgcagctctattcttctgagcccacggaaccatatttgtcatcccaaaactatggagagatcttcagcaaccaaattatttggtttgttgatgacacaaatgtttatcgtgttacgatacataaaacatttgaaggaaatctcacgacaaaacccatcaatggagctattttcatattcaatccaaggactggtcagctgttcctgaaggttatccacacaagtgtctgggcaggacagaagcgtcttggtcaattggccaagtggaaaactgctgaagaagttgctgcacttgtgcgctctctgcctgttgaagaacagccgaagcaaattattgtgactcgtaagggaatgttggatccattggaggttcatttgcttgatttccccaacatagtcataaaaggaagtgagctgcagcttcctttccaggcttgtctgaagattgagaaatttggtgatctgatattgaaggcaactgaaccgcagatggttctgttcaacatttatgatgattggttgaagagtatttcatcatacactgcattctcccgactaattctgattcttcgtgcacttcatgtaaacaatgagaaggcaaagatgttattgaagcctgataaaacagtcattactgagccacaccacatctggccttctctttctgatgatcaatggatgaaggttgaggttgctctaagggatctcatattatctgactatgcaaaaaagaacaatgtgaatacatcggccttgacacaatccgagatccgtgacattatacttggagctgagatcactccaccttctcaacaaaggcagcagattgcagagatagaaaaacaggctaaagaagccagtcagctgacagcagtcacaacaaggactacgaatgtgcatggtgatgaactcattgtcaccactacgagtccctatgagcaaaatgcttttggttccaaaacagattggcgtgtcagggcaatatcagccacaaatctatatcttcgtgtcaatcatatatatgtgaattcagaagatataaaggaaacgggttacacctatattatgccgaagaacattttgaaaaaattcatctgcattgcggatctgaggacacaaattgccggttatttgtatgggataagccctcctgacaaccctcaggttaaggagattcgttgcattgccatggcaccacagtgggggacccatcagcaagttcatcttccatcagctcttcctgagcatgattttctcaacgacttggaacctttgggatggatgcacacgcagccgaatgagcttcctcagctttctccacaggatctcaccactcatgcaaagattttagagaacaccaagcaatgggatggggagaaatgcatcatcttgacctgcagtttcactccaggttcctgctcgttaactgcatacaaacttactccatctggttatgagtggggacgtgtcaacaaagacaccggaagcaatcctcacggataccttcccactcattatgagaaggtccagatgcttctcagtgaccgcttccttggtttctatatgattccggacactgggccatggaactacaacttcatgggggtgaagcatacgcctagcatgaagtatggcatcaagcttgggacccctagggagtactatcacgaggaccatcggccgacccattaccttgagttcagcaacttggaggagggtgacacagtggagggtgatcgcgatgataccttcacgtaaacgtttgttctggcatgtaacacagccttttttgttgtagcaatccatttagcaattaatatgcttgtgcacctgtaaagctactagtaatgttcatgtttttagacgaggcctgtaaatatttgatctagaggcaaattacaagttttgttaccgaagatatgaattttatttttctctctccctttctccttgagttgggaggcagaatccttgtatt

SEQ ID NO: 974 - DNA, 7331 bp, Solanum lycopersicum
ccacctatgatgcctccgccacctggtacgagttcagtacagcctatgatgcctcctggaacaagtggtggaggagctagtggtgctggaccgcctttaccacctccatcttatactgttttgccgactgaagctcagcttgaagagaaagctaggaaatggatgcagcttaactctaagcggtatagtgataagcggaagtttggatttgtggagacgcaaaaggaggacatgcctccggaacatgttcggaagattattagggaccatggggatatgtcttcaaaaaaatatcgtcatgataaacgtgtgtatctcggagctcttaaatttgtaccgcatgctgtttacaaactccttgagaacatgcctatgccgtgggagcaggttcgagatgtaaaaatcctgtaccatattactggtgctattacattcgttaacgagattccatgggttgttgaacctatatatctggctcagtggggcacaatgtggatcatgatgagaagggagaagagagaccggcgacatttcaagagaatgcgttttcctccctttgacgatgaggaaccaccgttagattatgctgataatcttttggatgttgatcctttggagccaatccagttggagttggatgaagaagaggattctgcggtttataactggttttatgaccataagccactggtgaaaacaaagcttattaatggtcctagttaccgcaggtggcatttgtccctccctataatggcaacacttcaccgactggctggacagcttctttcagacctgactgatcgcaattacttctacttgtttgatatggagtcctttttcactgctaaagcattgaacatgtgcatacctggtggtccaaagttcgaacctttatatcgtgacatggagaaaggagatgaagactggaacgagttcaatgatatcaacaaattgatcatcaggtcaccacttaggacagagtacagaattgccttccctcatctctataacaacaggccaagaaaggtcaggcttggcatatatcacactccgatgatcatgtacataaaaacagaggatcctgatctacctgctttttattatgatccgctgatacatcccatagtcaccaaggaccgaagagagaagaaagtttctgatgacgacgacgacgatgatttcgccttacctgagggtgtggaaccgttgctgacagagactccaatctatactgatactactgctgctggtatctccctattgtttgccccacgcccatttaacatgagatctggtcgaacaagacgtgctgaagatattccccttgtttctgattggtttaaggagcactgtcctccatcatatcctgtcaaggttcgcgtcagttatcagaagttgttgaaatgttttgtattgaacgagttgcatcacagaccccccaaggcccagaagaagaagcacctctttcgctcacttcaagccacaaaatttttccaaaccacagaacttgattgggcagaggctggtcttcaagtttgtaagcagggatataatatgctgaatctcttgatccataggaagaacctgaactatcttcatcttgattacaattttaatttgaagcctgttaagacactaactaccaaggagcgtaagaaatcgcggtttggaaatgctttccacctttgtcgtgaaattctgcgtttgacaaagcttgttgttgatgccaatgtccagtttcgtctgggaaatgttgatgcgtttcagctggcagatggcttgcaatacattttctcgcatgttggtcagttgacgggtatgtatcgttacaagtacaggcttatgaggcagattcggatgtgcaaggatctgaaacatttgatctattatcgatttaataccgggccagttggaaaaggtcctggttgtggtttctgggcacctatgtggagggtgtggttattctttcttcggggtatagtacctcttttggaacgttggttaggaaatctactggcaaggcaatttgagggtcgccattcaaagggggtggccaagactgtcacaaagcaacgtgttgaaagccatttcgatttggaactccgtgctgcagtaatgcatgatgtccttgatgctatgccagaggggatcaagcaaaataaagcaagaaccatcttacagcatcttagtgaagcatggcgttgttggaaggcaaatattccttggaaggtcccgggtttgcctgttcctattgagaacatgattctccgctatgtcaaatccaaagctgattggtggacaaatgttgctcactacaatcgtgaacgtataagaagaggagcaactgttgacaagacggtgtgccggaaaaaccttggaagattgactcgcctttggctgaaggctgaacaggagcggcaacataattacttgaaagacggaccatatgttactccagaagaagcagtagccatatatactaccactgtgcattggttggagtccaggaagttttctcctataccattccctccgttgtcatacaagcatgacacaaagctactaatccttgcacttgagagactgaaagaatcttacagtgtggctgtgaggttgaaccagcagcaaagggaagagttgggtctcattgagcaagcttatgataatcctcatgaagcattatcacgaattaagcgtcatctgcttactcagcgtgccttcaaagaagttggtattgagtttatggacttgtacagctacctcattccagtttatgagattgagccacttgagaagattactgatgcatatctggatcagtacctatggtatgaaggtgataagcgtcatctcttcccaaattggattaagcctgccgactcagagccaccacctctgttggtgtacaaatggtgtcaaggcataaacaatttgcaaggagtatgggacactagtgaaggacagtgtgtggtgatgctgcagaccaagtttgagaagttctttgaaaagatcgacttgaccatgctgaacaggcttctgcgtttggtgctcgaccacaatattgctgattatgtcactgcaaaaaacaatgtcgtgctgtcttacaaagatatgagccatacaaattcatacgggctgatacggggccttcagtttgcttcatttgttgtacagtactatggacttgtgttggatcttttgctccttggtttaactcgagcaagtgaaattgcgggtccaccacagatgcctaatgagttcattacctatagtgattctagagtggaaacaaggcatccaatccggttgtactctcgatacattgacaaggtgcatatattatttcgcttcactcatgaagaggctcgggaccttatccaaagatatcttactgagcatcctgatcccaacaatgaaaatatggttggttataacaacaagaaatgctggccaagggacgcaagaatgaggctcatgaagcatgatgttaatcttgggagaagtgtcttctgggacatgaagaatcgactgcctagaagtatcactactttggagtgggaaaatagctttgtctctgtatatagcaaagataatcctaacttgctcttcagcatgtgtgggtttgaagttcggatactgcctaagattagaatgacccaagaggcattcagcaatacaagagacggagtctggaatttgcaaaacgagcagactaaggaacgcacggctgttgccttcttgcgtgtagatgatgaacacatgaaggtgtttgagaatcgtgttaggcagatacttatgtcctctggctctacaacattcacaaagatcgttaacaaatggaacactgctcttattggcctcatgacatatttccgtgaagcaacggtgcatacacaagagttgctggacctgctggtcaaatgtgaaaacaagatacaaactcgtattaagattggtttgaactcaaaaatgcctagcaggtttcctcctgttattttctacacaccaaaggaaattggagggcttggaatgttgtcaatgggtcacatattgatcccccagagtgatcttaggtatagtcagcaaacagatgttggtgtcacacatttcagaagtggaatgagccatgaagaggaccaattgatcccaaatttgtaccggtacatacagccttgggaaagtgagtttatagactctcagagagtttgggccgagtatgctttgaaaaggcaggaagcccaggcacagaataggcgcttgactcttgaagatttggaagactcatgggatcgtggaatacctcgaatcaatacattgttccagaaggatcgccacacccttgcatatgacaaaggatggagagtaagaacagattttaagcagtaccaagttcttaagcagaatccgttctggtggacacaccagaggcatgatgggaagctatggaacctgaataattatcgtactgatgttattcaagctcttggaggagttgaaggaattctggagcatacattattcaaaggaacatatttccctacttgggagggacttttctgggagaaagcttcaggttttgaggaatccatgaagtacaagaaactgactaatgctcaacgatctgggcttaatcaaattccaaatcgtaggtttacactttggtggtcaccaaccataaatagggcaaatgtctatgttggtttccaagtacaactggatctgactgggatatttatgcacgggaagattccaactctgaagatatctttaatacagatattccgtgcacatttgtggcagaagatccatgagagtgttgtcatggatctctgccaagttttggatcaagagttggatgcattggaaattgaaactgtacagaaggagacgattcatccaagaaagagttacaaaatgaatagctcgtgtgctgacatccttctctttgctgcgcatagatggccaatgtcaaaacctagtcttgtggctgaatcaaaggatgtgtttgaccagaaagctagcaacaaatactggatagatgtgcagcttcggtggggtgactatgattctcatgatattgagcgttatacacgagcaaagttcatggattacacaacggacaatatgtctatttatccatcgcctactggcgttatgattggacttgaccttgcttacaatttgcattccgcctttggaaactggtttcctggttcaaaaccattgcttgcccaagccatgaacaagattatgaagtcaaatcctgcgctctatgtgctgagggaacgcataaggaaagggttgcaactgtattcttcagagcccacagaaccatatttatcatctcagaactatggagagatattcagcaatcaaatcatctggtttgttgatgacacaaatgtgtaccgtgtgaccatccacaagaccttcgagggaaatctgacaacaaagcccataaatggtgcaattttcattttcaatcccaggacaggtcaactgtttttgaaggtcattcacacaagtgtgtgggcagggcaaaagcgtcttggccaactggcgaagtggaaaacagccgaagaagtggctgcgcttgttaggtctttgcctgttgaagaacaaccaaagcaaattattgtgactcggaagggaatgcttgatccattggaggtccacttgctcgattttccaaatattgttatcaaaggaagtgagctgcaattaccattccaggcttgtttgaagatagagaaatttggtgatctgatactgaaggctacagagccacaaatggttctgttcaacatatatgatgattggttgaagagtatctcatcttatacagcattctccaggctcatcctcattctgcgtgcgctccatgtgaacaatgagaaggctaagatgttactcaagcctgacaagtctatcattactgagcctcaccacatctggccttcacttacagatgaccagtggatgaaggttgaggtagcgcttcgagatctcattctctcagactatgcaaaaaagaacaacgtgaacacatcagcattgacagtgtctgagatccgtgatattatacttggagctgagataactcctccatcacagcagcgccaacagatagctgagattgagaaacaggctaaggaagcaagtcaactgactgctgttacgacaaagacaactaatgtccatggtgatgagttgattgttactacaacaagtccctatgaacaagctgcctttggctctaaaacagattggcgtgtcagagcaatttctgctacaaatctctatctccgtgtgaaccacatatatgtaaattcagaggatataaaggagactggatatacttacatcatgccaaaaaatatactgaagaagttcatctgcattgctgatctgcggacacaaattgctggttacttatatggtgtaagtccaccagataatcctcaggtgaaagaaatccggtgtattgcaatgcctccacagtggggcacacatcagcaggtgcatctaccttctggtcttcctgagcacgattttctcactgacttggagccgttgggatggatgcatacacaaccaaatgagcttcctcagttatcgccacaggatgtgacttcacatgctcgggtcctggagaacaacaaacactgggacggagagaagtgtattatattgacatgcagtttcacgccagggtcttgttcattaactgcgtataagttgacgccaaccgggtacgaatggggacgtgctaacaaggatacaggaagtaaccctcatggttacctgccaacccattacgagaaggtccagatgttgttgagtgacagattccttggcttttatatggtacctgataatggaccttggaattacaacttcatgggagtgaaacacactgttagcatgaaatatggagtgaagttaggaacacctcgcgagtactacaatgaggatcacagaccgacacatttcctggaattcagtaatatggaggaaggtgatactgctgaggcagatcgagaggacacatttacataatatactgctatcatttccaatcagaatggttactttttgtgttcttgtattgtttaagctgtaacagagagtgagtgtagtggcggatggaacaaagttgtaaatatatgaaaaatgatattgtagctgtatactttttatcgaggatgagcctctgttagcttagctggtatagaattttactatttagctgggctctgcttgtttgcagtgaaacaaacagatgcttgtacattagaggaagtaaaattgtgttttgggtattctgaatt

SEQ ID NO: 975 - DNA, 7500 bp, Solanum lycopersicum
atatgtggaacaatagtaacatagcaccaccaggtactagcggaggaccaccgccgccgccgtcgatgatgcagccacctatgatgcctccgccacctggtacgagttcagtacagcctatgatgcctcctggaacaagtggtggaggagctagtggtgctggaccgcctttaccacctccatcttatactgttttgccgactgaagctcagcttgaagagaaagctaggaaatggatgcagcttaactctaagcggtatagtgataagcggaagtttggatttgtggagacgcaaaaggaggacatgcctccggaacatgttcggaagattattaggtatttattctttgcaattcttaaattgtgcatttttaggtcatatacatattacagggaccatggggatatgtcttcaaaaaaatatcgtcatgataaacgtgtgtatctcggagctcttaaatttgtaccgcatgctgtttacaaactccttgagaacatgcctatgccgtgggagcaggttcgagatgtaaaaatcctgtaccatattactggtgctattacattcgttaacgagattccatgggttgttgaacctatatatctggctcagtggggcacaatgtggatcatgatgagaagggagaagagagaccggcgacatttcaagagaatgcgttttcctccctttgacgatgaggaaccaccgttagattatgctgataatcttttggatgttgatcctttggagccaatccagttggagttggatgaagaagaggattctgcggtttataactggttttatgaccataagccactggtgaaaacaaagcttattaatggtcctagttaccgcaggtggcatttgtccctccctataatggcaacacttcaccgactggctggacagcttctttcagacctgactgatcgcaattacttctacttgtttgatatggagtcctttttcactgctaaagcattgaacatgtgcatacctggtggtccaaagttcgaacctttatatcgtgacatggagaaaggagatgaagactggaacgagttcaatgatatcaacaaattgatcatcaggtcaccacttaggacagagtacagaattgccttccctcatctctataacaacaggccaagaaaggtcaggcttggcatatatcacactccgatgatcatgtacataaaaacagaggatcctgatctacctgctttttattatgatccgctgatacatcccatagtcaccaaggaccgaagagagaagaaagtttctgatgacgacgacgacgatgatttcgccttacctgagggtgtggaaccgttgctgacagagactccaatctatactgatactactgctgctggtatctccctattgtttgccccacgcccatttaacatgagatctggtcgaacaagacgtgctgaagatattccccttgtttctgattggtttaaggagcactgtcctccatcatatcctgtcaaggttcgcgtcagttatcagaagttgttgaaatgttttgtattgaacgagttgcatcacagaccccccaaggcccagaagaagaagcacctctttcgctcacttcaagccacaaaatttttccaaaccacagaacttgattgggcagaggctggtcttcaagtttgtaagcagggatataatatgctgaatctcttgatccataggaagaacctgaactatcttcatcttgattacaattttaatttgaagcctgttaagacactaactaccaaggagcgtaagaaatcgcggtttggaaatgctttccacctttgtcgtgaaattctgcgtttgacaaagcttgttgttgatgccaatgtccagtttcgtctgggaaatgttgatgcgtttcagctggcagatggcttgcaatacattttctcgcatgttggtcagttgacgggtatgtatcgttacaagtacaggcttatgaggcagattcggatgtgcaaggatctgaaacatttgatctattatcgatttaataccgggccagttggaaaaggtcctggttgtggtttctgggcacctatgtggagggtgtggttattctttcttcggggtatagtacctcttttggaacgttggttaggaaatctactggcaaggcaatttgagggtcgccattcaaagggggtggccaagactgtcacaaagcaacgtgttgaaagccatttcgatttggaactccgtgctgcagtaatgcatgatgtccttgatgctatgccagaggggatcaagcaaaataaagcaagaaccatcttacagcatcttagtgaagcatggcgttgttggaaggcaaatattccttggaaggtcccgggtttgcctgttcctattgagaacatgattctccgctatgtcaaatccaaagctgattggtggacaaatgttgctcactacaatcgtgaacgtataagaagaggagcaactgttgacaagacggtgtgccggaaaaaccttggaagattgactcgcctttggctgaaggctgaacaggagcggcaacataattacttgaaagacggaccatatgttactccagaagaagcagtagccatatatactaccactgtgcattggttggagtccaggaagttttctcctataccattccctccgttgtcatacaagcatgacacaaagctactaatccttgcacttgagagactgaaagaatcttacagtgtggctgtgaggttgaaccagcagcaaagggaagagttgggtctcattgagcaagcttatgataatcctcatgaagcattatcacgaattaagcgtcatctgcttactcagcgtgccttcaaagaagttggtattgagtttatggacttgtacagctacctcattccagtttatgagattgagccacttgagaagattactgatgcatatctggatcagtacctatggtatgaaggtgataagcgtcatctcttcccaaattggattaagcctgccgactcagagccaccacctctgttggtgtacaaatggtgtcaaggcataaacaatttgcaaggagtatgggacactagtgaaggacagtgtgtggtgatgctgcagaccaagtttgagaagttctttgaaaagatcgacttgaccatgctgaacaggcttctgcgtttggtgctcgaccacaatattgctgattatgtcactgcaaaaaacaatgtcgtgctgtcttacaaagatatgagccatacaaattcatacgggctgatacggggccttcagtttgcttcatttgttgtacagtactatggacttgtgttggatcttttgctccttggtttaactcgagcaagtgaaattgcgggtccaccacagatgcctaatgagttcattacctatagtgattctagagtggaaacaaggcatccaatccggttgtactctcgatacattgacaaggtgcatatattatttcgcttcactcatgaagaggctcgggaccttatccaaagatatcttactgagcatcctgatcccaacaatgaaaatatggttggttataacaacaagaaatgctggccaagggacgcaagaatgaggctcatgaagcatgatgttaatcttgggagaagtgtcttctgggacatgaagaatcgactgcctagaagtatcactactttggagtgggaaaatagctttgtctctgtatatagcaaagataatcctaacttgctcttcagcatgtgtgggtttgaagttcggatactgcctaagattagaatgacccaagaggcattcagcaatacaagagacggagtctggaatttgcaaaacgagcagactaaggaacgcacggctgttgccttcttgcgtgtagatgatgaacacatgaaggtgtttgagaatcgtgttaggcagatacttatgtcctctggctctacaacattcacaaagatcgttaacaaatggaacactgctcttattggcctcatgacatatttccgtgaagcaacggtgcatacacaagagttgctggacctgctggtcaaatgtgaaaacaagatacaaactcgtattaagattggtttgaactcaaaaatgcctagcaggtttcctcctgttattttctacacaccaaaggaaattggagggcttggaatgttgtcaatgggtcacatattgatcccccagagtgatcttaggtatagtcagcaaacagatgttggtgtcacacatttcagaagtggaatgagccatgaagaggaccaattgatcccaaatttgtaccggtacatacagccttgggaaagtgagtttatagactctcagagagtttgggccgagtatgctttgaaaaggcaggaagcccaggcacagaataggcgcttgactcttgaagatttggaagactcatgggatcgtggaatacctcgaatcaatacattgttccagaaggatcgccacacccttgcatatgacaaaggatggagagtaagaacagattttaagcagtaccaagttcttaagcagaatccgttctggtggacacaccagaggcatgatgggaagctatggaacctgaataattatcgtactgatgttattcaagctcttggaggagttgaaggaattctggagcatacattattcaaaggaacatatttccctacttgggagggacttttctgggagaaagcttcaggttttgaggaatccatgaagtacaagaaactgactaatgctcaacgatctgggcttaatcaaattccaaatcgtaggtttacactttggtggtcaccaaccataaatagggcaaatgtctatgttggtttccaagtacaactggatctgactgggatatttatgcacgggaagattccaactctgaagatatctttaatacagatattccgtgcacatttgtggcagaagatccatgagagtgttgtcatggatctctgccaagttttggatcaagagttggatgcattggaaattgaaactgtacagaaggagacgattcatccaagaaagagttacaaaatgaatagctcgtgtgctgacatccttctctttgctgcgcatagatggccaatgtcaaaacctagtcttgtggctgaatcaaaggatgtgtttgaccagaaagctagcaacaaatactggatagatgtgcagcttcggtggggtgactatgattctcatgatattgagcgttatacacgagcaaagttcatggattacacaacggacaatatgtctatttatccatcgcctactggcgttatgattggacttgaccttgcttacaatttgcattccgcctttggaaactggtttcctggttcaaaaccattgcttgcccaagccatgaacaagattatgaagtcaaatcctgcgctctatgtgctgagggaacgcataaggaaagggttgcaactgtattcttcagagcccacagaaccatatttatcatctcagaactatggagagatattcagcaatcaaatcatctggtttgttgatgacacaaatgtgtaccgtgtgaccatccacaagaccttcgagggaaatctgacaacaaagcccataaatggtgcaattttcattttcaatcccaggacaggtcaactgtttttgaaggtcattcacacaagtgtgtgggcagggcaaaagcgtcttggccaactggcgaagtggaaaacagccgaagaagtggctgcgcttgttaggtctttgcctgttgaagaacaaccaaagcaaattattgtgactcggaagggaatgcttgatccattggaggtccacttgctcgattttccaaatattgttatcaaaggaagtgagctgcaattaccattccaggcttgtttgaagatagagaaatttggtgatctgatactgaaggctacagagccacaaatggttctgttcaacatatatgatgattggttgaagagtatctcatcttatacagcattctccaggctcatcctcattctgcgtgcgctccatgtgaacaatgagaaggctaagatgttactcaagcctgacaagtctatcattactgagcctcaccacatctggccttcacttacagatgaccagtggatgaaggttgaggtagcgcttcgagatctcattctctcagactatgcaaaaaagaacaacgtgaacacatcagcattgacagtgtctgagatccgtgatattatacttggagctgagataactcctccatcacagcagcgccaacagatagctgagattgagaaacaggctaaggaagcaagtcaactgactgctgttacgacaaagacaactaatgtccatggtgatgagttgattgttactacaacaagtccctatgaacaagctgcctttggctctaaaacagattggcgtgtcagagcaatttctgctacaaatctctatctccgtgtgaaccacatatatgtaaattcagaggatataaaggagactggatatacttacatcatgccaaaaaatatactgaagaagttcatctgcattgctgatctgcggacacaaattgctggttacttatatggtgtaagtccaccagataatcctcaggtgaaagaaatccggtgtattgcaatgcctccacagtggggcacacatcagcaggtgcatctaccttctggtcttcctgagcacgattttctcactgacttggagccgttgggatggatgcatacacaaccaaatgagcttcctcagttatcgccacaggatgtgacttcacatgctcgggtcctggagaacaacaaacactgggacggagagaagtgtattatattgacatgcagtttcacgccagggtcttgttcattaactgcgtataagttgacgccaaccgggtacgaatggggacgtgctaacaaggatacaggaagtaaccctcatggttacctgccaacccattacgagaaggtccagatgttgttgagtgacagattccttggcttttatatggtacctgataatggaccttggaattacaacttcatgggagtgaaacacactgttagcatgaaatatggagtgaagttaggaacacctcgcgagtactacaatgaggatcacagaccgacacatttcctggaattcagtaatatggaggaaggtgatactgctgaggcagatcgagaggacacatttacataatatactgctatcatttccaatcagaatggttactttttgtgttcttgtattgtttaagctgtaacagagagtgagtgtagtggcggatggaacaaagttgtaaatatatgaaaaatgatattgtagctgtatactttttatcgaggatgagcctctgttagcttagctggtatagaattttactatttagctgggctctgcttgtttgcagtgaaacaaacagatgcttgtacattagaggaagtaaaattgtgttttgggtattctgaattctctatcatctttttcttcaaattttgttactacttgt

SEQ ID NO: 976 - DNA, 2759 bp, Solanum tuberosum
actgactaatgctcaacgatctgggcttaatcaaattccaaatcgtaggtttacactttggtggtcaccgaccataaatagggcaaatgtctatgttggtttccaagtacagctggatctgactgggatattatgcacgggaagattccaactctgaagatatctttaatacagatattccgtgcacatttgtggcagaagatccatgagagtgtcgtcatggatctctgccaagttttggatcaagagttggatgcattggaaattgaaactgtacagaaggaaacgattcatccaagaaagagttacaaaatgaatagctcgtgtgctgacatcctcctctttgctgcgcatagatggccaatgtcaaaacctagtcttgtggctgaatcaaaggatgtgtttgaccagaaagctagtaacaaatactggatagatgtgcagcttcggtggggtgactacgattctcatgatattgagcgttatacacgagcaaagttcatggattacacaacagacaacatgtctatttatccatcgcctactggtgttatgattggactggaccttgcttacaacttgcattccgcctttggaaactggtttcctggttcaaaaccattgcttgcccaagccatgaacaagattatgaagtcaaatcctgcgctctatgtgctgagggaacgcataaggaaagggttgcaactgtattcttcagagcccacagaaccatatttatcatctcagaactatggagagatattcagcaatcaaatcatctggttggttgatgacacaaatgtgtaccgtgtgaccatccacaagacctttgagggaaatctgacaacaaagccaataaatggtgcaattttcattttcaatcccaggacaggtcaactgtttttgaaggtcattcacacaagtgtgtgggcagggcaaaagcgtcttggccaactggcaaagtggaaaacagccgaagaagtggctgcgcttgttaggtctttgcctgttgaagaacaaccaaagcaaattattgtgactcggaagggaatgcttgatccattggaggtccacttgcttgattttccaaatattgttatcaaaggaagtgagctgcaattaccattccaggcttgtttgaagatagagaaatttggtgatctgatactgaaggctacagagccacaaatggttctgttcaacatatatgatgattggttgaagagtatctcatcttatacagcattctcgaggctcatcctcattctgcgtgcgctccatgtgaacaatgagaaggctaagatgttactcaagcctgacaagtctgtcattactgagcctcaccacatctggccttcacttacagatgaccagtggatgaaggttgaggtagcacttcgagatctcattctctcagactatgcaaaaaagaacaatgtgaacacatcagcattgactgtgtctgagatccgtgatattatacttggagctgagataactcctccatcacagcagcgccaacagatagctgagattgagaaacaggctaaggaagcaagtcaactgactgctgttaccacaaagacaactaatgtccatggtgatgagttgattgttactacaacaagtccctatgaacaagctgcctttggctctaaaacagattggcgtgtcagagcaatttctgctacaaatctctatctccgtgtgaaccacatatatgtaaattcagaggacataaaggagactggatatacttacattatgccaaaaaatattctgaagaagttcatctgcattgctgatctgcggacacaaattgctggttacttgtatggtgtaagtccaccagataatcctcaggtgaaagaaatccggtgtattgcaatgcctccacagtggggtacacatcagcaggtgcatctaccttctggtcttcctgagcatgattttctcaccgacttggagccgttgggatggatgcatacacaaccaaatgagcttcctcagttatcgccacaggatgtgacttcacatgctcgggtcctggagaacaacaaacactgggatggagagaagtgtattatattgacatgcagtttcacgccagggtcttgttcattaactgcatataagttgacgccaactgggtacgaatggggacgtgctaacaaggatacaggaagtaaccctcatggttacctgccaactcattacgagaaggtccagatgctgttgagtgaccgattccttggcttttacatggtacctgataatggaccttggaattacaacttcatgggagtgaaacacactgttagcatgaaatatggagtgaagttaggtacacctcgtgagtactacaatgaggatcacagaccaacgcatttcctggaattcagtaatatggaggaaggtgatactgctgaggcagatcgagaggatacatttacataataaatatactgctactattcaaatgagtaatttggggcgtccaatcaaaatggttacttttgtgttccttgtatgtttcagctgtaatacggagtgtagtggccgatggaacaagttgtaaatatatgaaaatgattttgtagcttgatgccactgtatactttttattggaggatgactctctgctagctttagctggtatagaacgttactgtttagcttgcgttgcttgtttgttgtgaaacaaacagatgcttgtacattagagtaagtaaattgttttttgggcattttgaatttcc

SEQ ID NO: 977 - DNA, 1826 bp, Selaginella moellendorffii
gtctgcagctgtattcatcggagcctacagagccttacctctcgtctcaaaactatggagagcttttcagcaaccagatcatctggtttgtcgatgacaccaatgtgtatcgggttaccatccacaaaacattcgaaggcaacttgacaaccaaacctatcaatggagcaatctttatcttcaatccacgtactgggcaactgtttctgaaggtaattcataccagtgtctgggctgggcaaaagcgtctgggtcagcttgcaaaatggaaaacagcggaagaagtagccgccctggtcagatcactacctgtggaagagcagccgaagcagatcatcgtgactcgcaaggggatgcttgatcctttggaagttcatcttcttgatttccccaacatcgtcatcaaggggagcgagctgcagttacctttccaggcttgcttaaagattgaaaaattcggcgatctgattctcaaggctacagaaccccagatggttctcttcaacatatatgacgactggctcaagagtatatcctcgtacacggccttttcgcggttgatattaatcctccgggcattacatgtgaacaacgaaaaggccaaaatgctcttgaagccggacaagactattgttacagaaccccatcatatttggccttccttgacggatgaccaatggatgaaggtcgaggttgcactgagagatcttatattgtccgactatgccaagaaaaacaatgtaaatacttctgcattgacgcagtcggagattcgagacattattcttggtgccgagatcactccaccttcgcaacaacggcagcagatcgctgagattgagaagcaggccaaggaagcgagccagcttactgctgttacgactagaaccacgaatgttcatggtgatgagcttatcgtcaccactaccagtccctacgaacagcaagcttttggttccaagacagattggcgtgtacgagcaatatcggcgaccaatctctatctccgcgtcaatcatatatacgtaaactcggacgacattaaggaggctgggtacacgtatatcatgcccaagaacgtcctcaagactttcatatgtgtcgccgacttgcggacgcagattgcaggatacctatacggcctgagcccacctgataatcctcaggtgaaggagattcgctgcattgtaatgccgccacagtgggggacgcaccagcaggttcatttgcctgcggctcttccggagcacgactacctcaacgacttggaacctcttggatggatacacacccaacccaacgagttgccacagttgtctccacaggacgttacttctcatgccaagatcttggagaacaacaagcagtgggaaggggagaagtgtatcatattgacttgcagttttacgcccggctcgtgctccttgacggcttacaagctcaccccgactggctacgagtggggccgtgccaacaaagacactggcagcaatccccatgggtaccttcccacacattacgagaaggtccagatgctcttgagcgaccgcttcttgggcttttacatggttcccgataatgggccatggaactacaacttcatgggcgtcaagcactcgaccgggatgaagtatggcgttaagctggccaatccccgcgagtactaccacgaggaccacaggccgacgcactttttggaatttagcaacctggaggaggctgaccacgtagaaggcgatagggaggacgccttcaactgagagagtctgttgatgtgttgtaacctttttaaatgtatcgatgactaatattcccgccaacgtgtc

SEQ ID NO: 978 - DNA, 8052 bp, Ceratodon purpureus
gtctcccccactgcatttccatcgccatggcggtgccccgcatgctgccgctgccgcccctgaccctgccgttgccttgatgcgcacgctttcatctccccttttatccacgcctctcgtcttcacctcgagcttcctccggccctcgccttagctaccataacccctcacctagggtttcgcttcgtctccacccgattggagttagcgcagaggttttctccagccattggtggtggttgtcgttgttgctactgggcgttttggagcgccgagggttttacatgttggcgtgcagctgaggaggagctaccatgatggacgcgcaagcgccaccgctgccgccgcagcagacggccgctgcgtccgcagctgatgccgaggcgcgcctggatgagaaggccaggaagtggatgcagttgaacaccaagcgctatggcgagaagcgcaagtttggttttgttgagacgcagaaggaggatatgcctcccgagcatgtgcgcaagatcatcagggaccatggtgatatgtcctcaaaaaagtatcgtcacgacaagcgggtgtatttgggagctttaaagtttgtgccccatgctgtgtataaattgttggagaatatgccaatgccgtgggagcaggttcgagacgtgagggtgctgtatcacatcactggtgctatcacattcgttgatgagatcccatgggtggtcgaacctatcttcctagctcagtggggtaccatgtggattatgatgaggcgggagaaaagagatcgtcgccacttcaagcgcatgcgtttcccaccatttgatgacgaggagcctcccttggattatgcagataacttgttggatgttgacccactagaacctattcagttggagcttgatgaggaagaagactctgctgtgtatgaatggttctatgactacaagcctcttgtgaagaccaagctgatcaatgggcctagttacaggcgttggcatctgtcattacccatcatggccgctcttcatcgccttgctggccagctgctgagtgatctgatagatcgaaattacttctatctttttgacatggagtcatttttcacagcgaaggcactcaatttatgcattcccggtggtcccaagtttgagccgctgtaccgggacatggagaagggagatgaagactggaatgagtttaatgacattaacaaactcattatccgctcccctttgcgtactgaatacagaattgcatttccgcacttgtacaacaatcgtcctcgtaaagtgaagctgggcgtctatcatactcctatggttatgtacatcaaatcagaagatcctgacttgccagccttttattttgatccgttgattcaccctattgctttttacaaaaccgataagcgaggtgagcgaaaggcctttcaggaagaagaagatgaagatgattttgtgttaccagaaggtgtggagcccttgcttgagaatgtaccgcagtacactgacactactgcagcgggtatcgctttgctctttgctccccgccctttcaacatgcgatcaggtcggacgagacgggctgaggatatccctttggtatctgattggtacaaggaacactgccctccaacttacccagtgaaggtgcgtgtcagttatcagaagcttttgaagtgttacgttctaaatgagcttcatcatcggccaccgaagggtcagaagaaaaagtacctgtttcgttcattgcgtgcaacgaagttcttccagacaaccgagttggactgggctgaagccggtcttcaggtgtgcaagcaagggtacaatatgctgaatcttctgatccacaggaagaatctgaactacctgcatttggactacaacttcaatctcaaacctgtgaagacccttactactaaagagaggaagaagtctcgttttgggaacgcctttcatctttgtcgggagattttacgactgaccaagttggtagtagacgcaaatatccaatttcgtcttggaaatgtcgacgcctatcaactagcagatggtctacagtacacattttcacatgttggtcaattgacgggtatgtaccgttataaatacaggctcatgaggcagatcagaatgtgcaaagatttgaagcatcttatctattatcggttcaatactggacctgtaggtaagggccctggctgtggattttgggcacctatgtggcgtgtgtggttatttttccttcggggtgtagtccctctgttggagaggtggttgggcaatcttcttgcacgacagtttgaaggtcgtcattctaagggagttgccaagactgtgaccaagcagcgtgtggagagtcacttcgacctggagcttagggcagcagttatgcatgatgttcttgatgctatgccagagggtatcaagcagaacaaggcccgtactatacttcagcatctgagtgaagcttggcgctgctggaaagcgaacatcccctggaaggtcccggggctgccagtgccgatcgagaacatgattttgcgctatgtgaagtcgaaggctgattggtggactaacgtggctcattataaccgagaacgtattcggcgaggtgcaactgtggataaaactgtttgtcggaaaaatcttgggcgtctgactcgcctgtggctcaaggctgagcaagagcgtcagcacaactacctcaaagatgggccttatgttactccggaggaggcggtggctatttacactacgacggtccactggctggaatctcggaagttttcacccatcccttttccgccactctcatataagcacgacacgaagcttctcattcttgccttggagcgtctgaaggagtcttacagtgtggctgttcgtttgaatcagcagcaaagggaggagcttgggttgattgagcaggcttatgataatccacacgaggctttgtcccgtatcaagcggcacttgcttactcagagagctttcaaggaggttggaattgagtttatggatttgtacagccatctcatccctgtctacgagattgagcctttggagaagattactgatgcttatcttgatcagtatctgtggtacgagggtgacaagagacatctatttccgaactggatcaagcctgccgactccgaacctccacctttgctggtttacaagtggtgtcagggtatcaacaacctgcaggacatatgggataccagtgaaggacagtgcgttgttatgttacaaaccaagtttgaaaagttcttcgacaagattgatttgaccatgttgaacaggcttctacgactggttctcgatcacaatattgctgattatgtgacggcgaagaacaatgtggttttatcctacaaggatatgagccacacgaattcatacgggttgcttcaagggcttcagtttgcatcatttgtagtccagtactatggactagtgctggaccttttggttttgggacttacacgtgctagtgagatcgcaggacctccacagatgccgaatgagttcatcactttttgggatgtgaaggtggagactcgtcatcccatccgcctgtactcgcggtacatagacaaagttcacatactcttccattttactcatgaagaggccagggatctcatccagcgatacttgactgaacatccagatcctaataatgagaatattgtgggttataacaacaagaagtgttggccaagagatgcgcgcatgcgtctcatgaagcacgatgtgaatcttggtagaagtgtattttgggatatcaagaacaggctccctcgtagcattacgacgttggagtgggagaactctttcgtgtcagtttacagcaaagataatccaaacttgctgttcagcatgtgtggatttgaagtccgtattttgccgaagatccgtatgactcaagaggcttttggcagtaaggatggtgtgtggaacctgcagaacgagcaaaccaaggagcgtactgctatggcttaccttcgggtggatgacgaacatttgaaggttttcgagaaccgtgtcagacagattcttatgtcatctggttccacaactttcaccaagattgtcaacaagtggaacaccgctctcattggtctgatgacctatttcagggaagcaactgtccacacacaagaacttctcgatctactagtaaaatgtgagaacaagatccaaactcgtattaagattggattgaattccaagatgcctagtagattcccccctgtaatcttctacacgcctaaggagattgggggtcttggtatgctctctatgggtcatattttgatccctcagagtgatttgagatacagccagcagacagatgttggggtcactcatttccgaagtggtatgagtcacgaagatgagcagctgattcctaatctttaccggtatattcagccatgggagagtgagtttatcgactcgcagcgtgtgtgggcagagtatgccttgaagaggcaggaagcacaggctcagaacaggaggttgactctagaggatcttgaggattcgtgggacaggggtataccacgtatcaacacactatttcagaaggatcgtcacacgctggcttatgacaaaggttggcgtgtgcgtactgatttcaagcagtatcaagttctgaaacagaatcctttctggtggacacatcagcgtcacgacggcaagttgtggaacttgaacaactaccgtactgatgttatccaggctcttggtggagtggagggtattttggagcataccctgttcaagggtacgtatttccctacatgggagggtcttttctgggagaaagcatcaggtttcgaagaatccatgaagtacaagaagcttacgaacgctcaacgttctggtttgaatcaaattccaaatcgacgtttcactctttggtggtctccgaccattaacagagcgaatgtttatgttggtttccaagtgcagcttgatctcacaggaatcttcatgcatgggaagattcccaccctgaagatttctctcatccagatcttcagagcacatttgtggcagaaggtgcatgaaagtgtggtgatggatctctgtcaggtccttgaccaggagctcgatgctctggagattgaaacagtgcagaaggaaactattcatccacggaagagttacaagatgaacagctcttgtgcagacatccttttgtttgctgcttacaagtggcctatgagcaagccaagcctggttgcagaacctaaggatgtctttgatcagaaggcaagtaataagtactggattgatgtgcagttaaggtggggtgattacgattctcatgatatcgagcggtatacccgagcaaaattcttggattatactaccgacaatatgtctatctacccagctcccaccggggtgatgattgggctggatttagcctataatctgcatgctgcgtttggcaactggttccccggctccaagccgcttttcgcacaggctattaacaagatcatgaaggctaatcctgcactgtatgtgttgagggagcgtgtgaggaaaggactgcagctctattcatccgagcctaccgagccctatctgtcttctcagaattatggagagctattcagcaaccagattatctggtttgttgatgatacaaacgtgtatcgagtgaccatacacaagacatttgaagggaatttgaccacaaagcccatcaatggtgcgattttcatcttcaaccccagaactggtcagcttttcttgaaggtcattcataccagcgtgtgggctggacagaaacgtttgggacagttggccaagtggaagactgctgaagaagtagctgctttggtacgttcccttccagttgaggaacagcccaaacagatcattgtgacacgaaagggaatgcttgatcctttagaggtgcatcttctcgattttcccaatatcgtcatcaagggtagcgaattgcagttgccattccaagcttgcctgaagatcgagaaatttggtgatttgattcttaaagcaacagagccacaaatggttttattcaacatctacgacgattggctgaagactatttcatcatacacggcgttctccaggctcatcctgattcttagggcacttcatgtcaacaatgagaaggctaagatgttgttgaagcctgacaaaacagtggttacagagccgcaccacatttggcccaacttgagtgatgatcagtggatgaaggtcgaggttgcgctgagggatctgatattgtctgattatgcgaagaaaaacaatgtgaatacatctgcgttaacacagtcagagattagggacattatccttggtgctgaaattactcctccatcgcaacaacggcagcagatagcagagattgagaagcaggcaaaggaagccagtcaattgactgcagtcacgaccaagacaacgaacgtccacggagacgatctgattgtgacaacaacgagtccttatgagcaagcagcatttggctctaaaacagactggcgagtgagagctatctctgccaccaatctccatcttcgtgtgaaccacatttatgtcaattcagacgatatcaaggagtctggttacacatacattatgccaaagaacgtcctgaagaagtttatttgtattgccgacttgaggactcaaattgctggatacttgtacggggttagtcctcctgataatcctcaggttaaggagattcggtgcatagtgatgcctccacagtggggcacacatcagcaggttcatcttcctgctgggctacctgagcacgaattcttgaatgagctggagcctcttggttggcttcatacccaaccgaatgagcttccgcagctctcacctcaggacctgacaagtcatgctcgtatcctggagaacaacaagcagtgggatggtgaaaagtgcattattttgacctgcagttttacccctggctcttgctcgttgacagcctacaagctgacgccaactgggtacgaatggggacgagctaacaaggatagtggcagcaacccccatggttacttgcccacgcactatgagaaagtacagatgcttctgagtgaccggttccttgggttttatatggttcctgataatggtccatggaactacaatttcatgggagttaaacactctgtgggaatgaagtatggaatcaagctttcaataccgagggaattttatcacgaagatcatcggccgacacattttttggagttcagcaatctggaggagaacgatgccgcagagggagaccgggaagatgtgtttacttagttgacatgatctcgcatgccacacactgtattgttgctgtgggaccacttgactacagggtaggtgcaggttcgcaccttgccatgcttttgagcttaatgaaagcggcgaagaacctattatgtgcagcactagtctttcttggtatatccaatcctgctattttacttttgccttgctctgatgcatgcttcgaaggcaagatgctgcagactatccagctgcttcaagattgttttgaaagatatatttggcttgcgtttgttcatacccatggttcctcaaggattttgtagcatttgaagcactgaagttgggaatatcaaatttccacatcattcttctgagtagttattttcttctggaggacaagcatgacagttgagattgaagatgctgcctacttgagcatgtacaagcccagcgctcttaatgtgcgttgctgtcagatttactgtatacctagagcagtctgctagtgcatgtttagatagttcactactgttttgtgttggagagaagtggacacacttgagttggtgtggtcttaaaaaaatgtcaagacagcgcaagcagtgacgtagaccatagactttgttcacaggaaacaatgactcaaggttgcaatgtaagcatttttgtatagatagcaacaattttgtcgaatgagcacgagtcttggcaattgctggaccatggttaatgaatgtttattttcattattgcctaaaaa

SEQ ID NO: 979 - DNA, 7337 bp, Fragaria vesca
tttctggttcccgatatgtggaacaacggccagattgtgccgcctggcaccggtggctcgtcgattccgccaccgcctgctgctcagccctcttatacggtgctgccgcctccggcagatgccgaggccgtgctcgaagagaaggctcgtaaatggcagcagctcaattccaagcgctacagcgacaagcgcaagtttggcttcgttgagacgcagaaggaggacatgcctccggagcatgtcaggaagattattaggtctgtttcttttgttcttagccttcattttttggttatagaccatggggacatgtcctcgaagaaattccgtcatgataaacgtgtgtatctaggagcacttaaatttgttccgcacgcagtttacaagcttctcgagaatatgccaatgccctgggagcaggtccgtgatgtgaaggttctgtaccatattactggggcaattacatttgtgaatgagataccttgggttgttgaacctatatatttggctcagtggggttccatgtggattatgatgagaagggagaagagggatcgtcgacattttaaaagaatgcggtttccaccttttgatgatgaggaacctccattagattatgctgataatctgttagatgttgatcctctagagccaattcaactggagttggatgaagaagaagattctgctgtttatacttggttttatgaccataaacctctagtcaagacaaaactcattaatggtccaagttatcggaaatggcatctgtcacttcccattatggcaactctccaccggcttgcaggacagctgctttctgatttgattgaccgcaattatttctacttgtttgacatggagtcattctttacagcaaaagcactgaatatgtgcattccaggtgggcctaagtttgaaccgctgtatcgggatatggagaaaggggatgaggactggaatgagtttaatgacattaacaagctgattattcggtcacctctcagaacagagtacagaattgcattccctcatctctacaataatagacctaggaaggtaaagctctgcgtgtatcacacacccatggtaatgtacataaaaactgaagatcctgatctacctgcattctattatgatcccttgatacacccaatccccagcacaaacaaggagcgacgtgaaaagaaagttgatgaggatgatgacactttcatattgccagaaggagtagagccatttctgagtgatactcagctctatactgacacaacagcagctggagtttccctcttgtttgcaccacgcccctttaacatgagatctggccggactcgccgtgcagaagatataccccttgtgtcagagtggtataaagagcattgtcctccttcctatccagttaaggttcgggtcagctatcagaagttgttaaaatgttttgtgttgaacgagttgcatcataggccacccaaggctcagaagaagaagcacttgtttcgatcactccaagctactaagttcttccaaactaccgaacttgattgggctgaagcgggtcttcaagtctgcaagcagggttataacatgctaaatctcctaatccatagaaaaaatttgaattacctccatcttgattacaatttcaacctgaagcctgtgaaaaccttgacaaccaaagagcgtaagaagtcccgttttggaaatgcttttcatctttgccgtgagatcttgcggttgacaaagctggtagttgatgccaacattcagttccgtttgggtaatgttgatgcctttcagttggctgatggcctgcagtacactttctctcatgttggtcagttgactggtatgtatcgttacaaatacaggttgatgcgtcagattagaatgtgcaaagatttgaagcacttgatttactaccgcttcaacacggggccagttgggaaaggacctggatgtggattctgggcaccaatgtggagggtctggttgttcttccttcgtggcatagttcctcttttggaaaggtggttgggaaatttacttgctcggcaatttgaagggcgccattcaaaaggagtggcaaagactgtaactaagcagcgtgtggagagccattttgacttggagcttcgagctgctgtcatgcatgatgttcttgatgcgatgcctgagggaatcaagcaaaataaggccagaactatattgcaacatctcagtgaggcatggcgttgctggaaagcaaatattccttggaaggtacctggtttgccagttcccattgagaatatgattcttcgctacgtcaagtcaaaggcagactggtggacaaatgtggctcattacaatcgtgaacgtataagaagaggtgctactgtagataagaccgtttgtcgaaagaatctcggaagattaactcgcctatggctgaaggctgagcaggaacgtcaacacaactatttgaaagatggtccatatgttaccccagaggaggcagttgcaatatacacgacaactgtgcattggttggagtcaagaaagttcagccccatcccatttccacctttgtcgtacaagcatgataccaagctacttatccttgctctggagaggttgaaggaatcatatagtgttgctgtgagattgaatcagcttcaaagagaagagcttggtcttattgaacaagcgtatgataacccgcatgaggcattgtctcgaattaagcgtcacttactcactcagcgtgccttcaaagaagttggcatagagttcatggatttgtacagctatctcattccagtttatgagattgaacctcttgagaagattacagatgcgtatcttgatcaatatctgtggtatgagggtgacaaacgtcatctcttcccgaactggatcaagcctgcagattcggagccgcctcctctcttggtttataaatggtgtcagggaataaacaatttacagagcatatgggacactggtgacgggcagtgtgttgtcatgcttcagaccaagtttgagaagttctttgataagattgacttgacgatgctaaataggcttctacgtctagtccttgatcataatatcgctgattatgtcaccgcgaagaacaatgtggtattgtcctacaaggatatgagtcatacaaattcttatggtcttattcgcggtcttcagtttgcttccttcgttgtacaatattacgggcttgtgctggatctgttgcttcttggattgactcgagccagtgagattgctggtccaccccagatgccgaatgagttcatcacttattgggacacaaaggtggagacccgacatcctatcaggctgtactctcggtacatagacaaggtgcacatcttgtttcgcttcactcatgatgaagcccgggatctaatccagcgatatctcactgaacatccagatcctaataatgagaatatggtgggatataataacaagaagtgctggccaagagatgctagaatgaggctcatgaagcatgatgtcaatcttgggagaagtgttttctgggatatgaagaaccgtcttcctcgaagcatcacaactttagagtgggagaacagctttgtttctgtttacagcaaggataatccaaatttgctcttcagcatgtgtggatttgaggttcgcatacttcccaagataagaatgagccaagaggcattcagcaacacaagagatggagtctggaatttgcagaatgaacagacaaaggaaaggactgcagttgctttcttacgggttgatgatgaacacatgaagatatttgagaatcgtgtgaggcagatccttatgtcgtcagggtctaccacatttacaaaaattgtcaacaaatggaatactgctctgattggtcttatgacttacttccgtgaagcgactgtacatacacaagagctgttagatttactagtcaagtgcgagaacaaaattcagacccgtattaagattggattgaattccaagatgcctagtaggtttccacctgtcatattttacacaccaaaagaaattggaggacttggtatgttatccatgggtcacatattgattccccaaagtgatctcagatacagtcagcagactgatgttggtgtgacacactttaggagtggtatgagtcatgaagaggaccagctgattccaaatctgtaccgctacatacaaccttgggagagtgaattcattgattcccagcgtgtttgggcagaatatgcacttaaaaggcaggaggctcaagcacaaaataggcgtctgacccttgaagatttggaagattcgtgggataggggaattcctcgcataaatactttgttccagaaggaccggcacacactagcatatgacaaagggtggagggttcgtactgattttaagcagtaccaggtcttgaaacagaatcctttttggtggactcaccaaaggcatgacgggaagctttggaacttgaataactacagaactgatgttattcaagctcttggaggtgtagagggaatcttggaacacaccttatttaaaggaacatacttccctacctgggagggtctcttctgggaaaaagcatctggtttcgaggaatcgatgaagtacaagaagctgaccaatgcacagagatctgggctcaaccaaattcccaatcgtaggttcacactttggtggtcgccaaccattaatcgggctaatgtatatgtcggtttccaagtgcagttggatcttactgggatctttatgcatggaaaaatcccaaccttgaagatatccttgattcaaatattccgtgcacatttgtggcaaaagatccatgaaagtgttgtcatggatctctgtcaggttttggatcaggagttagatgctttggaaattgagactgtgcagaaggaaacaattcatcccaggaagagttacaaaatgaacagttcttgtgctgacattcttctctttgccgcccatagatggccaatgtcaaaacctagtcttgtggcggagccaaaggatgtctttgatcagaaagcaagcaacaagtactggatagatgtacaactacgatggggagattatgattcccacgatattgaacgttacacccgagccaagtttatggattatacaacagacaacatgtctatctatccctcccccacaggggtgatgattggtcttgatctggcgtataatttacattctgcttttggtaattggtttcctgggtccaaacccctgcttcagcaggcaatgaacaaaataatgaagtcaaatccagctctgtatgtcttgcgggagaggatacggaaaggattgcagctttactcttcggaacctacagaaccttacttatcatcccagaactatggggagattttcagcaatcaaattatttggtttgttgatgatactaatgtgtatcgagttaccatccacaagacatttgaaggaaatctgactacaaaaccaattaacggtgcaattttcatattcaatccaaggactgggcagctgttcctgaaggtcatccacacaagtgtgtgggcaggacagaagcgtcttggtcagttggccaagtggaaaactgcagaagaagttgctgcacttgtgcgctctttaccagtagaagagcagccaaaacaaattattgtgactcgaaagggaatgcttgatccactggaggtccacttgttggatttcccgaacattgtcataaaaggaagtgagctgcagcttcctttccaggcttgtctcaagattgagaaatttggtgatctgatattgaaggctactgagccacagatggttcttttcaacatttatgatgattggttgaagagtatatcatcatatactgcattctctcggctgattttgattcttcgtgcacttcatgtaaacaatgagaaggcaaagatgttactgaaacctgacacaacagtcattactgagccacaccacatctggccttctctctccgatgatcaatggatgaaggttgaggttgctctaagggatctgattctctcggactatgcaaaaaagaataacgtgaacacatcggctctgacacagtctgagattcgtgatatcattcttggagctgagattactcctccttcacaacaaaggcaacaaattgcagagattgaaaagcagcataaagaagcaagtcagctgacagcagttactactaggactacgaatgtgcatggtgatgagctcattgtcaccactactagtccttatgagcaagctgcatttgggtccaagactgactggcgtgtgagagcaatatcggctaccaatctctaccttcgtgtcaaccatatatatgtgaattcagaagatgtaaaggaaacgggttacacttatatcatgccgaagaacatattgaagaagttcatatgcgttgcggatctgaggacacaaattgctggctacttgtatggtgtaagcccacctgacaaccctcaggtcaaggaaattcgctgcattgccatgccaccgcagtggggaacccaccagcaagtcaatcttccaacagctcttcccgagcatgattttctcaatgatctggaacctttgggatggatgcacacacaaccaaacgaacttcctcagctttctcctcaggatttaacctctcatgctaagatcttggagaacaccaagcaatgggatggggaaaagtgcatcgtcttaacttgcagtttcactcctggttcctgctcgttaactgcatacaaactcactccatctggttatgagtggggacgggtcaacaaagacacaggaagcaatccacacggttacctcccaactcattacgagaaggtccaaatgcttctcagtgacaggttccttggtttctatatgattcctgataatggtccatggaactacaacttcatgggtgtgaagcatactcaaggcatgaagtacggggtcaagcttgggacaccaagggagtactatcatgaggaccaccggccgacccattaccttgagtttagcaacatggaggagggtgacacagtggtgggagatcgtgacgataccttcacataagtagtctttgttaactggagtagtgtagcctacccgtttgtaatgcttgtgcatgtttttggtgaaggcctgtaaatatttgatacagagaggcagtttacaagtttttgatatgttaaaacagataggaattgctgaggtatcaatggtaaacaatatatgctaagcattcctttaatatggatcaattgctatattcttgattaggttgctcttttcaagtgatcatacaaaaggtagaaagt

SEQ ID NO: 980 - DNA, 2850 bp, Solanum phureja
tttccctacttgggagggtcttttctgggagaaagcttcaggttttgaggaatccatgaagtacaagaaactgactaatgctcaacgatctgggcttaatcaaattccaaatcgtaggtttacactttggtggtcaccgaccataaatagggcaaatgtctatgttggtttccaagtacagctggatctgactgggatatttatgcacgggaagattccaactctgaagatatctttaatacagatattccgtgcacatttgtggcagaagatccatgagagtgtcgtcatggatctctgccaagttttggatcaagagttggatgcattggaaattgaaactgtacagaaggaaacgattcatccaagaaagagttacaaaatgaatagctcgtgtgctgacatcctcctctttgctgcgcatagatggccaatgtcaaaacctagtcttgtggctgaatcaaaggatgtgtttgaccagaaagctagtaacaaatactggatagatgtgcagcttcggtggggtgactacgattctcatgatattgagcgttatacacgagcaaagttcatggattacacaacagacaacatgtctatttatccatcgcctactggtgttatgattggactggaccttgcttacaacttgcattccgcctttggaaactggtttcctggttcaaaaccattgcttgcccaagccatgaacaagattatgaagtcaaatcctgcgctctatgtgctgagggaacgcataaggaaagggttgcaactgtattcttcagagcccacagaaccatatttatcatctcagaactatggagagatattcagcaatcaaatcatctggtttgttgatgacacaaatgtgtaccgtgtgaccatccacaagacctttgagggaaatctgacaacaaagccaataaatggtgcaattttcattttcaatcccaggacaggtcaactgtttttgaaggcaagtacagtcattcacacaagtgtgtgggcagggcaaaagcgtcttggccaactggcaaagtggaaaacagctgaagaagtggctgcgcttgttaggtctttgcctgttgaagaacaaccaaagcaaattattgtgactcggaagggaatgcttgatccattggaggtccacttgcttgattttccaaatattgttatcaaaggaagtgagctgcaattaccattccaggcttgtttgaagatagagaaatttggtgatctgatactgaaggctacagagccacaaatggttctgttcaacatatatgatgattggttgaagagtatctcatcttatacagcattctccaggctcatcctcattctgcgtgcgctccatgtgaacaatgagaaggctaagatgttactcaagcctgacaagtctgtcattactgagcctcaccacatctggccttcacttacagatgaccagtggatgaaggttgaggtagcacttcgagatctcattctctcagactatgcaaaaaagaacaatgtgaacacatcagcattgacagtgtctgagatccgtgatattatacttggagctgagataactcctccatcacagcagcgccaacagatagctgagattgagaaacaggctaaggaagcaagtcaactgactgctgttaccacaaagacaactaatgtccatggtgatgagttgattgttactacaacaagtccctatgaacaagctgcctttggctctaaaacagattggcgtgtcagagcaatttctgctacaaatctctatctccgtgtgaaccacatatatgtaaattcagaggacataaaggagactggatatacttacatcatgccaaaaaatattctgaagaagttcatctgcattgctgatctgcggacacaaattgctggttacttgtatggtgtaagtccaccagataatcctcaggtgaaagaaatccggtgtattgcaatgcctccacagtggggtacacatcagcaggtgcatctaccttctggtcttcctgagcatgattttctcaccgacttggagccgttgggatggatgcatacacaaccaaatgagcttcctcagttatcgccacaggatgtgacttcacatgctcgggtcctggagaacaacaaacactgggatggagagaagtgtattatattgacatgcagtttcacgccagggtcttgttcattaactgcatataagttgacgccaactgggtatgaatggggacgtgctaacaaggatacaggaagtaaccctcatggttacctgccaactcattacgagaaggtccagatgctgttgagtgaccgattccttggcttttacatgatacctgataatggaccttggaattacaacttcatgggagtgaaacacactgttagcatgaaatatggagtgaagttaggtacacctcgtgagtactacaatgaggatcacagaccaacgcatttcctggaattcagtaatatggaggaaggtgatactgctgaggcagatcgagaggatacatttacataataaatatactgctactattcaaatgagtaatttggggcgtccaatcaaaatggttacttttgtgttccttgtatgtttcagctgtaatacggagtgtagtggccgatggaacaagttgtaaatatatgaaaatgattttgtagcttgatgccactgtatactttttattggaggatgactctctgctagctttagctggtatagaacgttactgtttagcttgcgttgcttgtttgttgtgaaacaaacagatgcttgtacattagagtaagtaaattgttttttgggtattttgaatttcccttaatcccgca

SEQ ID NO: 981 - DNA, 6673 bp, Trigonella foenum-graecum
tttttttacagcgaaggctttgaacatgtgcatacctggtgggcctaaatttgagcctctctaccgtgacatggagaaaggagatgaagattggaatgagtttaatgacatcaacaaactcattataagatcaccacttcggacagaatatagaattgcctttccccatctctataacaacaggcctcgtaaagtaaggctttgtatttaccatactcccatggttatgtacataaaaactgaagatcccgacctacctgctttttattatgatcccttaatacacccaataaccagtgctaacaaagagcggcgtgagaagaaaatctacgatgaggatgatgatgatgactgggtcttgccagatggtgttgagccttttcttaaagatacacaactgtataccgacactacagctgctggaatttccttgctttttgctcctcgtccttttaacatgagatctggccgcatgaggcgtgcagaagacattcctcttgtgtcagaatggtacaaggagcattgtcctccatcatatccagttaaagtccgagttagttatcaaaagttgctcaagtgttttgtgttaaatgagctgcatcacagacctcctaaggctcaaaaaaagaaacacttattcagatcacttcaagcaacaaagtttttccagaccacagaacttgattgggttgaagcaggtcttcaagtctgtcggcaggggtacaatatgttgaatttgttaattcaccggaaaaatttgaactaccttcaccttgattataattttaatttgaagcctgtcaaaaccttgactacaaaagagcgtaaaaaatcacgatttggtaatgcttttcatctttgtcgagagatccttcgtttgacaaaacttgtggtggatgccaatgttcagttccgtttgggtaatgttgatgctttccagctggcggatggcctccaatatactttctctcatgttggtcaattgaccggtatgtatcgttacaagtataggcttatgcggcaaattaggatgtgtaaagacctgaagcacttgatttactaccgttttaacactggtcctgtcgggaagggaccgggttgtgggttttgggcaccgatgtggagggtttggttattctttcttcgtggtattgtgccccttcttgaacgatggcttggaaatttacttgcacggcagtttgagggacgtcattctaaaggagtggctaagaccgttactaagcagcgtgttgagagccatttcgacttagagcttcgagcagctgttatgcatgacgtgcttgatgccatgccagagggtataaagcaaaataaggcaagaactatattgcagcatttgagcgaagcttggcgatgctggaaggcaaatattccttggaaggttcctggtctgcctgttcccatagagaacatgatccttcgctatgtgaaatcaaaagcagattggtggacaaatgttgctcattataatcgtgagcgtataagaagaggtgcaactgtcgataagactgtttgtcgcaagaatcttggaagattgacacgtctttggctgaaggcagagcaggagcgacaacacaattatttgaaagatggtccatatgttactcctgaagaagctgttgctatctatacaactacagtccattggttggaatctaggaagttctcccctattccatttccacctctatcatacaagcatgatacgaagttgcttatccttgcacttgagaggttgaaggaatcctacagcgttgcagtaagattaaatcaactgcaaagagaggagttagggctgattgaacaagcttatgacaatccacacgaggcattatcgcgaatcaagcggcacctcctcacccaacgtgccttcaaagaggttggaatagagtttatggatttatatagctacttgattccagtttatgagatagagcctcttgagaaaattacagatgcatatcttgatcaatatctatggtatgaaggtgacaaacgtcatctctttcccaactggatcaagccagcagattcagagccgccacctcttctggtttacaaatggtgccaaggtatcaacaatttgcaaggtgtctgggacaccagtgatggtcagtgcgttgtgatgttgcagaccaagtttgagaaatttttcgagaagattgatttaacaatgttaaataggcttctccgtttggttctagaccacaacattgctgattatgtcactgcgaaaaacaatgttgtgttgtcatataaggacatgagccacacaaattcatatggtcttatacgtggactgcagtttgcttcctttgttgttcaatattatggcctagtattggatcttttgcttcttggattgactcgagcaagtgagattgctggtccaccgcagatgcctaatgagttcattacttattgggacaccaaagtggagaccagacatcctattaggctgtattctcggtacatagaccgagttcacatattatttcgctttacacatgaggaggctcgggatctcattcagcggtatctcactgagcaccctgatcctaacaatgagaacatggtggggtacaataataagaagtgttggccaagagatgctagaatgaggctcatgaagcacgatgtcaatcttgggaggagtgtcttttgggatatgaagaatcgtcttcctcgaagcatcacaacgctggaatgggaaaacagcttcgtctctgtttacagcaaagataacccaaacttgctttttagcatgtgtggatttgaagtgaggatacttcctaaaattagaatgactcaagaagcatttagtaacacaagagatggtgtctggaatctccagaatgagcagacaaaagaaagaacagctgttgccttcttaagagttgatgatgaacacatgaaggtgtttgagaatcgtgttagacagattcttatgtcttcgggttctactacattcacaaaaaattgtcaataagtggaatacagctttaataggactcatgacttacttccgagaggccactgtacatactcaagagctgttggatttgcttgttaaatgtgaaaataaaattcagactcgtattaagattggactcaactcaaagatgcctagcaggtttccgcctgtcattttctacaccccaaaggaaattggaggacttggaatgttgtctatgggtcacatattgattccacaaagtgatctaaggtatagtcagcagactgatgttggtgtaacccacttcagaagtggaatgagtcacgaggaggaccagttgattccaaatctttatcgctatatacagccttgggaaagtgagttcgttgattcacagcgcgtctgggctgaatatgcattgaaaaggcaggaagcacaagcacaaaataggcgcctgacccttgaggatttggaagattcatgggacagaggaataccacgtattaacactttgtttcagaaggatagacacactttggcttatgataaaggatggagggtgcgtacagacttcaagcagtatcaagttttaaaacaaaatcccttctggtggacacaccagaggcacgatgggaagttgtggaacttgaataattaccgtactgatgttattcaagcccttggaggagttgaaggaattcttgaacatactctattcaaaggaacatattttccaacatgggaaggtctcttctgggaaaaggcgtcaggttttgaggaatctatgaagtataagaagctcaccaatgcgcagagatctggtctcaaccagatacccaaccgtaggtttacgctttggtggtcaccaaccattaaccgggccaatgtttatgttggttttcaagtgcagctagatctgactggtattttcatgcatggaaaaattccaactttgaagatctctcttattcagatattcagagctcacttgtggcaaaagatccatgagagtgttgtcatggatctttgtcaggttttggatcaagagttagacgctttggagattgaaactgtccagaaggaaacaatacatcctaggaagagttacaaaatgaacagttcttgtgcggacatccttctctttgctgcccacagatggccaatgtcaaagcctagtcttgtagctgaatctaaggatgtttttgatcagaaggcaaacaataagtattgggttgatgttcagcttagatggggtgattatgattctcacgatattgagcgttatacccgggccaaatttatggattacacaacagataatatgtctatatacccatctcctactggggttatgattggccttgatttggcatataacttgcattctgcatttgggaactggttccctggatcaaagccactacttcagcaggccatgaataagataatgaagtcaaatcctgcattgtatgttttgagggaacgcatcaggaaaggtttgcagctgtactcttctgagcctactgaaccatatttgtcttcccaaaactatggagagatattcagcaaccaaattatatggtttgttgacgacactaatgtgtatcgtgttacaattcataagacttttgaaggaaatcttacaacaaaacccatcaatggtgccatttttattttcaatcctaggactgggcagttgtttcttaaggttattcatacgagtgtatgggctggtcagaagcgtcttggccaactggcgaaatggaaaacagcagaagaagttgcagctcttgtaaggtctttgcctgtggaagagcagccaaagcagattattgttactcgtaaaggaatgttggatcccttggaggttcacttgctggatttccctaatattgtcatcaaaggaagtgagctgcagcttcctttccaagcatgtttgaaaattgagaaatttggggatcttattttgaaggccacagaaccacaaatggttttgttcaacatttatgatgactggctgaagagcatttcctcatacactgcattctccaggctgattctgattctacgtgcacttcatgtgaataatgaaaaggcaaagatgttattgaagcctgacaaaactatcgtcactgaacctcatcacatctggccttctctaagtgatgaccagtggatgaaggtggaggttgcattaagagatcttatactttctgattatgctaagaaaaacaatgtgaatacttcagctttgactcaatcggagattcgtgatattatacttggagctgagattactccaccttcacaacagcggcaacagattgcagagatcgagaaacaggcacatgaagcaaaccaggtgacagcggtaacaacaaagaccacaaatgttcatggtgatgaccttatagtaaccaccactagcccctatgagcaagctgcttttggttcgaagactgattggcgtgtcagagcaatatcagccacaaatttatacctccgagtgaaccatatatatgtgaactccgaggatataaaggaaacgggctatacctatatcatgcccaagaacattttgaagaagtttatatgcatagcagatctacgatcacagatttctgggtacttgtatggtataagtcctcctgacaatccccaggttaaggaaattcggtgcattgtgatgccaccacaatgggggaatcatcaacaagtccatctcccatcagctctcccagaacatgatttcttgactgacttggagcctttgggatggatgcatactcaaccaaatgaactcccacagttgtcgcctcaggatctcatttcacatgctaaggttctagagaacaataaacaatgggatggggagaagtgtattatcttgacttgcagctttacccccggttcctgttctttaactgcatataaactaacaccatctggttatgaatggggacgcattaccaaggatccaacaatcaacccacatggttaccttcccactcattacgagaaggttcagatgctcctcagtgatcgcttccttggtttctacatgattcctgataatggtccatggaattacaacttcatgggagtgaggcacgcatcagggatgaagtatggagtgaagcttgggacccctagggagttttaccacgaagatcatagaccaacccatttcttagagttcatcaatttggaggaaggggagacatttgccgagggagatcgagaggatacattctcttaagatataaaatgttcagtttatcttgagatacaatacaagtggcagatcctttaatttctgaaacttgtcataagatgttgtattgtctatcgtatgtacgttctaatgattttgtagcgaaagtatcatagttttgtaaataattacagtcaggaaatactaaattgcagttgtctgtttccgcaatttgatagctatttcctccttacttattagtcattctgttcaaggaagtgtgaaattcggcttgacatgattgaagttttggcatggtcacaagcaaaaaataatcatgtaaaaagtaatcctagctgttaagtatcatataaaggtcaattatttagagggaaattttgattgaaaagtgaaacttagttgtaatgaaatacgttgatttaggatctgttgacactataagttgacattaattaaattaa

SEQ ID NO: 982 - DNA, 7056 bp, Eucalyptus grandis
atgtggaacgacgctggcaacggccagactgccccgccggggaacagcgacccctccacgatcactttgccgcccgcaccacagccatcgtacaccgtcctgccctcgccggccgaggctgaggccaggctcgaggggaaggcgcggaaatggatgcagctcaactcgaagcggtacggggacaagaggaagttcgggttcgtggagccgcagaaggaagacatgcctcccgagcacgtcaggaagattattcgggaccatggggacatgtcctctaaaaaatatcgccatgataaacgtgtataccttggagctttgaagttcgttcctcatgcagtttataagctcctagagaacatgcccatgccatgggagcaggttcgcgacgtgaaggttttataccatatcaccggggcaataacattcgtcaatgaaataccttgggttgtcgagcccatctatttagctcagtggggtacaatgtggatcatgatgcgaagggagaaaagggatagaaggcatttcaagagaatgcggtttccaccttttgatgacgaggaacctcccctggattatgccgataatctattggatgtcgatcctctggaaccgattcagttagagttagatgaagaagaagattcggctgtttgtgcttggttttatgaccataagcctcttgtgaaaacaaagcttgtaaatggtccgagttataggaagtggcatctgtctctgccaattatggccaccctccatcggctagcggggcagcttctttctgatttgattgaccgcaactacttttatctgtttgatatggagtcctttttcactgcgaaagcactgaacatgtgcataccaggaggtcctaagtttgagccactctaccgggatatggaaaagggagatgaggattggaatgagttcaatgacatcaacaaactcattattcgatctcctcttaggacagaatacaggattgcatttccacatctttacaacaataggcctcggaaagtaaagctttgtgtataccatactcccatggtcatgtatataaagactgaggatcctgatttaccggccttctattatgatcctttgattcatcctattgccagcattagcaaggaccggcgtgagaagaaggcatatgatgatgaggatgaggaaaatttctccttgcccgaaggcattgaacctctgctgaatgatacccagctttatactgacaccacagctgcaggaatctcgttgttatttgccccacgccctttcgacgcaagatctgggcacatgcgacgggctgaagatataccccttgtgtcagagtggtacaaggagcactgtcctccaacatatcccgtgaaagttcgagtcagctatcaaaaattgttgaaatgtttcgtcttgaatgagctacatcatcgacctcctaaggctcagaagaagaagcatttgttccggtctcttcaggcaaccaaattttttcagactactgagctggattgggtggaggcgggcctgcaagtatgtaagcagggctacaacatgttgaatctgttgatacacaggaagaatttgaactaccttcaccttgactacaatttcaatcttaagccagtgaagactctcacaaccaaagaaaggaagaaatcacgattcggcaatgcatttcatctctgtcgtgagattctgcgtcttacaaagcttgtggtcgatgccaatgtccagttcagactaggaaacgtggatgcattccaattggctgatggtttacagtatacattttcacacgttggacagttgactggcatgtatcgatataagtatcgactgatgaggcagatcagaatgtgtaaagacctgaagcacttaatttactatcgcttcaatacagggcccgtgggaaagggacctggatgcggtttctgggcaccaatgtggagggtgtggctgttctttctgcgtggtatagtacctttgcttgaaaggtggttagggaacttattggcccgtcaatttgaaggacgccattcaaaaggggtcgctaagaccataacaaagcaacgggtggaaagtcattttgatctggagcttcgagctgctgttatgcatgatgttcttgatgccatgccagagggcattaagcacaataaagcgaggaccattttgcagcatcttagtgaagcatggcgctgttggaaagccaatattccttggaaggttcctggtcttccagttcccattgaaaacatgattcttcgttatgttaaatcgaaagctgattggtggacaaacgttgcacattataatcgtgaacgcataagaagaggtgcaacagttgataagactgtttgtcggaaaaatcttggaagattgactcgcctctggtttaaggctgagcaggaacgacaacataattatctgaaagatgggccatttatcacaccagaagaagctgtggcaatttatactacgactgtgcactggttggaatcaagaaagttctctcccattcctttccctccgttgtcatacaagcatgatacgaagctgcttattttggctctagagaagctaaaggaatcttacagtgttgccgtgagattgaatcagttgcagagggaggagttgggtctcattgaacaagcatatgataatcctcatgaagctttgtcacgtataaagcgtcacttgcttacacgacatgcctttagagaggtgggcattgagttcatggatctgtatagttatttgattcctgtatatgaaatagagcctcttgagaagatcactgatgcataccttgaccagtatctgtggtatgaaggtgataaacgtcatctgtttcccaactggattaagcctgcagattcagaaccacctccgctcttagtttataagtggtgtcagggtataaataacttacaggcaatatgggatacaagtgaggggcagtgtgtagtcatgcttcaaaccaagtttgagaagttctttgaaaagattgacttgcatttcttaaatcggcttcttcgcttaattctcgatcaccacattgctgattatataactgagaaaagcaatgctgtcctttcttacaaggatatgagccatacaaacttttatggttttataaggggactacagttttcttcttttgttgtccagttttatggacttgtgttggatctactgcttctgggattgactcgagccagtgagattgctggtccaccccagatgccaaatgagttcattacttattgggacacaaaagttgagaccagacatcccattcgattgtattctcgctacatagacagagttcatatcctgtttagattcactcatgacgaggcccgtgaccttatccagcggtaccttactgaacatcctgaccccaataacgaaaacatggtcggatacaataacaagaaatgctggccgagagatgcaaggatgaggcttatgaaacatgatgttaatcttgggagaagtgttttctgggacatgaagaaccgtcttcctagaagtcttacaaccttggagtgggagaacagttttgtttctgtttacagcaaggacaatcccaacttgctattcagcatgtgtggctttgaagtccgcatactgccgaagataagaatgacgcaggaagcatttagcaataccagggatggcgtttggagtttgcaaaatgagcagaccaaagagcggacagcagctgcttttttgcgggttgatgatgaacatatgaaagttttcgagaatcgtgtgaggcaaattctgatgtcctctggatcgacgacattcaccaagattgttaacaaatggaatactgccctcataggactcatgacatacttccgcgaagctactgtgcatacacaagagcttttggatttgttggtcaaatgcgagaacaaaatccaaacgcgtatcaagatcggattgaattctaaaatgcctagcaggtttcctccggtcattttttacaccccgaaggaaattggaggtcttggtatgctctcaatgggtcatatattgattccacaaagcgatcttcgatacagcaagcaaactgatgttggtgtaacccattttagaagtggaatgagtcatgaggaggatcaactgataccaaatctttatcgctacatacagccatgggaaagtgagttcattgattcacagcgagtatgggctgaatatgctttgaagaggcaagaagctctgacccaaaacaggcgtttaacgttggaggatttggaggactcatgggacagggggatacctcgcataaatactctgtttcagaaggatagacatacgcttgcgtatgacaaaggatggagggtacggactgatttcaagcagtaccaggtcctcaaacaaaaccctttttggtggacacaccaaaggcacgatggtaaactttggaacttgaataactatcggactgatgttatccaagctcttggaggtgttgaagggatcctggagcacaccttattcaaaggaacatattttccaacatgggaaggtctcttttgggaaaaagcatctggttttgaagagtcgatgaagtacaaaaagttgacaaatgcacagagatctggtctgaaccagattccgaaccggaggtttaccttgtggtggtcgcctacaattaatagagcaaatgtttatgtgggtttccaagtgcagttggatctcactggaatatttatgcatgggaagattcctactttgaagatatctctaatccagatattccgtgctcatttgtggcaaaagatccatgagagtgttgttatggatctttgccaagttcttgaccaggagttggatgcattagaaattgaaactgtccagaaggaaactatccacccgaggaagagttacaaaatgaatagttcttgtgctgacattcttctctttgctgcccatagatggccaatgtcaaagcccagtcttgtggctgaatctaaggatgtttttgaccaaaaagcaagcaacaagtattggatagacatacagcttcgctggggagattacgattctcacgatattgagcgttacacaagagccaaattcatggactatacgacagataacatgtctatatatccatctccagctggtattatgattggacttgatcttgcttataacttgcattctgcgtttggcaattggtttcctggttccaaaccactgtttgcacaggctatgaataagattatgaagtcaaatccagcattgtatgttctccgagagcgcataaggaaaggtttgcagctctattcttcagagcctacggagccatacttgtcatctcagaattatggagagattttcagtaatcaaattatatggttcgttgatgacactaatgtttatcgcgtgacaattcacaagacattcgagggaaatctgactactaagcccatcaatggtgccattttcatattcaatccaaggactggccagctcttcctgaaggtcattcatacaagtgtttgggctgggcaaaagcgtctaggtcagcttgccaagtggaaaactgcagaagaagtagctgctcttgtgcgctctttgcctgttgaagaacaacccaagcaggtcatcgtcactcggaaggggatgcttgatcctttggaggttcacttgttggatttccccaatattgttattaaagggagtgagctgcaactaccattccaagcttgcttgaaaatagaaaaatttggtgatctgattttgagggcaacagagcctcaaatgcttctgtttaacatatatgatgactggctgaagagcatatcatcctacactgcattctctcgtctcattttgattctccgtgctcttcatgtgaacaatgagaaggctaagatgttactaaagcccgataagacagttgtcactgaacctcatcatatttggccgtctctcacagatgatcagtggatgaaggttgaagtagccttgagagacttgattctctcagattatgcaaagaagaacaacgtgaatactacagctctcacacagtctgagattcgtgatattatacttggtgctgagattacccctccatctcaacagaggcagcaaattgcggaaattgagaaacaggcaaaagaagccagtcagcttacggcagtcacaacaagaaccaccaatgtgcatggtgatgaactgattgtgaccactacaagtccttatgaacaagctgcatttgggtctaagactgactggcgtgtgagagcaatatcagcgaccaatctttatcttcgagtgaaccacatatatgttaattcagaggacataaaggagacgggatatacttatatcatgcccaagaacatattgaagaaatttatctgcatagcagacctgcgaactcagattgctgggtacttgtatggtataagcccacccgataatcctcaggttaaagaaattcgctgtatcgcgatgccacctcaatggggaacacatcagcaagtgaatcttccgagtgcactccctcagcatgatttcctaaatgacttggagccattggggtggatgcactcacaaccaaatgagcttccacagttatcacctcaagatctaactaatcatgctcgggttctggagaacaacaagcaatgggacggtgaaaagtgcattatcctgacgtgcagtttcacgccaggttcctgctcattgactgcttacaagctcaccccttcaggttatgaatgggggcgtctgaataaagataccggaagcaatcctgccggataccttccgactcactatgagaaggttcagatacttttaagcgacaggttccttggcttttacatgataccggataatggcccttggaactacaacttcatgggagtgaagcacacatcaagcatgaagtatggaatgaaactgggaacgccgagagagtactatcacgaggacaacaggcccactcacttcctggagttcagcaaaatggaagaggatgacactgctgagggcgaccgtgaagacacattttcttag

SEQ ID NO: 983 - DNA, 7711 bp, Physcomitrella patens
agtttaggaactcgaaggagctccccctccttaatgtagggagcggtagccctgttcttcagaaaccctctttggtcgcataggatttcggctttcctcacggacttaagcttaaagaggtttacaccgcaaggtgggatcttcttcaagaagaacgttatcgagaaattgaagcgaagcattttgttttgcatagtttattcgaagaacgaggttttaaaaagttggtgcggagctgagggggacgctgtcatgatggatcctcaggcgccacctacggctccacagcaaacggctgcttcagctgcagctgatgccgaggcgcatttggaagagaaggctaggaagtggcatcaattgaatagcaagcggtatggggagaagcggaagtttggttttgttgagacgcaaaaagaagacatgcctcccgagcatgttcgcaaaattatcaggagctggtcgtttcttcaattcttcatcatttgcctatttgatactttggagaggcgttgtttgttattttgggaccatggtgacatgtcctcgaagaagtatcgccatgataagcgggtatatctaggggccttgaagttcgtgcctcatgctgtgtataagctgttggagaacatgccaatgccatgggagcaggttcgagatgtgagggtgctctatcatatcactggtgctataacatttgttgacgagatcccgtgggtggttgagcctattttcctagctcagtggggtactatgtggatcatgatgagacgagagaaaagagacagacgtcatttcaagcgtatgcgttttccccctttcgatgatgaggagccccccttggattatgccgacaacctgttggatgttgacccgttggaacctattcagctagagcttgacgaagaagaagacgctgctgtgtatgagtggttctatgattataaacctctcgttaagacgaagctaatcaatggacccagttacaggcgctggcatctttcgttgcctatcatggccgctcttcaccgtcttgctgggcagttgctgagtgatttgattgatagaaactatttctatctttttgatatggaatcgtttttcaccgccaaagcactcaacctttgtattccaggaggtcccaagtttgagcctttataccgggatatggagaagggagacgaagattggaacgagtttaatgacatcaacaagctcattattcgctctccattgcgtacggaatacaggattgcgtttccgcatttgtataataatcgtcctcgcaaagtgaagctttgcgtgtatcacactcccatggttatgtacatcaagtcagaagatccagatttgccagccttttattttgatcctttgatccatccaattgctttttacaaaacggacaagcgtggtgagaagaagggatttcaggaagaagaagatgaagatgacttcgttttgccagaaggtgttgagcctttgcttcaggatgtaccacagtacactgacacaacggctgccggaattgctttgttgtttgctccccgcccctttaatatgcggtcaggtcggatgagacgcgcggaggatatccctctggtctctgattggtacaaggagcactgtcctccaacctatccagtgaaggttcgtgtgagttatcagaagcttttgaagtgttatgtgctgaatgagctgcatcatcggccaccaaagggccagaagaagaaatatttgttccgctcattgcgtgcaacgaagttcttccagacaacagaactggactgggctgaagcaggtttacaggtatgcaagcaaggatacaatatgttgaatcttctgattcacagaaagaacctaaattatctacatttggattacaacttcaatctcaaacctgtgaagactcttactactaaagagaggaaaaagtctcgatttgggaatgcttttcatctttgtcgagagattttacgactcactaagctggttgtggacgcaaacatccaatttcggctcgggaatgttgatgcttaccaacttgcagatggtctacaatatacattctcacatgttggtcaactgaccggcatgtatcgttacaaatataggcttatgaggcagatccgaatgtgcaaagatttaaagcatttgatctattatcggttcaacaccggtcccgttggaaagggtcctggctgcggattttgggcacctatgtggcgtgtgtggttgttcttccttcgaggggttgttcctctattggaaagatggttgggcaatcttcttgcacgacaatttgagggtcgtcactctaagggagttgccaagactgtcaccaagcagcgggtggagagtcactttgatttggagctcagggcagcagtcatgcatgatgtccttgatgccatgccagaaggtatcaagcagaataaggcccgtaccattcttcagcatctgagtgaagcttggcgttgctggaaggctaatattccatggaaagtccctgggcttccagtgccaattgagaacatgattttgcggtatgtgaagtcgaaggctgattggtggactaatgtcgctcattacaatcgggagcgtattcggcggggtgccacagtagataaaaccgtttgccggaagaatcttgggcgtctaactcgtctttggctgaaggcagaacaagaacgtcagcacaattatctgaaggatgggccttatgtcactcccgaggaagctgtggctatttacaccacaacggtacattggttggaatctcgcaagttttcacccattccttttcctcccctctcatacaagcatgacaccaagcttctcatccttgccttggagcgtcttaaggagtcgtatagtgtggcagtccgtctaaatcagcagcaaagagaggagcttgggctaattgagcaagcttatgataacccacacgaggcattatctcgtatcaagcggcatttgcttacacaaagagccttcaaggaggtcggaatcgagttcatggatctctacagccatcttattcctgtatatgagatcgaacctttggagaagatcactgacgcttatcttgatcagtatttatggtatgaaggagacaagagacatttgttccctaattggatcaagcctgctgactcggaacctcctccattacttgtctacaagtggtgtcaaggtatcaacaatctgcaggatatatgggacaccagtgaaggacaatgtgttgttatgctgcagactaagttcgaaaagttcttcgacaaaattgatttgaccatgctgaataggcttctacgattggttcttgatcataacattgctgactatgtgactgcaaagaacaacgttgttctatcctacaaagatatgagtcacacgaattcttatgggctgcttcaggggcttcagtttgcatcatttgtagtccagtattatgggctggtgcttgacttactggttttgggtcttacacgtgctagtgaaatagcgggacctccgcaaatgccgaatgagtttatcactttctgggatgtgaaggtggagactcgtcatcccatccgcctctactcacggtatatcgacaaggttcacatactcttccgtttcactcacgaagaagccagggatctcattcaacgttatctgacagagcatccagatcccaacaatgaaaacattgtaggttacaacaacaagaagtgttggcctagggatgctcgtatgcggctcatgaagcacgatgttaatctcggaagaagtgtattctgggatataaagaaccgacttcctcggagcataaccactttggagtgggagaattcgtttgtttccgtttacagcaaggataacccgaatctgctgttcagcatgtgtgggtttgaagtacgcattttaccaaaaatccgtatgactcaagaagctttcggcagcaaggatggagtatggaacttgcagaacgagcaaaccaaggagcggactgctatggcttatcttcgagtggacgatgaacacctgaaagtctttgagaatcgtgtccggcagattcttatgtcatctggttctacgactttcactaaaattgtaaacaagtggaacactgccctcattggtttaatgacctatttcagggaagcgacagttcatactcaagagcttcttgatcttctggtaaagtgtgaaaacaagatacagactcgtatcaaaattggactgaattccaaaatgcccagtaggttccctcctgtgattttttatacgcccaaggagattggtggtcttggtatgctgtcaatgggacatattttaattccccagagtgacttgagatacagtcagcagacagacgtcggagttactcacttccgaagtggtatgagtcatgaagatgagcaactgattcccaatctttaccgctatattcagccgtgggaaagtgagttcattgactcacagcgtgtgtgggcagagtatgctctgaagagacaggaagctcaggctcagaacaggaggttgactttggaggatcttgaagattcttgggacaggggtatacctcgtattaacacgttgtttcagaaggaccgtcatactctggcctatgacaagggttggcgtgtgcgtactgacttcaagcaataccaagtattgaagcagaatcctttctggtggactcatcagcggcacgatggtaagttgtggaacttaaacaattaccgtactgatgttatccaggctcttggaggagtggaaggtattttggagcatactctgttcaaggggacatatttccctacatgggaaggtcttttttgggaaaaggcatcaggttttgaggaatccatgaaatataagaagctaacaaacgctcagcgttctggtttgaaccaaattccaaaccgtcgttttacactttggtggtccccgaccattaatcgagccaatgtgtatgttggtttccaagtgcagcttgatcttacaggtattttcatgcatgggaagattcctactctgaagatttctctcattcagatctttagagcgcatttgtggcagaaggtgcacgagagtgtggtaatggacctttgccaggtcctcgaccaggagcttgatgctttggagatcgaaacagtacaaaaggaaactattcatccgcgtaagagttacaagatgaacagttcttgtgctgatattcttttgtttgctgcttacaagtggcctatgagcaagccaagtctcgttgcagaaccgaaggatgtttttgaccagaaagcaagcaacaaatactggatcgatgtgcaattacggtggggtgactatgattctcatgatatcgaacggtatacccgggctaaattcttggattatactactgataacatgtcaatatatccggctcctacaggggtgatgatcgggctggacttggcgtacaatctgcacgctgcgtttggaaattggtttcctggttccaagccgctatttgctcaggctatcaacaagattatgaaggctaatccagcactctatgtgttgagggagcgtgtaagaaaaggattgcagttgtattcatctgagcccactgagccttatttgtcatcccagaattacggagaacttttcagcaaccagatcatctggtttgttgatgatactaatgtctatcgagtaaccattcacaagacatttgaaggaaatttaaccacgaagcccatcaacggtgccattttcatcttcaacccaagaacagggcagctgtttttgaaggtcattcataccagcgtttgggcaggacagaaacgtctgggacaattagctaagtggaagactgctgaagaagtggctgccttggtacgttctctgccagtcgaagaacaacccaagcagattattgtgacacggaagggaatgcttgatcctctggaggttcatcttcttgatttcccgaatatcgtcatcaagggtagtgagttgcagttgccattccaagcttgtttgaagattgagaagtttggcgatttgatattgaaagcaacggagccacaaatggttttgttcaacatctatgatgactggctgaagaccatttcgtcttatactgcgttctcgaggctcatcctaattcttagggctcttcatgttaacaatgaaaaggctaagatgttactgaagcctgacaagacagtagtgacagagccacaccacatttggcctaatctcagtgatgatcagtggatgaaggtcgaagttgctttgagggatctaatattgtcggactatgcgaagaagaacaacgttaatacatccgcgttgacacagtcggagattcgggacattatcttgggcgctgagattactcctccttcgcaacaacggcaacagattgcagaaattgagaagcaggcgaaggaggctagtcaattgactgcagttacaacaaagacaacgaatgttcacggagacgatttgattgtaacaacaaccagtccgtatgaacaagctgcttttggttccaagacggattggagggtgagagctatttctgctaccaatctccatctgcgtgtcaaccacatttatgtgaactcggatgatatcaaagagtcgggatatacgtacattatgccgaagaacgttttgaagaagtttatttgtatcgccgatttgaggacacaaatcgcggggtatctgtatggagtgagtcctcctgataatccgcaggtgaaagagattcggtgcattgtgatgccgcctcagtggggtacacatcaacaggttcacctccctgctaatctgcctgaacatgagttcttgaatgagcttgagcctcttggttggcttcatactcaaccgaacgagctcccgcagctctcacctcaggacttgacaagtcatgcccgcgtgctggagaataacaagcaatgggatggtgaaaagtgcatcattctaacttgcagctttactcctggttcgtgctcattgacagcttacaagcttacacccactggttatgaatggggtcgggctaataaggacagtggtagcaacccccatggttacttacccactcattacgagaaagtacagatgcttttgagtgaccgattccttggcttctacatggttccagataacggtccatggaattacaatttcatgggtgtgaaacactccgtcggcatgaagtatggaattaaactttcgattccaagagaattttatcatgaagatcataggccaacgcactttttggagttcagcaatttggaggacaatgatgctgcagagggagatcgtgaagacgtgtttacttagaacagtttcagtagtttccgacgtctcatttcatctcggggttttgtcctagtacagcaagctgctttcgtataatacagacacttgcttttcttagtcgagcgaaagatgagtcagttaagaagtaactgtgcatctctgtaggatcttgatgaatcttctctgctgcgtgatttttcaggcgagttctgtgaaccagatttgttgatacaagtttaccacatttaagctcagtgcttggatgtgtagttatcgcaattgagatccattcagcatcctgaacacgggaatagacgattttgttgggacaggtcagggcaatggaaactaagcatagatgttcgcacttttgtaaagatagtaacgaagaattttccttccc

SEQ ID NO: 984 - DNA, 7368 bp, Physcomitrella patens
atggacccgcaggcgccaccgatggcgccaccaccgccggcatccgcttcaactgcagctgatgctgaggcgcggttggatgagaaggccaggaagtggcaccagttgaatgctaagcgatacggcgagaagcgcaagtttggttttgtggagacgcagaaggaagatatgcctccagagcacgtacgcaagattatcagggaccatggtgacatgtcttcgaagaagtaccgtcatgataagcgggtgtatttgggagctttaaagtttgtgcctcatgccgtgtataagctgttggagaacatgccaatgccatgggagcaggttcgagatgttagggtgctctatcacattactggtgccatcacattcgttgatgagattccgtgggtagtggaacctatttttcttgctcaatggggtactatgtggatcatgatgaggcgagagaagagggacagacgccactttaagcgtatgcgtttccctcctttcgacgatgaggaaccccctttggattacgctgataacctgctggatgttgagcccctcgaacctattcagctagagcttgacgaagaagaagactccgctgtatatgaatggttctatgattacaagcctcttgtgaagacaaagttgatcaatggacccagttacaggcgttggcatctgtcattacctatcatggccgctcttcaccgtcttgctgggcagctgctgagtgacttgatagatagaaactacttctatctgtttgatatggagtcatttttcactgccaaggcactcaatctgtgcatcccaggtggtcccaagttcgagcctttataccgggatatggagaagggagatgaagattggaatgagttcaatgatatcaataagcttattattcgctctccattgcgtacggaatacaggattgcgtttcctcacttatataataatcgccctcgcaaagtgaagctgggcgtatatcacactcctatggttatgtacatcaagtcggaagatccagatttgcctgcattttattttgatccattgatccatccaattgctttctacaaaacagacaagcgtggcgagaggaaaggatttcaggaagaagaagatgaagacgatttcgtcttgccagaaggagtggagcctttgattcaggatattccacaatacactgacactactgctgcaggaattgctttgttatttgctccccgccctttcaacatgcggtcaggtcggatgaggcgtgctgaggacatccccctagtgtctgattggtacaaagagcactgtcctccgacctacccagtgaaggttcgtgtaagttatcaaaagctcttaaagtgttatgtgctgaatgagcttcatcatcggccgccgaagggtcaaaagaagaaatatttattccgttcgttgcgtgcaaccaagttcttccagacgacagaattggactgggccgaagcaggtttacaagtatgtaagcaaggttataatatgttgaatcttctgattcacagaaagaatctcaactatctgcatttagattacaattttaatctcaagcctgtgaagactctaacaactaaggagaggaagaagtcccgttttggaaatgcattccatctttgccgggagattttacgcctcaccaagctggttgtggacgcaaatatccaatttcgattaggaaatgttgacgcttaccaacttgcagatggcctacaatatacattctcgcatgttggtcaattgactggtatgtatcgttacaaatataggctaatgagacagattcgaatgtgcaaggatttgaagcatttgatctattaccggttcaataccggacctgttggtaagggccctggctgtggattctgggcacccatgtggcgcgtttggttgttcttccttagaggtgtcgtccctctcttggagagatggttgggaaatctccttgcccgacaatttgaaggtcgtcattccaaaggagttgctaagactgttactaagcaacgggtggagagccattttgacttggaacttagggcagcagtcatgcacgatgtcttagatgctatgccagaaggtatcaagcagaataaggctcgtaccattcttcagcatctgagtgaagcttggcgttgctggaaggccaacattccctggaaagttcctgggctcccagtgccaattgagaacatgattctgcgctacgtgaagtcgaaggcggattggtggactaatgtcgctcattacaaccgagagcgaattcggcgaggtgccacagtggacaaaactgtttgccggaagaatctcggtcgtctaactcgtctttggttgaaggcagaacaagagcgtcagcataattatctgaaggatgggccttatgtcacacctgaggaagcggtggctatttataccacaaccgtacattggcttgaatcccgcaagttttctcccattccttttcctcccctttcatacaagcatgacacgaagctccttatccttgccttggagcgtcttaaagagtcttacagtgtagcagttcgtttgaatcagcagcaaagggaggagcttgggctgatagagcaggcttatgataatccacatgaggccctgtctcgtattaagcggcacttgcttacacaaagagccttcaaggaggtcggaatcgagttcatggatctctatagccatctcattcctgtatatgagattgagccattggaaaagatcactgatgcctaccttgatcagtatttatggtatgagggagataaaagacacttgttccccaattggatcaagcctgctgactcggaacctcctcccttgctggtttacaagtggtgccaaggtatcaacaatttgcaggacatatgggacaccagtgaagggcagtgcgttgttatgttgcagaccaagttcgagaagttcttcgacaaaattgatttgacgatgctgaacagacttctacggttggtccttgaccataacattgctgactatgtaacggcaaagaacaacgtggttctatcttacaaggacatgagtcatacgaattcctacgggctacttcaggggcttcagtttgcctcctttgttgtccagtattatgggctggtgctggatctgctagtgttgggtctcacacgtgctagtgaaatagcgggacctccgcaaatgccaaacgagttcataactttctgggacgtgaaggtggagactcgtcatcccatccgcctatattcgcgttacatagacaaagttcacatactcttccgtttcactcatgaagaagccagagaccttattcagcgttacctgactgaacatccagatccgaacaatgagaacattgtgggttataacaataagaagtgctggcccagagatgctcgtatgcgtctcatgaagcacgatgtaaaccttggaagaagtgtgttctgggacattaagaaccggcttcctcgcagcatcactactttggaatgggagaactcttttgtttcagtctatagcaaagacaatccgaacttgctgtttagcatgtgtgggtttgaagttcgcatcttgccaaagatccggatgactcaagaagctttcggcagcaaagatggtgtatggaacttgcagaacgagcaaaccaaggagcgaactgctatggcttatcttcgcgtggacgatgaacacttgaaagtctttgagaatcgagtcagacagattcttatgtcatctggctctaccacattcaccaagattgtgaacaagtggaacactgctcttattggtctgatgacgtacttcagggaagctacagttcatacccaagagcttctcgatcttcttgtcaaatgtgaaaacaagatccaaactcgtatcaagattggattgaattctaaaatgcctagtagatttcctccagtgatcttttacactcctaaggagattggtggtcttggaatgctgtcaatggggcatattttgattccccagagtgacttgagatacagtcagcagacagacgttggagtcactcactttcgaagtggtatgagtcatgaagatgagcaattgattcccaatctttaccggtacattcaaccttgggaaagtgagttcatcgactcgcagcgtgtgtgggcggagtacgctttgaagagacaagaggctcaggctcagaacaggagactgactttggaggatcttgaggattcttgggacaggggtataccacgtatcaacactttgtttcagaaggatcgtcatactttggcttacgataagggttggcgtgtgcgtaccgacttcaagcagtaccaagtattgaagcagaatcctttctggtggactcatcaacggcacgatggtaagttgtggaacttaaacaactaccgtacggatgttattcaggctcttggtggtgttgaaggcattttggagcacactttgtttaagggaacatatttccctacgtgggaaggtcttttctgggaaaaggcatcaggtttcgaagaatccatgaagtacaagaagctcacaaatgctcagcgctctggtttgaaccaaattccaaaccgtcgttttacactttggtggtcccctaccattaatcgagccaacgtgtatgttggtttccaagtgcagcttgatcttacaggtattttcatgcatggaaagattccgaccttgaagatttccctcattcagatctttagagctcatttgtggcaaaaggtgcacgaaagtgtggtgatggatctttgccaggtcctggatcaagagctcgatgctttggagattgaaacagtgcaaaaggaaactattcacccgcgtaagagttataaaatgaacagctcttgtgcggatattctgttgttcgctgcttacaagtggcccatgagcaagccaagtcttgttgcagagccgaaggatgtttttgatcagaaggctagtaacaagtactggattgatgtgcaattgcggtggggtgattacgattctcatgatattgaacgttacacccgagccaaattcttggattatacaactgataacatgtcaatatatccagctcctacaggcgtgatgatcgggctggacttagcgtacaatctacacgctgcgtttggcaattggttccctggttctaagcctctttttgcacaggctatcaacaaaatcatgaaggctaatcccgcactttatgtgttaagggagcgtgtaaggaaggggttgcagctgtattcatctgagcccactgagccttatttatcttcccagaattacggagagcttttcagcaaccagatcatctggtttgtagacgatactaatgtgtatcgcgtgacaattcacaagactttcgaaggaaacttgaccacaaaacctattaatggtgccatttttatcttcaatccaagaacaggacaactgtttttgaaggtcattcatactagtgtgtgggcaggacagaaacgtttgggacaattggcgaagtggaagactgctgaagaagtagctgctttggtccgttctctcccagttgaagaacagcctaagcagattattgttacgcggaaaggaatgcttgatcctttggaggttcaccttcttgatttcccgaatatcgtcatcaagggcagtgaattgcagttgccattccaagcttgtctgaagattgagaaatttggagatttaattctgaaagcaacggagccgcaaatggttttgttcaacatctatgatgactggctgaagactatatcatcttataccgcattctctaggctcatcttgattcttcgagctcttcacgtcaacaatgagaaggctaagatgttgctgaagcctgacaagactgtagtgacagagccacaccacatctggcctaatctgagtgatgatcagtggatgaaggtcgaagttgctttgagagatctgatattatcggactacgcgaagaagaataacgttaatacgtctgcattgacacagtcagagattcgggacatcattttgggtgctgaaattacgcctccctcacaacaacggcagcagattgctgagatcgagaaacaggcgaaggaggctagtcaattgaccgcagttacaacaaagacaactaacgtacacggagatgatttgattgtaacaactaccagtccttatgaacaagcagcctttggttccaagacagactggcgagtgagagctatctctgctaccaatctccatctgcgtgtcaaccacatttatgtgaactcagatgacatcaaggagtcgggatacacatacattatgccgaagaatgtattgaagaagtttatatgtattgctgatttgaggactcaaattgctgggtatttgtacggagtgagtcctcctgataatccacaggttaaggagattcggtgcattgtaatgcctcctcaatggggcacacatcagcaggtccaccttcctagtagtctacctgagcatgagttcttaaatgagcttgaacctcttggttggcttcatacccagccgaatgagcttccgcagctctcacctcaggacttgaccagtcatgctcgtgttctggagaacaacaagcagtgggatggtgaaaagtgcatcatcttaacctgcagtttcactcctggttcttgctcattaacagcttataagctgacaccaactgggtatgaatggggtcgggctaataaggacagtggcagcaatccccacggttatctgccaactcactacgagaaagtgcagatgctgctgagtgaccgattccttggattctacatggtcccagataacggtccgtggaattataatttcatgggtgtgaaacattctgttggtatgaagtatggaatcaagctctccattccaagagaattttatcatgaagatcacaggccgacacactttttggagttcagcaatctggaggaaaacgatgttgcggagggggatcgtgaagatgtgtttcagtagattttgaaggtctcatttcgtctggaggtttcgtttaaacccagagaacctcgtttgtattaacgtatggcagttgtctttcttagttgagctaaacctgaaatgatcaagtaaatgttcatgctaacaaagcctacatgttagtggctggggttgtgaagagaagaggattatgagctaggtgcgagaatgcttatgtgcgttgtagtcaccagtatatcctatgaacttctttgcacacgtgaacatcttagactgtccggatagtctaggacgattcaaaatagacaatttctcttcttctgaagatgtaaacatttttgtaaaggtaaacatcgatcatgtcaaagaatttgattctgt

SEQ ID NO: 985 - DNA, 6937 bp, Medicago truncatula
acgttcgaaaaatcatccgcgatcacggtgatatgtcatcaacgaaattccgtcacgataagcgagtttatctcggagcactgaaattcgtaccgcatgctatttataagcttctggaaaatatgccaatgccatgggagcaagttcgagatgttaaagttctgtatcatgtttctggtgctattacatttgtgaatgaaattccgcttgttattgaaccaatttacatcgctcaatggagtacaatgtggattatgatgcggagagagaagcgtgatcgacgatgttttaagaggatgaggttcccaccgtttgatgatgaggagcctgtgattgattatgctgataatctgttggaagttgaaccgctcgaagcaattcaccttgagttagatgaagaggaggatggtcctgtgtttgattggttttatgatcataagccactcgtgaaaactaaatttgttaatgggctgagttatcgaaaatggtgtcttccgattccggtgatggaaactttgcataggcttgctgggcagcttttgtctgatttgtgtgataggaattatttctatttgtttgatgtggagtccttttttacagctaaggctttgaatatgtgtatacctggtgggccgaagtttgagcctctgtatcgtgacgcggagaaaggagatgaagattggaatgagtttaatgacattcacaaacttattataaggtcaaaacttaggactgagtataggattgcttttccgcatctttataacgataggccgaggaaagtaaggcttggtgtttaccatactcccatggttgtgtatgtgaaggctgatgatcctgatttacctgcattttattatgatcccttgatacacccgatagctggtgctggtaacaaagagcggtgcgagatggaaatctgcaatgaggatgatgatgactggattttgcctgatggtgtggaaccttttctcaaagatgtggagctttataccgacactaccactgatggaatgtcattgctttttgctccccgtccttttaacatgagatcgggccgaatgaggcgtgcagaagacattcctcttgtgtcagaatggtacaaggagcattgtcctccatcgtatccggttaaagtgagggttagttatcaaaagttgctcaagtgttttgtgttgaatgaactgcatcatagacctcctaagcctcaacaaaagaagaacttattcagatcacttcaagcgacaaagtttttccagaccacagaacttgattgggttgaagcaggtcttcaagtttgtaagcaggggtacaacatgttgaatctgttgatacacaggaaaaatttgaactaccttcaccttgattataattttaatttgaagcctgtcaaaaccttgactacaaaagagcgtaagaaatcacgatttggtaatgcttttcatctctgtcgtgagatccttcgtttgacgaaacttgtggtggatgccaatgttcagtatcgcttgggtaatgttgatgcttttcagctggcggatggcctccaatatactttctctcatgttggtcaattgaccggtatgtatcgatacaagtataggcttttgcgacaaataagaatgtgcaaagacttgaaacacttgatttactaccgttttaacactggccctgtcgggaagggacccggttgtgggttttgggcaccgatgtggagggtttggttattctttcttcgtggtattgtgccccttcttgaacgatggcttggaaatttactggcacgacagtttgagggacgccactctaaaggagtggcgaagaccgtaactaagcaacgtgttgaaagccattttgacttggagcttcgggcagctgttattcacgatgtggttgatgccatcccggagggtatgaaggagaccaagtcaagagttatattgcagcatttgagtgaagcatggcgatgctggaaggcaaatattccttggaaggtccctggtatggctgttccaatagagaatatgatccttcgatatgtgaaatcaaaagcagattggtggacaaatgtcacccattataatcgtgagcgtataagaagaggagcaactgttgataagactgtttgtcgcaagaatcttggaagaatgactcgtctttggctgatggcagagcaggagcgccaatgcaattattcaaaagatggcccatatgttactcctgaagacggtgttactatttatacaactatagtccattggttagaatctcggaagttctcccatattccatttccacctctatcatacaagcatgatacaaagctgcttatccttgcacttgagaggttgaaggaatcctacagtggttcagcaagattaaatcaatttcaaagagaagagttggggctgattgaacaagcttatgacaatccacacgaggcattatcacgaatcaaacgacacctcctcacccaacgtgcattcaaagaagttggaatagagtttatggatttatatggttacttgattccggtttacgaaatagagcctctggagaaaattacagatgcatatcttgatcaatatctgtggtatgaaggggacaaacgtcatctatttcctaactggatcaagccagcagattcagagccaccacctcttttagtttacaaatggtgtcaaggtataaataatttggaaggcatctgggacaccagtgatggtcactgcgttgtgatgttgcagaccaaatttgagaagtttttcgagaagattgatatactaatgttaaataggcttctccgtttggttctagaccacaacattgctgattatatcactgcaaaaaacaatgttgtgttgtcatacaaggatatgagccacacgaataaatatggtcttatacgtggactacagtttgcctcctttgttgctcagtattatggcctgatattggatctcttgcttcttggattgactcgagcgagagagattgctggtccgccgcagatgcctaacgagttcattacttattgggacactaaagttgagaccaggcatccaattaggctgcattcccggtacatagataaagtttatatgttatttcgtttcacacatgaggaggctcgggatctcattcagaaatatctcactgaacaccctgatcctaacaatgagaacatggtggggtacaataataagaagtgctggccaagagatgcaagaatgaggctcatgaagcatgatgtcaatcttgggaggagtgtcttttgggatatgaaaaaccgtcttcctcgaagcatcacaacactggaatgggaaaacagcttcgtttctgtttacagcaaagataatccaaacttgctttttagcatgtgtggatttgaagtgcggatacttcctaaaattagaacgactcaagaagcattcggtaacacaagagatggtgtttggaatctccagaatgaacaaaccaaagaaaggacagctactgctttcttaagagttgatgatgaacagattaaaatgtttgagaatcgtgtgaggcagattcttatgtcttcgggttctactacattcacaaaaattgtcaataagtggaatacagctttaataggactcatgacttacttccgagaggcaactgtacatactcaagagttgttggatttgcttgtcaaatgtgaaaataaaattcagacccgtatcaagataggactcaactcaaagatgcctagcagatttccgcctgtcattttctactcgcccaaggaagttggaggacttgggatgttgtctatgggtcacattttgattccacaaagtgatatacgtcacaatcagaagacagatgttggtgtaacccacttcagaagtgggatgagtcatgaggagggtcagttgattcccagccttcatcgttatatacagccctgggaaagggagttcaatgattcacaacgtgtctgggctgaatatgcagtgaaaaggcaggtagcacaagcacagaataggcgcttgacccttgaggatttggaagactcatgggaccaagggattccacgtattaacactttgtttcagaaggatagacacactttggcttatgataaaggatggagggtacgtttagacttcaagcagtatcaagttttaaaacaaaatcccttctggtggacacaccagaggcatgatgggaagttgtggaacttgaataattaccgaactgatgttattcaagctcttggaggaattgaacaaattcttgaacacactttattcaaaggaacatattttccaacttgggaaggtctcttctgggaaaaagcatcaggttttgaggaatctatgaagtataagaagctcaccaatgcacaaagatctggtctcaaccagatacccaaccgtagatttacgctttggtggtcaccaaccattaaccgagccaatgtttatgttggtttccaggtgcagctagatctgactggtattttcatgcatgggaaaattccaactttgaagatatctcttattcagatattcagagctcacttgtggcagaagatccatgagagtgttgtcatggatctttgtcaggtattggatcaagagttggacgctttggagattgaaactgtccagaaggaaacaatccatcctaggaagagttacaaaatgaacagttcttgtgcagacatccttctctttgctgcccacaaatggccaatgtcaaagcctagtcttgtagctgaatctaaggatgtttttgatcagaaggcaagcaataagtattggattgatgttcagcttcgatggggtgattatgattctcacgatattgagcgttacaccagggctaaatttatggattacacaacagataatatgtctatatacccatctcctactggggttatgattggccttgatttggcatataacttgcattctgcatttgggaactggttccctggatcaaagccactacttcagcaggccatgaataagattatgaagttaaatcctgcattgtatgttttgagggaacgaatcaggaaaggtctgcagttgtactcttctgagcccactgaaccatatttgtcttcccaaaattatggagagatattcaacaaccaaatcaaatggtttgttgatgacactaatgtgtatcgcgttacaattcataagacttttgaaggaaatcttacaacaaaacccatcaatggtgccatttttatcttcaatccaaggactgggcagttgtttcttaaggttatccatacgagtgtatgggccggtcagaagcgtctcggccaactggcgaagtggaaaacagcagaagaagttgctgctcttgtaaggtctttgcctgtagaagaagagccaaagcaaattattgttacccgtaaaggaatgttggacccgttggaggttcacttgttggatttccccaatattgttatcaaaggaagtgagctgcaacttcctttccaagcatgcttgaaaattgagaaatttggggatcttattttgaaggccacagaaccacaaatggttttgttcaacatttacgacgactggctgaagagcatttcctcatacactgcattctccaggctgattcttattctgcgtgcacttcatgtgaataatgaaaaggcaaagatgttactgaggcctgacataactgctgtcactgaacctcatcacatctggccttctctaagtgatgaccagtggatgaaggtggaggttgcattaagagatcttatactttctgattatgcaaagaaaaacaatgtgaatacttcagctttgacccagtctgagattcgtgatattatacttggagctgagattactcccccttcacaacagcggcaacagattgcagagattgaaaaacaggcacgcgaagcaaatcaggtgacagctgtaacaacacagactacaaatgttcacggtgaaggactgattgtaaccaccactagtccctatgagcaagctgcttttggttcgaagactgattggcgtgtcagagcaatatcagccacaaatttataccttcgagtaaaccatatatatgtgaattcggaggacataaaggaaacgggctatacttatatcatgccaaagaacattttgaaaaagtttatatgcatagcagatcttcgaacacagatttctgggtatttgtatggtataagtcctcctgacaatcctcaggttaaggaaatccggtgcattgtgatgccaccacagtgggggactcatcaacatgtccatctcccatcagatctgccagaacatgatttcttgaatgatttggagcctttgggatggatgcatactcaaccaaatgaagttccgcagttgtcgcctcaggatctcacttcacatgctaaggtcctagagaacaataaacaatgggatggggagaagtgtattatcttgacttgcagttttactccgggttcttgttctttaactgcatataaactaactccatctggttatgaatggggacgtattaacaaggatacaggaagcaacccacatggttatcttcccactcattatgagaaggttcagatgctcctcagtgatcgcttcattggtttctacatgattcctgataatggtccatggaattacaactttatgggagtgaggcacgcatcaggcatgaagtatggagtgaagcttgggacccctagggagtattaccatgaagatcataggccaacccatttcttagagttcagcaatatggaggaaggggagacaatcgccaagggagatcgagaggatacattctcttagagtgtgtttgagttggagattgtaaaaaggtaaaatacttttgagggatttaaaatgatttgtcttagttgtagcactatttcttcaaacactatcaagtggtatgttgtagc

SEQ ID NO: 986 - DNA, 7374 bp, Aquilegia formosa
atgtggaacaatggaggaggaggagcgagtagtagtagtagtagtaacaatagtaatactaactcggttttacaacaacaacaatcggttgtattaccacctggtactggaggatcttcgattccaccaccaccagcgatgcagccatcttacagtattccactttcacctgctgaagcagaagctagacttgatgagaaagcaagaaagtggcaacaacttaactctaagagatatggtgataagaggaagtttggatttgttgaaacacagaaagaagacatgccaccagaacatgtcaggaaaatcattagtttcagtcgttttttgttcatatttgttactaatgattagatgcctgttgcttgtacagagaccatggagatatgtcctcgaaaaagtatcgtcatgacaaacgtgtttatcttggagcccttaaattcattccacatgcagtatacaaacttcttgagaacatgccaatgccttgggagcaagtcagggatgtgaagattttgtatcacattacaggagcaatcacatttgtcaatgagataccatgggttgttgaacctatatatatggctcagtggggtacaatgtggattatgatgcgaagggaaaaaagagatcgtcggcactttaaaaggatgcgtttcccaccttttgatgatgaagaaccgccgttggattatgccgacaatctgttggatgttgatcctttggagccaatccagttagaattagatgaagaagaagattctgctgtatgtacatggttttatgatcataaacctcttgtgaaaacaaagcttattaatgggcctagttacaggaggtggcatctgtctctcccaataatggcaactcttcatcggctcgctgggcagctactgtctgatttgatagatcgcaattatttctacctatttgatatggagtcatttttcactgccaaagcattgaacatgtgtattcctggggggcccaagttcgaacctttgtatcgtgacatggagaaaggggatgaggactggaatgaatttaatgacattaacaagcttataattcgctcacctctcaggactgagtacagaattgcatttccccatctctacaacaatagacccaggaaagtaaagctctgtatatatcacaccccaatgataatgtacatcaaaaccgaggatcctgatttacctgcattttactatgatcctttgctccatcccattgtcccttctaacactgatcggattgaaaggaagctacacgaagaagttgacgatgatttttccttgccggaaggagtggaacctttgctgcaaagcactcaactttatactgacacaacagctgcaggaatttctctgttgtttgcaccacgccctttcaatatgagatctggacggatgcgaagggctgaagatatacctcttgtgtcagagtggtacaaggagcactgccctccatcatatccagtcaaagttcgtgtcagctaccagaagttgttgaaatgctttgttttaaatatgttgcatcacagaccacctaaggctcaaaaaaagaagcacttattccgttctcttcaagctactaagttttttcaaagtacgcagctggattgggctgaagctggtcttcaagtttgtaagcaagggtacaatatgctgaatcttttgattcacagaaaaaatttgaattatcttcacctggactataatttcaatctgaagcctgtgaaaacacttaccacaaaggagcgcaagaagtcacgttttggtaatgctttccatttgtgccgtgagatccttcgattgacaaaacttgtggtggatgccaatattcagtttcgattgggaaatgttgatgcattccagttggcagatggcttgcagtacacattttcccatgtcggacaattgactggtatgtacaggtacaaataccgccttatgcgtcagatcagaatgtgcaaagatttgaagcatttgatctactaccgattcaatactgggcctgtgggcaaggggccaggatgtggtttttgggcaccaatgtggagagtgtggttattctttcttcgtggtatagtgccactgctggaaagatggttgggcaatctgctagcacgccagtttgaggggcgccattcaaaaggagttgcgaaaactgttacaaagcagcgtgtcgagagtcattttgatttggaactccgtgctgctgttatgcatgatgttcttgatgctatgccagagggcattaagcaaaacaaggccaggacaatcttgcagcaccttagtgaagcttggcgttgttggaaagctaacatcccttggaaggttcctggtctgccagtacccattgaaaacatgattctacgctatgtgaagtcaaaagcagactggtggacgaatgttgctcattataatcgtgaacgtataagaaggggtgctacagttgataagactgtttgtcggaaaaatttaggaaggttaactcgattatggttgaaggccgaacaggaacggcagcacaattatttgaaagatggtccatatgtaacgccagaagaagcagttgctatttataccaccactgtgcattggctggaatcaaggaaattttccccaattcccttccccccattgtcatacaagcatgatacaaaacttcttattctcgcgcttgagaggcttaaggaatcctacagtgtagctgtgaggttaaatcaactacaaagggaagagttgggtctcattgagcaggcttatgacaatccacacgaggcattgtcacgtataaagcgtcaccttctcacacaacgtgccttcaaagaggttggcatcgagttcatggatttatacagctatcttatccctgtctatgagattgaacctctcgagaagatcacagatgcttatcttgaccagtatttgtggtatgagggtgacaaacgtcatcttttcccaaattggatcaagcctgctgattctgaaccacctcccctcttagtctataaatggtgccaagggatcaacaatctacaaggcatttgggatacaagtgacggacagtgtgttgtgatgcttcagactaagtttgagaaattctttgaaaaaattgacctcacaatgcttaacaggcttcttcgtctggttcttgaccacaatattgctgattacgttactgcaaagaacaatgttgtgttgtcttacaaggatatgagtcacacaaactcttatggtttgatccgtgggcttcagtttgcttcttttgttgtccagtattatgggcttgtgttggatcttctgttgcttggtttgactcgagctagtgaaattgctggtccgcctcagtcacccaatgaattcattacctttggggatacaaaagttgaaacacggcatccaattaggttgtattctaggtatatagacagggtgcacatattgttccgctttacgcatgaggaggcaagggaccttattcagcggtatcttacagagcatcctgatccaaataatgagaatatggttggatataacaacaaaaagtgctggcctcgggatgcgagaatgaggctcatgaagcatgatgtaaatctcggaagaagtgttttttgggacatgaagaatcgacttcctcgaagtattacgacattggaatgggaaaacagttttgtttctgtctacagcaaagacaatcctaacttactcttcagcatgtgtgggtttgaagttcggattttgcccaagattaggatgactcaagaggcctttagcaacacaaaagatggggtttggaacttgcagaatgagcagactaaagagagaacggctgtggctttcttacgagttgatgatgaacacatgaaggtgtttgaaaatcgtgtgaggcagattcttatgtcatcagggtcaacgaccttcacgaaaattgtcaacaaatggaatacagctctcataggtttgatgacatatttccgagaagcgactgttcatacccaggaactgttagacttgctggtcaaatgtgagaacaaaattcaaacccgcatcaagattggattaaattcaaagatgcctagcaggttccctcctgtcatattctatacaccaaaggaaattggaggacttggcatgctatcaatgggtcacatattgattccgcaaagtgaccttagatacagccaacagacagatgttggagtaacacatttccggagtggaatgagtcatgaagaggaccagctcattccaaatctttatcgctatatacagccatgggagagtgagtttgtagattctcagcgtgtgtgggcagaatatgcattaaagaggcaggaggcgcaatctcagaataggcgcttaactcttgaggatctcgaggattcttgggatagaggtatacctcggatcaacaccttatttcagaaggaccggcacacactagcatatgacaagggatggagagtgcgaactgatttcaagcagtatcaagttctaaagcagaacccattttggtggacccatcagcggcatgatggaaaattgtggaacttgaacaattatcgaacagatgtcatccaagctcttggaggagttgagggaattctggagcatactttgtttaaaggaacatactttccaacttgggaagggcttttctgggaaaaggcttctggttttgaggaatcgatgaagtataagaagttgactaacgcacaaagatctgggcttaaccaaattccgaaccgtagatttacgctttggtggtcacctacaataaatagagccaatgtctatgtgggtttccaagttcagttggatctgacaggaatattcatgcatgggaagattccaaccttgaagatatctttgattcagatattccgtgctcatctgtggcagaaggtacatgagagtgtggtcatggatctctgtcaggttttagatcaagaactggatgccttggaaattgaaactgtgcagaaagagacaatacatcctaggaagagttacaagatgaacagctcttgtgctgatattcttctctttgctgctcatagatggcctatgtcgaaacctagtcttgttgccgagtccaaggatgtgtttgatcagaaagcaagcaacaaatattggattgatgtacagctccgatggggagattatgattctcatgatatagaacggtatactcgtgccaagtttatggactacacgacagataacatgtccatctatccttctccaacaggggtgatgattgggcttgatcttgcatacaatttacattccgcttttggcaattggttccctgggtcaaaaccgcttcttgcccaagcaatgaataaaatcatgaagtcgaatcctgccctatatgttctccgagagcgtatcagaaaaggtttgcagttgtattcctctgagcccacagaaccatatttatcatcacaaaactatggagaaatcttcagcaatcaaataatatggtttgttgacgacacaaatgtgtatcgtgttacgattcataaaacgtttgaagggaatctcacaacaaaacccataaatggtgctatcttcatattcaatccaagaacagggcagctgtttcttaagatcatccatacaagtgtatgggctggtcaaaagcgtctgggtcaactggctaagtggaaaacagcagaagaagttgctgctctagtgcgctctttacctgttgaagagcaaccaaagcaaattattgttactcgtaaaggaatgcttgatccattagaagtgcatttgcttgattttcccaacatcgtgattaagggaagtgagctgcaattgccattccaggcttgcttgaagatcgagaaattcggtgacttgattttgaaggcaactgagccacaaatgcttttgttcaacctttatgatgattggctgaagagcatatcatcttacactgcattttcacgtttgatattgatcttgcgtgcgctacatgtgaacaatgagaaagccaaaatgttactgaagcctgacaagacaatcaccacccaaccacatcacatctggccatcccttacagatgatcagtggatgaaggttgaggttgctttgagagatcttatactgtcggattatgccaagaagaacaatgtgaacacatctgctttaacccaatcagagattcgtgatataatactgggggctgagatcactccaccatcacaacagagacagcagattgcagagatagagaagcaggcaaaagaagcaagtcagctgacggctgtcacgacgaggaccactaatgtgcatggtgatgaactcattgtctccacaataagtccctatgagcaagccgcctttgcgtccaaaactgattggcgtgtgagagcaatctcagccactaatctatatcttcgagttaatcatatatatgtgaattcggaagacatcaaggagacgggtttcacttacatcatgcccaagaacattttgaagaagtttatttgtatagcagatttgaggacacaaattgcaggttacctgtatggcataagtcctcctgacaaccctcaagttaaggaaatacgttgcattacaatggtaccacaatggggaactcaccaggaagtccatcttccactagaacttcccgggcatgagtttttgaatgatctggaaccattgggatggatgcatactcagccaaatgagcttcctcagctttcaccacaggatctgacataccatgccaaaattttagaaacccacaagcagtgggatggagagaagtgtatcgtccttacttgcagctttactcctggatcctgttccctaactgcttataagcttacaccaagtggttacgagtgggggcgtgtgaacaaggatactggaggcaatcctcatggttatcttcctactcattatgagaaagttcagatgcttctcagtgaccgtttcttgggattctacatggttccagataatggtccgtggaatttcaacttcatgggggtgaaacataagcacgatatggattatgggatcaagcttggaacaccccgtgaatactatcattacgatcatagaccgacacattatcttgagttcagtaatttggaggagggagagacacaggaaggagaccgagaggatacttttacttgaatctgagatttcaaagcatttgaccgttttgtatccccaatgtcagtggaaggcttgatttgtggggaaatttcagctgaacgccttttgttgtattaatggtgttcatatcccgaggaataatctggatactgtacaagttatgttacctgaagatgttgtacatatcattttgtagtctacctaatgttgttgatgtaca

SEQ ID NO: 987 - DNA, 7503 bp, Mimulus guttatus
atgccgcctatggctcctcccggaactagtggtgtgcaacctgttccgcctccacttgcgacagtgccgccgtcttacacagttgtgccgagtgagtcgcaacttgacgagcgagcgaggaagtggatgcagctcaacacgaagcggtacagtgataagaggaagttcggattcgtggagacgcagaaggaggatatgcctcccgaacatgttcgaaaaatcattcggagcgcagagaagtttctgcttacatttccgcaattgtgcatatataacatatatatacctaggtcttacatgatgtatgttctcttcttcgaaaatgtgtgcatcgattttgcaaaatatagacacgataagcgtgtttatttgggagcgcttaaatttgtaccacatgctgtgtacaaacttcttgaaaatatgcccatgccgtgggaacaggttcgtgaagtgaaggttctctaccatatcactggggctattacatttgtaaatgagataccatgggttgtcgaaccaatctatttggcacagtggggtactatgtggattatgatgcgaagagagaagagagacagacggcatttcaagagaatgcgttttccaccttttgatgatgaagagcctccactggattatgctgataatctcctagatgtggatcctttggagccaatccagttggagatggatgaggaagaagattcggctgtttatacttggttctatgaccataaacctctagtgaagacaaagcttataaatggacccagctacaggaaatggcatctctcgcttccgattatggcaacacttcatcggcttgctggacagctgctctctgatttgattgatcgtaattacttttacctttttgacatggagtcgttcttcacagccaaagccctgaacatgtgtatacctgggggtcctaaatttgagcctctatatcgtgacatggagaaaggagacgaggactggaatgaatttaacgacatcaacaaacttatcatccgttcacctctcaggacagagtacaggattgcgttccctcatctttataataataggcccaggaaagtaaggcttagtatctatcacactccaatggtgatgtacataaaaactgaggatcctgatttacccgcattctattatgatcctctaattcacccaataacaagtacaaataaagatagacgcgataagaaaatctacgaagaagatgatgatgatgatttcgtcttgcccgagggagttgaaccattactgaccagcactcctatatataccgacactactgctgctggagtctcgttgttgtttgccccacggcccttcaacatgcgatctggtcggatgaggcgtgctgaagatataccgctcgtgtctgagtggtacaaggagcactgtcctccatcgtaccctgtcaaagttcgcgttagttaccaaaaactgttgaaatgctttgtgctgaatgagttgcaccaccgtccaccaaaggctcagaagaagaaacacctgtttaggtcccttcaagctacgaagtttttccagactactgaacttgattgggccgaagcaggtcttcaagtttgtaagcaaggttacaatatgctgaacctgctaatccataggaaaaatttgaactacctccatcttgattacaatttcaacttgaagcccgtgaagaccctaaccactaaggaacgcaaaaaatctcggtttggcaatgccttccatctttgtcgtgaaattctgcgtttgacgaagcttgtcgttgatgcaaatatccagttccgtttgggaaatgtggacgcgtttcagttggctgatgggttgcaatacatattttcacatgttggccagttaacgggtatgtaccgttacaaatacaggcttatgaggcagataagaatgtgcaaagatctgaagcacctgatatactaccgattcaataccgggcctgttgggaaaggacctggatgtggtttttgggcacctatgtggagagtatggttgttctttcttcgtggtatagttcctctgcttgaaaggtggttggggaacttacttgccaggcaatttgaaggacggcattcaaaaggagttgctaaaactgtgacgaagcagcgtgttgaaagtcactttgacttggagcttcgtgctgctgttatgcatgatgtccttgatgcaatgccaggcaagcagggtattaaggcaaataaagcaagaactatcttgcagcatttgagtgaagcatggcgttgctggaaagcaaatattccttggaaggttcctggtttgccagttcccattgagaacatgatacttcgttatgtcaaatcaaaagctgattggtggacaaatgttgctcactataatcgtgaacgtattagaaggggagcaacagttgacaagaccgtctgtcgaaagaatcttggaagattgacccgtctttggttgaaggcagaacaggaacgccagcacaactatttaaaggatggcccgtatgtgacaccagaagaagcagtggccatatacacgaccactgtgcattggctagaatctagaaaattctctcctattccttttcctcctctgtcttacaagcacgatacaaagcttctcattcttgctctggaaaggctgaaggagtcctacagtgtggccgtccggttaaaccagcttcaaagagaagagttgggtctgattgagcaggcttatgataatccacatgaagcgctgtcgcgcattaagcgacatttgcttacacagcgagccttcaaagaagtcggcatcgagttcatggatttatacagctatctgattcctgtttatgagattgaacctcttgagaagataactgatgcatatttggatcagtacttgtggtatgaaggtgataaaaggcacctgtttccaaattggattaagccagcagattctgaaccaccaccattgctggtgtacaaatggtgtcagggcataaacaacttacagggtgtatgggacactggtgatggccagtgtgtcgtgatgcttcagactaaatttgagaaattctttgaaaagattgatctaaccatgctcaacaggcttctgcgtttggttcttgatcataacattgctgattatgtgactgctaaaaataacgttgtcttatcatacaaggatatgagtcacacaaattcttatgggctcatacgtggtctacagtttgcttcattcgttgtgcagtactatgggcttgtcctggatcttctgctgcttggtcttacccgagccagtgaaatagctggtccaccacagatgcctaatgagttcattactttccatgacactagggtggaaacacgtcatcctatccgtctctactctagatacattgagaaggtgcatattttgttccgcttcactcacgaggaagctcgtgaccttattcagcgctatcttacagaacatccagatcccaacaatgaaaacatggttggttataacaataagaagtgctggccacgagatgctagaatgcgtctaatgaagcatgatgtgaatcttggtagaagtgttttctgggatatgaagaaccgtcttccacgaagtatcaccacactcgaatgggagaatggttttgtatctgtctacagcaaagacaacccgaacttgctgttcagcatgtctggtttcgaagtacgtatacttcccaagataaggatgactcaagaggcattcagcaatacacgggatggagtttggaatcttcaaaatgagcaaacaaaagaacgtactgcagttgctttcctccgagtagatgatgaacacatgaaggtgtttgaaaaccgagttagacagattctcatgtcctcaggttcaacaacattcacaaaaatcgtcaacaaatggaataccgctcttataggtcttatgacatatttccgtgaagcaactgtgcacacgcaggagttgttggatcttctggtaaaatgtgaaaataaaatacagactcgtataaagattgggttgaattcaaagatgcctagcaggttccctcctgtcatcttttacacaccaaaagaaatcggagggcttggaatgctgtcaatgggtcatatattgattccccagagtgaccttcggtatagtaaacagacagatgttggtgtgacacattttagaagtggaatgagtcatgaagaggatcaattgattccgaatctgtatcgatacattcagccatgggagagtgagtttgttgattctcaacgtgtttgggctgaatatgcattgaagaggcaggaggcacaagcacagaataggcgattaaccctggaggatttggaagattcatgggatcgtgggatacctcgtataaatactctgtttcagaaggaccggcacacgcttgcgtatgacaaaggatggcgagtgaggacagattttaagcaatatcaggttctgaagcaaaatccattctggtggacgcaccagaggcacgacgggaagctgtggaacttgaacaattaccgaactgatgttattcaagctttgggaggagtagaaggaattctcgaacataccttgttcaagggaacatacttcccgacgtgggagggtctcttctgggagaaggcttcaggttttgaggagtctatgaagtacaagaaattgactaatgctcaaagatctggactgaatcaaattcccaataggagatttaccctttggtggtcacctactataaacagagcaaatgtatatgttggtttccaagtacagctggatctcactgggatttttatgcatggaaagattcccactctgaagatatctctgatccagatattcagggctcacttgtggcagaaaatacatgagagtgtggttatggatctttgccaggtgttggaccaagagctggatgcattggagattgagactgtacagaaagaaactattcatcctaggaagagttacaaaatgaacagctcatgtgctgacattctgctctttgccgcacatagatggcccatgtcgaagcctagtctggtggctgagtcgaaggacgtgtttgaccagaaggctagtaacaaatactggatagatgtgcaacttcgctggggtgattatgattcccatgatattgagagatacacaagggcaaagtttatggattacacaacagacaacatgtcaatctatccatcaccaactggggttatgattggacttgatctggcttataatttgcattctgcatttggaaattggttccctgggtcaaagccattgcttgcacaggccatgaacaaaatcatgaagtcaaatcctgcgttatatgttctaagagaacggataaggaaagggctacagctgtattcttctgaacccacagagccatatttatcatctcagaactatggggagatattcagcaaccagatcatctggtttgtggatgacacaaatgtgtatcgagtcacaatacacaagacatttgaaggaaatctcacaaccaaacctattaatggtgccattttcatattcaatccaagaactggtcaactgtttctaaaggttattcacacaagtgtatgggccgggcaaaaacgtcttggtcagctggccaagtggaaaactgctgaagaagtggctgctctggtccggtcattgcctgttgaggaacagccgaagcaaatcattgtgacacgaaagggcatgttggatcccctagaggtgcacttgctcgatttcccaaatatcgtgatcaaaggaagtgagctacaattgccattccaggcttgcttgaagattgagaaatttggtgatctaatattgaaggcaacagaaccacaaatggtcttgttcaatatatacgatgattggttgaagactatctcatcgtacacagctttctctaggctgatattgattttgcgagcacttcatgtcaacaatgagaaggcaaagatgttgctaaagcctgacaagacgattgttaccgagccccaccacatctggccttctttgtccgaggatcagtgggttaaggtcgaagttgctctcagagatttgatactgtctgactatgcgaagaagaacaatgtgaacacatctgctttaacccagtctgagatgcgtgatataattcttggagctgagattaccccgccttcccaacagcggcaacaaattgctgagatagagaaacaggcgaaggaggctagtcaactcacagcagtcaccacaaagaccacaaatgtgcacggagaagaattgattgtgaccactacgagtccttacgaacaagcagcattcgggtcgaaaactgactggcgtgtaagagctatatctgccaccaatctccatcttcgtgtcaatcacatatacgtgaactcggaagacattaaggaaacgggatatacttatatcatgcccaaaaatgtcttgaagaagttcatatgcatagcggacctgcgcactcagattgcaggttacctttacggtgtaagtccaccagacaatccacaggtgaaggagatccgctgtatcgccatgccacctcagtggggtactcaccagcaggttaatcttccatcagcactacccgaacatgatttcttgaatgacttggagcctctaggatggatgcatactcagccaaatgaacttcctcagctatcaccacaggatcttgctgctcatgctaaggtcctatttaacaacaaacaatgggatggagagaaatgcataattctgacgtgcagtttcactcccggttcttgttctttgacagcatataagttgaccccatctggatacgaatggggcaagagcaacaccgatgctgcaagtaatccgcatggttacctcccaacttactacgagaaagttcaaatgctcttgagtgaccgttttcttgggttctatatgattcctgataatggtccttggaactacaatttcatgggtgtgaaacatactcctggcatgaggtatggtgtgaaactggggactccacgggagtactatcacgaggaccatcggccaacgcatttcttggaattcagtaacttggaggaaggtgacactgccgagggtgatagggaagataccttcacctaatctgtttcagatattcgtctgtgtctttttgattttgttacaacaaaccattttaagaaagcaattttctcgactctgtcttttgtaaatacgtgtattcggatgagatgtgtcttgttgtaccgaaggatgtgaagcgctcaacatcgcttatcggctacttgtgaaaactaaggttgaatctgtagcatcgttttgaaatataccgtagctaaaagtgttgtccgttattggactttcttgtcaggttatgtttacagttctgttctgcgatatctggtgactgcgtcctatattagaagtttattgattagttttagcaagtggagtcgtttcgaactaggttttgcttttgacaggatggaactatgatttcca

SEQ ID NO: 988 - DNA, 7386 bp, Arabidopsis thaliana
atgtggaacaacaacgatggtatgcccttagctcctcctggtactggcgggtccatgatgccgccacctcccgctgctcatccttcttacacggcgcttccgccgccttctaatccgactcctccggtcgagcctactcctgaggaagcggaggctaagcttgaggagaaggcccgaaaatggatgcagctaaattccaaacggtacggcgacaagaggaagtttggattcgttgaaactcagaaggaggacatgccacctgagcacgtcaggaagatcatcaggctagttttcttctcttctttctctaccatttcgaaatacagtttacttgataattattttctggctagagatcatggtgatatgtcatccaagaaattccgtcacgacaaacgtgtataccttggagcccttaaattcgtccctcacgcagttttcaagctcttggagaacatgcctatgccctgggagcaggtccgagatgtaaaagttttgtaccacatcaccggagctattacatttgtgaacgagataccatgggttgtggaacctatttacatggctcagtggggtactatgtggattatgatgcgaagggagaagagggatcgtcgtcatttcaagagaatgcggttcccaccttttgatgatgaggagcctccactagactatgcagacaacttgctggacgtggatcctctggagccaattcaattggagctagatgaggaagaagattctgctgtccacacttggttttacgaccacaagccactcgttaaaacaaaactgattaatggtcccagttaccggaggtggaacctctcacttccaatcatggcaacccttcacaggcttgcaggccagttgctgtctgatttgattgatcgcaactacttctacttatttgacatgccatctttcttcacagcaaaagctctgaacatgtgcatacctggtggacccaagtttgaacctttgtaccgtgatatggagaaaggggatgaggactggaatgagtttaatgacatcaacaagctcattattcgttcccctctgcgtactgagtacagaatagcttttccccatctctacaataatcggcccaggaaagtaaaactctgtgtgtatcacagtcctatgatcatgtatataaagaccgaggatcccgatcttcctgcattttattatgatccgttgattcacccaataagcaacaccaacaaggaaaaacgtgaaaggaaggtttatgatgatgaggatgacttcgccttaccagaaggtgtggaacctttgctaagagatacccaactctacactgacactacagctgctggcatatcattgttgtttgccccacgacctttcaatatgaggtctgggaggacgcgccgcgcagaagatattcccttggtgtcagagtggttcaaagagcactgtcctccagcctatccggttaaagttcgggttagttaccaaaagctattgaagtgctatgtgctgaatgagttgcaccatagaccgcctaaagctcagaagaagaagcacttgtttcgatctcttgcagctacaaagtttttccaaagtaccgaactggattgggttgaagtgggtctgcaagtctgtcggcagggatataatatgctgaatctgctgattcataggaagaatttaaactacctgcatcttgactacaacttcaacctcaagcctgtgaaaactttgaccaccaaagagcgaaagaagtcacgttttgggaacgctttccatctgtgccgtgagatcctccgcctgacaaaacttgtagttgatgcaaatgtccaattccgacttggtaatgtcgatgccttccaattggctgatggtctgcagtatattttctctcatgttggccagttgacgggtatgtatcgttataaatacagactgatgaggcagattcggatgtgcaaggatttaaagcacttgatatattaccgtttcaatactggtccggtgggtaagggtccagggtgtggattttgggctccaatgtggagggtatggttgtttttccttcggggtatagttcctcttcttgaaagatggttagggaatcttcttgctcgtcaatttgaggggcgtcattcaaaaggagtggccaaaacagtcacaaagcagagagttgaaagccattttgatctggagcttcgggctgctgtcatgcatgacgtccttgatgctatgccagagggtatcaagcaaaataaagcgcggactatattgcagcaccttagtgaggcatggcggtgctggaaagctaatatcccatggaaggtccctgggttacctgtgccgattgaaaatatgatcctgcgttatgtcaagtctaaggctgattggtggacgaatgttgctcactacaatcgtgagcgtatccgaagaggggctactgttgataagacagtttgtagaaagaatctcggaaggttgactcgtctttggctaaaggcagaacaggaacgacagcacaattacctgaaagatggtccgtatgtcactccagaagaagcacttgcaatttatacaactactgttcattggctggaatcaaggaagttctcaccaattccattccctccattgtcatacaaacatgacacaaagttgctcatccttgcccttgagagactgaaggaatcatatagtgtagctgtgaggttgaaccagcagcagcgagaagagcttggtttgattgaacaagcttatgacaatcctcatgaagctctatcacgaataaaacgtcatcttctcacccaacgaggctttaaagaggttggcatagaatttatggatctttatagctacttgattccagtttatgaaatagagcctctagagaaaattaccgatgcatatcttgatcaatacttgtggtacgaaggtgacaagcgtcacttgtttccaaactggattaagccagcagactcagagccgcccccacttctggtttataaatggtgtcaaggtatcaacaatttgcaaggcatatgggacacaggtgatgggcagtgtgtggtgatgctccaaactaagttcgaaaagttctttgagaaaatcgatttgacaatgttgaacaggcttcttcgtttggttcttgaccacaatattgcagactatgtgtccgccaagaataatgtggtcctgtcttacaaggatatgagtcatactaactcgtatggtctcattaggggacttcagtttgcatcgtttgttgttcagttttatggactattgcttgatcttttgcttcttggtttgactcgagcgagtgaaattgctgggccacctcagatgcctaatgagtttatgacgttttgggatacaaaagtggagacacgccatcccataagactctattctcggtatatagacaaagttcatataatgtttaaatttacccatgaagaagctcgggatcttattcagcgatatcttacggagcatcccgatcccaacaatgaaaacatggtgggatacaacaataagaagtgctggccaagagatgcaaggatgagactgatgaaacatgatgtcaatcttggtagaagtgtcttctgggacatgaagaaccgtcttcctcggagcatcactactttggagtgggagaatggctttgtctctgtctatagcaaggataatcctaacctgctctttagcatgtgtggatttgaagtccggatactccctaaaatcaggatgacccaagaagctttcagcaacacaaaagatggtgtctggaatctgcaaaatgaacagacgaaggagaggactgcagtagcttttctgcgggttgacgatgaacacatgaaggtatttgagaatcgtgtgaggcagatcctcatgtcatcaggatcaaccacctttaccaagatcgtcaacaaatggaatacagctctaattggtctcatgacttacttccgggaagccactgtacacacgcaagagctcttggatctactggtcaagtgtgagaataaaatccaaaccaggattaagattgggctgaactcaaagatgcctagtcgatttcctcctgttatcttctacactccaaaggaaattggtgggctgggaatgttgtcaatgggacatattttgatcccacaaagtgaccttcggtacagcaagcaaacagatgttggtgtaacccactttaggagtggaatgagccacgaggaagatcagcttataccaaatctttaccgttacatacagccgtgggaaagtgaatttattgattcacagcgggtgtgggcagaatatgctttgaagaggcaggaagcccaagcccaaaataggcgtcttacactggaagatctggaagattcttgggataggggaattcctcgtataaatacactgtttcagaaggataggcacactttggcatatgataaaggttggagggttcggaccgacttcaagcagtaccaagtccttaaacaaaatccattctggtggacacaccagagacatgatgggaagttgtggaacttgaacaattaccgcactgatgtcatccaagctcttggaggtgttgagggtattcttgagcacacattattcaaggggacatatttcccgacatgggagggacttttctgggagaaggcgtctggttttgaggagtcgatgaaatataagaagttgactaatgctcagaggtctggtctgaaccagattccaaatagaagattcacgctttggtggtcgccaacaattaatcgagcgaatgtctatgtgggtttccaagtgcagttggatctgacaggaatatttatgcatggaaagattcctacacttaagatatctttgattcagattttccgtgcccatttgtggcagaagatccatgagagtgttgttatggatctctgccaagtattggaccaagagttggacgctttggagatagaaactgtacagaaggagacaattcatccaaggaagagttataaaatgaacagctcttgtgctgatgttcttctatttgctgctcataaatggccaatgtctaagcctagcctggttgcagagtcgaaggatatgttcgaccagaaagcgagtaacaagtattggatagatgtgcaacttcgatggggagattatgactctcatgatattgagcgttatactagggccaaattcatggactatacaactgacaacatgtctatctatccatctccaacaggtgtaatgattgggcttgatctggcatacaacctgcattctgcctttggtaattggttccctggatcaaagcctcttcttgctcaagcgatgaacaagatcatgaagtccaatccggctctatatgtgttgagagagaggataaggaaaggtttgcagctatactcgtctgagcctacagagccatatttgtcatctcaaaactatggtgaaatattcagcaatcagattatatggtttgttgatgataccaatgtttatcgtgtcacgattcacaagacatttgaaggaaatttaacgacaaagccaatcaatggtgcgattttcattttcaatccaagaactgggcagttgttcctgaaggttatccatacaagtgtttgggctggtcagaagcgtcttggccagctagcgaaatggaaaactgcagaagaggttgctgcacttgtgcgatctctccctgttgaagaacagccaaagcagattattgtcacacggaaaggaatgttggatccccttgaggttcacttgcttgatttccccaacattgttattaagggaagcgagctgcagcttccgttccaggcttgcctaaagatagagaaatttggtgacctgattttgaaggctacagaaccgcagatggtcttgtttaatatatatgatgattggttgaagagtatttcttcttatactgccttttcaagacttattttgatccttcgtgcgcttcacgtgaataatgagaaggctaagatgttgttgaagcctgacaagtccgttgtcactgagccacatcacatctggccctctctcactgatgatcaatggatgaaggtggaggtagcacttagagatcttattctttctgactacgcaaagaaaaacaatgtgaatacctcagctctgacacaatcagagatccgagatattattcttggagctgagattactccaccctctcaacagaggcaacagatagctgagattgagaaacaggcaaaggaagccagccagcttactgcagtcacaacaagaactacaaatgttcatggtgatgagctcattgtcaccaccacaagcccttacgagcaatctgcattcggttccaagacagattggcgtgtacgtgcaatatcagccactaatctttaccttagagtcaatcacatatatgtgaactcagatgacataaaggaaaccggatacacctacatcatgccaaagaacattttgaagaagttcatatgcgttgcggatcttcgtactcaaattgctgggtatttatatggtattagtcccccggataatccccaggtgaaggagatccgttgtgttgtgatggtgccacagtggggaaatcatcagctagttcacctgccgtcatctcttcctgagcatgatttcctaaatgatcttgagcccttgggatggttgcacacacagcctaacgagctgcctcagctatcaccacaggatgtaacctctcattcccgtattctggagaacaacaagcaatgggatggagaaaaatgcatcatcctgacctgcagtttcactccgggctcctgctctttgacgtcatataagttgacccaaaccggatatgaatgggggcggcttaacaaggacaatggcagcaatcctcacggttaccttcccacccattatgaaaaggttcagatgctgctgagtgaccggttcctcgggttttacatggttcctgagagtggaccgtggaactatagcttcactggagtgaagcacacgttgagcatgaaatacagtgtcaaactcggatccccaaaggagttctatcacgaggagcatcgacccactcatttcctggagttcagcaacatggaggaggctgacattacagagggagatcgcgaggacacatttacttgagatatactcaattttcttaccgtgtgtgtgatttagctttattttgcagtatagacttgtaagatgttgtactgtcttgtgctttactgagatagatagtaaggtccctaaatcttaaaaagatggtttgccactataatcaaaatcttgaatgtgatgtaatcatacgtacgtgtataacggaattttggtaactaacgtcttcgatgagagaaaataaaacgacaaatttaaact

SEQ ID NO: 989 - DNA, 2355 bp, Triphysaria pusilla
atggcccatgtcgaagcctagtctcgtggcagagtcaaaggatgtatttgaccaaaaggctagtaataaatactggatagatgtgcagcttcggtggggtgattatgattcccatgatattgagcggtacactagggcaaagtttatggattacacgaccgacaatatgtcaatctatccatcaccaactggtgttatgattggactcgatctcgcatataatttgcattctgcttttggaaattggttccctggctccaaaccattgcttgctcaggccatgaacaagatcatgaagtcaaatccagcattgtatgttctgagagaacgtattcggaaagggcttcaattatattcttcagaacctacagaaccttacctatcatctcagaactacggggagatattcagcaatcagattatctggttcgtggacgacacaaatgtgtatcgtgtcacgatccacaagacatttgaaggaaatttgaccacaaaaccaataaacggggctattttcatttttaaccctagaactggtcaattgtttcttaaggtcattcatacaagtgtgtgggctgggcaaaaacgtcttggtcagctggctaagtggaaaactgctgaagaagtggctgctctggtgcggtcattgccggttgaagaacagccgaagcagatcattgtgacacgtaaaggaatgctggaccctcttgaggtccatttgctcgatttccctaacattgtcatcaagggaagtgagctacaattgccgttccaggcttgcttgaagattgagaaattcggtgatctgatactgaaggctactgaaccacagatggtcttgttcaatatatatgatgattggttgaagtctatctcatcttacacagcgttctccaggctgatattgattttgagagctctccatgtgaacaatgagaaggcaaaaatgttgctgaagcccgacaagacaattgtcaccgaggctcaccatatctggccttcgttatcagatgaccaatggactaaggttgaagttgccctcagagatctcattctttctgactatgccaagaagaataacgtgaacacgtcagcgttaacccaatctgagatccgtgacataattcttggagctgagattactccgccttcccaacagcggcaacaaattgctgaaattgagaaacaggcaaaggatgctagtcagttaacggcagtcaccacgagaaccacaaacgtgcatggtgacgagataattgttacgacaattagtccttacgaacaagctgcatttggatcgaaaactgactggcgtgtcagggctatatcatccaccaacctccatcttcgagtcaatcacatttatgtgaactctgacgacatcaaggaaactggatatacttatatcatgcccaagaatatcttgaagaagttcatatgcatagctgacctgcgtactcagatttctgggtacctttacggtataagtcccccagacaatccccaggtgaaggagatccgctgtatcgccatgccaccacaatggggtactcaccagcaggttcatcttccatcggcccttcccgaacatgatttccttaatgacttggagcctttaggatggatgcacacacagccaaatgagcttcctcagttgtcaccacaggatcttgctgcgcatgctcgggtattatcgaacaacaaacaatgggatggagagaaatgcataattttgacctgcagtttcacacccggttcatgctccttgaccgcgtacaagttaaccccatcagggtacgagtggggtaagagcaactcagacgtagccagcaatccgcatggctatctgccgacttactatgagaaggttcaaatgctcttgagtgaccgtttccttggattctacatgatacctgataatggcccttggaactacaactttatgggtgtgaagcataccgtaagcatgaagtatggggtgaagctcggcacaccccgagaatactataacgaggaccatcggccgacccatttcctggagtttagtaacttggaagaaggtgacatggcagagggtgatcgggaagacactttcacttaaattgtactgaaatacattttctagacaatgtgattcgaaatgaggatatgcatgtactgttttgtaacttgaagctcttcttttgttgtaaatacgttttcgtctttgcgtttttgttgtatctgatgtatttgtgcaagtgttacaatgagaactttctcacgcttgtttgcaattatcgccacaattcagtttgtctttgatgcttttaagccactaggcaaatgttatctctaacaaaaaaaaaaaaaaaa

SEQ ID NO: 990 - DNA, 7299 bp, Arabidopsis lyrata
atgtggaacaacaacgatggtatgcccttagctcctcctggtaccggcggctccatgatgccgccaccgcccgctgctcatccttcttacacggctcttccgccgccttctactcctactcctccgctcgagcctactcctgaggaggcggaggccaagcttgaggagaaggcccgaaaatggatgcagctaaattccaagcggtacggcgacaagaggaagtttggattcgtcgaaactcagaaggaggacatgccacctgagcacgtcaggaagatcatcaggcgagttttctcctcttcgatttcgaattccagtttactggaatattattttctggcccgggatcatggtgatatgtcatccaagaagttccgtcacgacaaacgtgtataccttggagcccttaaattcgttcctcacgcagttttcaagctcttggagaatatgcctatgccctgggagcaggtccgagacgtgaaggttttgtaccacatcaccggagctattacatttgtgaacgagataccatgggttgtggaacctatttacatggctcagtggggtactatgtggattatgatgcgaagggagaagagggatcgtcgtcatttcaagagaatgcggtttccaccatttgatgatgaggagcctccactagactatgcagacaacttactggacgtggatcctctagagccaattcaattggagctcgatgaggaagaagattctgctgtgtacacttggttttacgaccacaagccactcgttaaaacaaaactgattaatggtcccagttaccggaggtggaacctctcacttccaattatggcaacccttcacaggcttgcaggccagttactgtctgatttgattgatcgcaactacttctacttgtttgacatgccatctttcttcacagcaaaggctctgaacatgtgcatccctggtggacctaagtttgaacctttgtaccgcgatatggagaaaggggatgaggactggaacgagtttaatgacatcaacaagcttatcattcgttcccctctgcgaaccgagtacagaatagcttttccacatctctacaataaccggcccaggaaagtaaaactctgtgtgtatcacagtcctatggttatgtatataaagaccgaggatcctgatcttcctgcattttattatgatccgttaattcacccaataagcaacactaacaaggacaagcgcgaaaggaaggtttatgatgatgatgatgaggatgacttcgccttaccagaaggagtggaacctttgctaaaagatacccaactctacactgacactacagctgctggcatatcattgttgtttgccccacgacctttcaatatgaggtctgggaggactcgccgggcagaagatattcccttggtgtcagagtggttcaaggagcactgtcctcctgcctatccggttaaagttcgggtcagttaccaaaagttattgaaatgctacgtcctgaatgagttgcaccatagaccacctaaagctcagaagaagaagcacttgtttcgatctcttgcagctaccaagtttttccaaagtaccgaactggattgggttgaagtgggtctgcaagtctgtcggcagggatataatatgctgaatctgttgattcataggaagaatttaaactacctgcatcttgactacaacttcaacctcaagcctgtgaaaactttgaccaccaaagagcgaaagaagtcacgttttgggaacgctttccatctctgccgtgagatcctgcggctgacaaaacttgtagttgatgcaaatgtccaattccgacttggtaatgttgatgccttccaattggctgacggtctgcaatatattttctctcatgttggccagttgacgggtatgtatcgttataaatacagactgatgaggcagattaggatgtgcaaggatttaaagcacttgatatactatcgtttcaatactggtcctgtgggtaagggtccagggtgtggattttgggctccaatgtggagggtatggttgtttttccttcggggaatagttcctcttcttgagcgatggttagggaatcttcttgcacgtcaatttgaggggcgtcattcaaaaggagtggccaaaacagtcacaaagcagagagttgaaagccattttgatttggagcttcgagctgctgtcatgcatgacgtccttgatgctatgccagagggtatcaagcaaaataaagcgcggactatattgcagcaccttagtgaggcatggcgatgctggaaagctaatatcccatggaaggtccctgggttacctgtgcctgttgagaatatgatcctccgttatgtcaagtctaaggcagattggtggacgaatgttgctcactacaatcgtgagcgtatccgaagaggggctactgttgataagaccgtttgtagaaagaatctcggaaggttgactcgtctttggctaaaggcagaacaggaacgacagcacaattacctgaaagatggtccgtatgtcactccggaagaagcacttgcaatttatacaactactgttcattggctggagtcaaggaagttttctccaattccatttcctccattgtcatacaaacatgacacaaagttgctcatccttgcccttgagagactgaaggaatcatatagtgtagctgtgaggttgaaccagcagcagcgagaagagcttggtctaattgaacaagcttatgacaatcctcatgaagctctatcacgaataaaacgtcatcttctcacccaacgtggctttaaagaggttggcatagagtttatggatctatatagctacttgattccagtttatgaaatagagcctctagagaaaattaccgatgcatatcttgatcaatacttgtggtacgaaggtgacaagcgccacttgtttccaaactggattaagccagcagactcagagccgcccccacttctggtttacaagtggtgtcaaggtatcaacaatttgcaaggcatatgggacacaggtgatgggcagtgtgtggtgatgctccaaactaagttcgaaaagttctttgagaagatcgatttgacaatgttgaacaggcttcttcgtttggttcttgaccacaatattgcagactatgtgtctgccaagaataatgtggtcctgtcttacaaggatatgagtcatactaatgcgtatggtctcattaggggacttcagtttgcatcgtttgttgttcaattttatggactattgcttgatcttttgcttcttggtttgactcgagcgagtgaaattgctgggccacctcagatgcctaacgagtttatgacgttttgggatacaaaagtggagacacgccatcccataagactctattctcgatatatagacaaagttcatataatgtttaagttttcccatgaagaggctcgagatcttattcagcgatatcttacggagcatcctgatcccaacaatgaaaacatggtgggatacaacaataagaagtgctggccacgagatgcaaggatgaggctgatgaaacatgatgtcaatcttggtagaagtgtcttctgggacatgaagaaccgtcttcctcggagcatcactactttggagtgggagaatggctttgtctctgtctatagcaaggataatcctaacctgctctttagcatgtgtggatttgaagtccgcatacttccaaaaatcagaatgacccaagaagctttcagcaacacaagagatggtgtctggaatctgcaaaatgaacagaccaaggagaggactgcagtagcttttctgcgagttgacgatgaacatatgaaggtatttgagaatcgtgtgaggcagatccttatgtcatcaggatcaaccacctttaccaagatcgtcaacaaatggaatacagctctaattggtctcatgacttacttccgggaagccactgtacacacacaagagctcttggatctactggtcaagtgtgagaataaaatccaaacaaggattaagattgggctgaactcaaagatgcctagtcgatttcctcctgttatcttctacactccaaaggaaattggtgggctgggaatgttgtcaatgggtcatattttgatcccacaaagtgaccttcggtacagcaaacaaacagatgttggtgtaacccactttaggagtggaatgagccacgaggaagatcagcttataccaaatctttaccgttacatacagccgtgggaaagtgagtttattgattcacagcgggtgtgggcagaatatgcgttaaagaggcaggaagcccaggcccaaaataggcgtcttacactggaagatttggaagattcttgggataggggaattcctcgcataaatacactgtttcagaaggataggcacacattggcatatgataaaggttggagggttcggaccgacttcaagcagtaccaagtccttaaacaaaatccgttctggtggacacaccagaggcatgatgggaagttgtggaacttgaacaattaccgcactgatgtcatccaagctcttggaggtgttgagggtattcttgagcacacgttattcaaggggacctatttcccgacatgggagggacttttctgggagaaggcatctggttttgaggagtcgatgaaatataagaagttgactaatgcgcagaggtctggtctgaaccagattccaaatagaagattcacgctttggtggtcgccaacaattaatcgagcaaatgtctatgtgggtttccaagtgcagttggatctgacaggaatatttatgcatggaaagattcctacactgaagatatctttgattcagattttccgtgcccatttgtggcagaagatccatgagagtgttgttatggatctttgccaagtattggaccaagagttggacgctttggagatagaaactgtgcagaaggagacgattcatccaaggaagagttataagatgaacagctcttgtgctgatgttcttctatttgctgctcataaatggccaatgtctaagcctagcctggttgcagagtcaaaggatatgtttgaccagaaagcgagtaataagtactggatagatgtgcaacttcgatggggagattatgactcccatgatattgagcgttatactagggccaaattcatggactatacaactgacaacatgtctatctatccatctccaacaggtgtaatgattgggcttgatctggcatacaacctgcattctgcctttggtaattggttccctggctcaaaacctcttcttgctcaagcaatgaacaagatcatgaagtccaatccggccctatatgtgttgagagagaggataaggaaaggtctgcagttatactcttctgagcctacagagccatatttgtcatctcaaaactatggtgaaatattcagcaatcaaattatatggtttgttgatgataccaatgtctatcgtgtcacgattcacaagacatttgaaggaaatttaacgacaaagccaatcaatggtgcgattttcattttcaatccaagaactgggcagctgttcctgaaggttatccatacaagtgtttgggctggtcagaagcgtcttggccagctagcgaaatggaaaactgctgaagaggttgctgcacttgtgcgatctctccctgttgaagaacagccgaaacagattattgtcacgcggaaaggaatgttggatccccttgaggttcacttgctggatttccccaacattgttatcaagggaagcgagctgcagcttccgttccaggcttgcctcaagatagagaaatttggtgacctgattttgaaggccacagaaccacagatggtcttgtttaatatatatgatgattggttgaagagtatttcttcgtatactgccttttcaagacttattttgatccttcgtgcgcttcacgtgaataatgagaaggctaagatgttgttgaagcctgacaagtccgttgtcactgagccacatcacatctggccttctctcactgacgatcaatggatgaaggtggaggtagcacttcgagatcttatcctttctgactacgcaaagaagaacaatgtgaatacctcagctctgacacaatcagagatcagagatattattcttggagctgagattactccaccctctcaacagaggcaacagatagctgagattgagaaacaggcaaaggaagccagccagcttactgcagtcacaacaagaactacaaatgtccatggtgatgagctcattgtcaccaccacgagcccttacgagcaatctgcattcggttccaaaacagattggcgtgtacgtgcaatatcagctactaatctttacctcagagtcaatcacatatatgtgaactcagatgacataaaggaaaccggatacacctacatcatgccaaagaacattttgaagaagtttatatgcgtagcagatcttcgtactcaaattgctggatatttatatggtattagtcccccggataatccccaagtgaaggagatccgttgtgttgtgatggtgccacaatggggaagtcatcagcaagttcacctgccgtcatctcttcctgagcatgatttcctaaatgatcttgagcccttgggatggttgcacacacagcctaacgagctgcctcagctgtcaccacatgatgtaacctctcattcccgtgttctggagaacaacaagcaatgggatggagaaaaatgcatcatcctgacctgcagtttcactccgggctcctgctctttgacgtcatataagttgacccaaaccggatatgaatgggggcggcttaacaaggacacaggcagcaatcctcacggttaccttcccacccattatgaaaaggttcagatgctgctgagtgaccggttcctcgggttttacatggttcctgagaatggaccgtggaactacaacttcatgggagtgaagcacacggtgagtatgaactacagtgtcaaactcggatccccaaaggagtactatcacgaggagcatcgacccactcatttcctagagttcagcaacatggaggaggctgacattgcagagggagatcgcgaggacacatttacttgagatatacttacttttcttaccatgtgtctgatttagctttattttgcaacagagacttgtaagatgttttactctcttgtgcgttactgagatagattgtaacgtccttaaatcttacaaagatgttttgccactagaatgaaaatcttgaat

SEQ ID NO: 991 - DNA, 1571 bp, Sequoia sempervirens
tttgaaggaaatcttacaacaaagcctatcaatggggcaattttcattttcaacccgagaacagggcaactatttttgaaggtcattcatactagtgtgtgggcagggcagaagcggcttggtcagctagcaaaatggaagacagctgaagaagtagctgcattggtaaggtcattacctgttgaggagcaaccaaaacagattattgttacgcgtaagggaatgcttgaccccttggaagttcacttacttgactttcccaacattgtcatcaaaggcagtgagcttcagttgcctttccaagcatgcttaaaaattgaaaagtttggtgatctgattctgaaggctactgagccccaaatggttctcttcaacatttatgatgattggttaaagactatctcttcatacacagcattttctcgcctaatattgatacttcgtgcccttcatgtgaataacgagaaagcaaagatgttgttgaaacctgacaagacagtcgttaccgaaccacatcacatttggccaaacctctctgatgatcaatggatgaaggtggaagtagctttgagagacctgatcctatctgactatgcaaagaagaaataatgttaatacatcagcattaactcaatcagaaattagggatattatacttggagctgaaataaccccaccttctcaacaaaggcaacagattgcagaaattgaaaagcaggcaaaggaagcgagccaactcactgctgttacaactagaactacaaatgtgcatggtgatgagttgattgttaccaccacgagtccctatgagcaggctgcttttggttctaaaacagattggcgagttagggctatatctgcaacaaacctctatcttagagtcaatcatatctatgtgaactcagatgatatcaaggaaactggctatacatacatcattcctaagaacatattgaagaaattcatttgtatagcagaccttagaacccagattgcaggctatctctatggtgtaagtcccccagacaatccacaggtgaaggaaattcgttgcatatctatgcctccacagtgggggacgcatcagcaagttcatttgcccttggctttgcctgagcatgattttctgaatgatctagaacctttaggatggatgcatacacaaccgaatgaacttcctcagttatcacctcaggacttgacatgtcatgcccgaatcctagaaaacaataagcaatgggatggagagaaatgcataattctaacatgcagcttcactcctggctcttgctccttaactgcatacaaactcacaccaacaggatatgaatggggacggcttaacaaagacactggaagcaatccacatggatatctacccactcattatgaaaaagtacaaatgcttctgagtgaccgcttccttggcttttatatggttccagacaatggtccatggaattacaatttcatgggtgtcaagcatacagtcagtatgaaatatggagttaagctaggaactcctcgagacttttaccatgaagatcatcgacccacacactttctggagt

SEQ ID NO: 992 - DNA, 1898 bp, Raphanus sativus
  misc_feature (121)..(121): n is a, c, g, or t
  misc_feature (267)..(267): n is a, c, g, or t
  misc_feature (306)..(306): n is a, c, g, or t
  misc_feature (645)..(645): n is a, c, g, or t
  misc_feature (791)..(791): n is a, c, g, or t
  misc_feature (817)..(817): n is a, c, g, or t
  misc_feature (828)..(828): n is a, c, g, or t
  misc_feature (838)..(839): n is a, c, g, or t
  misc_feature (848)..(848): n is a, c, g, or t
  misc_feature (865)..(865): n is a, c, g, or t
  misc_feature (993)..(993): n is a, c, g, or t
  misc_feature (1012)..(1012): n is a, c, g, or t
  misc_feature (1825)..(1825): n is a, c, g, or t
  misc_feature (1827)..(1827): n is a, c, g, or t
gatatggtttgtggatgataccaatgtctatcgtgtaacaattcacaagacgtttgaaggaaatttaacaacaaagccaatcaatggtgcgattttattttcaatccaagaactggacagntattcctgaaggttatccacacaagcgtttgggctggtcagaggcgtcttggtcagctagcgaaatggaaaactgctgaagaggtagctgctcttgtgaggtctctccctgttgaagaacagccaaaacaagttattgttactcgnaaaggaatgctcgatccccttgaggtccacttgctgganttccccaacattgttatcaagggaagtgaactgcagcttccattccaggcgtgccttaagatagagaaatttggtgatctgattttgaaggccacagaaccacagatggtcctgttcaatatctatgatgattggttgaagagtatttcttcgtatactgccttttcgagactcattctgatccttcgtgcgcttcacgtgaataatgagaaggctaagatgctgttgaagcccgacaagtctattgtcactgagccacatcacatctggccctctctcactgacgaccagtggatgaaggtggaggtagctcttagggatcttatcctatctgactangcaaagaagaacaatgtgaatacctcagctctgacacaatcagagatcagagatattatccttggagctgagattaccccaccctctcaacagaggcaacagatagctgagattgagaaacaggcaaaagaagccagccagcttantgcagtcacaaccagaacgacaaatnttcatggtgangagctcattnncactaccantagcccctacgagcaanctgcattcggttccaagacagattggcgtgtgcgtgcaatatcagctaccaacctctacctcagagtcaatcacatctacgtgaactcggatgacataaaggagacgggatacacatacatcatgccnaagaacatcctgaagaagntcatatgcgtagcagatcttcggactcaaattgctggatatctgtattgtatcagcccaccggataatccccaggtgaaggaaatccgttgtgttgtgatggtgccgcagtggggaagtcaccagcatgtgaacctgccgtcagctcttcctgagcatgatttcttgaatgatctcgagccattgggatggctgcacacacagcctaacgagctccctcaattgtcaccacaggatgtgaccgctcattcccgcattctggagagcaacaagcaatgggatggagaaaaatgtatcatcctgacatgcagtttcactccggggtcctgctctttgacatcatataagctgacccaagctggatatgaatggggacgtctcaacaaggacacaggcagcaatcctcatggctaccttcccacccattatgagaaggttcagatgctattgagtgaccgcttcctcgggttttacatggttcctgagaacggaccgtggaactacaactttatgggcgtgaagcacacggtgggcatgaaatacagcgttaaacttggatccccaaaggagtactatcacgaggaacatcgacccactcatttcctcgagttcagcaacatggaagacgctgacatcgttgagggagatcgtgaagacacctttgcttgatcattatgtttttaccatgttatgtactacgagtgacttgagttttactcttgtgtgtgtgtggtagtattgtaatgtacccaagtctatgacatcttttgccactagagctaaaatctttttatgtaaaaacttatagttactncntttcaaagcttgagaggtagaaaggcaactaactttcttgtaacaaaaggggaaaaagcttcgtatctcca

SEQ ID NO: 993 - DNA, 7378 bp, Plantago ovata
cccctttctctacgatttatccgcaaatatcaatttctactgctcaacgtttgttccaacgcctttctggcggttttgaattccgtcaatcatgtacaacgggcaggattggaacaacttcaataatccggcgccgcccggtactagcggcggtgccggagctatgccaccaatgatgccgcctcccggaaccagtggaccgcctcctggagctccgccaccgccttcggtgcagccaccttcgtacacggtggtaccgactgaatctcagctcgatgagagggcgaggaagtggatgcagctcaactcgaagcggtatggagataagcggaagtttgggttcgtggaggcgcagaaggaggatatgccacctgagcatgtcaggaaaatcattagagatcatggcgacatgtcatcgaagaagtttcgtcatgataagcgtgtgtatctgggagctcttaaatttgttccacacgctgtctataagcttcttgagaatatgcccatgccctgggagcaggtgcgtgaggtcaaggttctttatcacatcactggtgctattacctttgtgaatgaaataccatgggttgtagaaccaatttatttggcacagtggggtactatgtggatcatgatgcgaagagaaaaaagagaccggaggcatttcaagagaatgcgtttccccccgtttgatgatgaagagcctccattagattatgctgacaatcttcttgatgttgaccctctggagccaatccagttggagttagatgaagaagaagatggtgccgtgcaccgttggttctatgaccataagcctcttgtaggtacaaagcttattaatggtcccagttaccgcaagtggcacctgtcacttccaataatggctacacttcaccgtcttgctgggcagttgctttctgatctgattgatcgcaattatttttacctttttgacatggagtccttcttcacggcaaaagcactcaacatgtgcataccaggtggtccgaagtttgaacctttgtaccgtgacatggagaaaggtgatgaggactggaatgagtttaatgacattaacaagctcatcatccgatcacctctgcggacggagtacaggatcgcttttcctcatctttataacaataggcccaggaaagttaggcttagtatttatcacactcctatggtaatgtacataaagactgaggatcctgatttgccagctttctactacgatcccctaattcaccccatcacaagtacaaacaaagataagagagataaaaagaatctggaagaagatgacgatgatgattttgtgttgccagaggaaattgagcctttactaaccaacacgccaatctacactgacacaactgcggctggtatctcactattgtttgcaccacgccccttcaatatgcgttctggtcggatgagacgtgcggaggatattcctctcgtgtcagagtggttcaaggaacactgtcctccttcgtaccctgtcaaagtccgtgtcagctaccagaagctgttgaaatgttttgtgttgaatgagctgcatcatcgaccacccaaggctcagaagaagaagcacctatttaggtccctcaaagctacaaagtttttccagaccactgaacttgattgggctgaggcggggctgcaagtttgtaaacagggatacaatatgctgaatctattgatccataggaaaaatttgaactaccttcatctcgactataacttcaatttaaagcccgtgaagacccttaccaccaaagaacgtaaaaaatctcggtttggtaatgctttccatctttgtcgtgaaatcttgcgtttgacaaagcttgttattgatgcaaatatccagttccggttgggaaatgtggacgcatttcagttagcagatggtttgcagtacatcttttctcatgttggtcaattgactggtatgtaccggtacaagtacaggcttatgcgacagattcgcatgtgcaaggatttgaagcatctgatatactatagatttaacactgggccggtcgggaaaggtcctggatgtggtttttgggcaccgatgtggagggtatggttgtttttccttcgtggtatagtgcctctattggaaaggtggctgggaaaccttcttgcaaggcaattcgaaggacgacattccaagggagtggctaaaactgtgacaaagcaacgtgtagaaagccacttcgacttggagcttcgtgctgcggttatgcatgatgtgcttgatgcgatgccagagggtattaagcaaacaaagcaaggactatcttgcagcatttaagcgaagcatggcgttgctggaaggcaaatatcccttggaaggtacctggtttgcctgtccccatcgagaacatgatacttcgttatgtgaagtcaaaagctgattggtggacaaatgttgctcactacaatcgggagcgtattagaagaggagcaacagttgacaagaccgtctgcaggaagaatcttggaagattaacccgtctttggttgaaggcagaacaggaacgccaacacaactacctaaaagatggtccttatgtgacacctgaagaagcagttgcaatttattcgactactgtgcactggttggaatctagaaaattctcgcccattccctttcctccattgtcttacaagcatgatacgaagcttctcatccttgcactggagagattgaaggaatcgtatagcgtggctgtcaggttgaaccagttgcaaagagaagaattaggattgattgaacaagcttacgataatccacatgaggctttgtcgcgtattaaacgtcatctactcacacaacgttcctttaaagaagtgggtattgagttcatggatctttacagctatctcattcctgtttatgagatagaaccacttgaaaagataaccgacgcatacctggatcaatatttgtggtatgagggtgataagcgccacctgttcccaaattggatcaagcctgctgattctgagccaccaccgctccttgtttacaaatggtgtcaaggtattaacaatttgcaaaacatatgggacacaggcgacggccagtgtgtagtgatgcttcagacgaagttcgagaagttctttgaaaagattgatctgacaatgctcaacaggcttcttcggttggttctcgatcataatattgctgattatgtcactgcaaagaataatgttgtcctgtcatacaaggatatgagccatacaaattcttatgggctgattcgcggtcttcagtttgcctcatttgtagtgcaatattatgggcttgtcctggaccttcttcttctcggtctgactcgggcaagcgaaattgctggtcctccacagatgccgaatgagttcattactttccatgatacaagagtagaaaccagacacccaattcgtttgtattctagatacattgataaggtgcatatattatttcggtttactcatgaagaggcacgggatcttattcagcggtatcttacagagcatccagatcctaacaatgaaaatatggttggttacaacaacaaaaaatgctggcctagagatgctaggatgcgtctgatgaaacacgatgttaacctcggcagaagtgttttttgggatatgaagaaccgtcttccacgaagcattaccaccctggagtgggagaatagctttgtttcagtttacagcaaagacaatcccaatttgctcttcagcatgtgtggatttgaagttcgaattctaccaaagataagaatgactcaagaggctttcagcaatatgagagatggagtttggaatctgcagaatgagcagaccaaagagcgcacgtcagttgcatttctgcgggtagatgatgaacatatgaaggtgtttgagaatcgtgtaagacaaattcttatgtcttcaggttcaacaacattcacaaagattgtgaacaaatggaacacggctcttatagggctaatgacatatttccgtgaagcaactgtccacacgcaagaactgttggatctgcttgtcaagtgtgaaaataagatacagactcgtattaagattggcttgaactctaagatgcctagccggttccctcctgtgatattctacacaccgaaggaaatcggaggacttggaatgctctcgatgggccacattctgattccccagagtgacctccggtatagtaaacagacagatgttggtgtgacacacttcaggagtggaatgagtcatgaagaggatcagttgattccaaatctgtatcggtacatacagccatgggagagtgagttcattgattcccagcgtgtttgggctgaatatgcattgaagaggcaggaagctcaagcacagaatagacgattaaccctggaagatttggaagattcatgggatagaggtatacctcgtatcaacacactgtttcagaaggaccgtcatacacttgcatatgacaaaggatggcgagtgagaacagatttcaagcaatatcaggttctgaaacagaatccgttctggtggacacaccagaggcacgacggaaagttatggaacttgaataattacagaactgatgttatccaagctttgggaggagtcgaaggaattcttgagcatacactgttcaaaggaacatacttccccacctgggagggtcttttctgggagaaagcttctggtttcgaggagtctatgaagtataagaaattgactaatgctcaaagatccggtctcaatcaaattcctaatcggagatttactctatggtggtcaccaacaatcaacagggcaaatgtttatgttggttttcaagttcagcttgatctaactggaatctttatgcatggaaagatacctaccttgaagatatctctaattcagattttccgggcccacttgtggcagaaaatacatgaaagtgtggttatggatctttgccaggttttggatcaggaattggatgctcttgaaattgagactgttcaaaaagaaacaatccacccccgaaagagttacaaaatgaacagctcatgtgctgacattctctttttgctgcccatagatggtctatgtcaaagcccagtcttgtggcggagacaaaggatgtctttgaccagaaggctagtaataagtactggatagatgtgcagctgcgatggggtgattacgattctcatgacatcgagcgatataccagggcaaaatttatggattacacaactgataacatgtctatctatccatcgcctactggggtcatgattggtattgacctagcatacaatttgcattctgccttcggaaattggttcccagggtcaaagccattgattcaacaggccatgaacaagatcatgaagtcaaatccagcactttatgttctgagagagcgaataaggaaagggctgcaactgtattcttcagaacctacggagccctatttatcatctcagaactatggagagatattcagcaatcagattatttggtttgtcgatgacacaaatgtatatcgtgtcactatacacaagacattcgagggaaatctcacaacgaagcctattaatggtgcaatcttcatattcaaccctcggacagggcagctgttcctaaaggtcattcacacaagtgtgtgggctgggcaaaagcgtcttggtcagctggccaagtggaaaactgcagaagaagtggctgcattggttcggtcattgcctgttgaagagcaaccgaaacaaattattgtgacgcgaaaaggaatgttggatcctcttgaggtccatttgctagattttccaaatattgtgatcaaagggagtgagttgcagttgccattccaggcttgcctaaagattgagaagttcggtgacctgatactgaaggcaacggagccacagatggttctgttcaatatctatgatgattggttgaagagtatctcgtcctacacagctttctccagattgatattgattttgcgtgctctgcatgttaataatgagaaagcaaagatgttgctgaagcccgacaagacaattgttactgagcctcaccatatctggccttctctatctgatgagcagtggatgaaggttgaagttgctctgagagacctgatcctgtcggattatgccaagaagaacaatgttaatacatctgcacttacccagtctgagatccgcgatatcattcttggggcggagatcacaccaccttcacagcaacgccaacagattgctgatattgagaaacaggcaaaggaagccagtcagattacagcagtaaccacaaggactacaaatgtgcatggtgatgaattgattgttagcactactagtccgtatggccaagcttcatatgacagcagaaccgactggcgtgttcgagcaatatccgccactaacctacacctccgggttaatcacatatatgtcaactcagaagacattaaggaaaccggctacacatacatcatgccaaagaatatcttaaagaagtttatatgcgtagctgatcttcgtactcaggttgctggttacctatatggcataagtcctcctgacaatccccaggtgaaggagatccgctgtattgcaatgccaccacaatggggaacaccccaacatgttcatctcccatcaggaattcctaatcataatttcttgaatgacctggagcctcttggatggttgcacacgcaaccaaatgagcttccccagctttcacctcaggatctagctgttcatgccaaggtattatcgaacaacccacagtgggatggcgagaagtgcattattctgacatgcagtttcactccgggttcctgctcgttgactgcgtataaattgactccctcagggtatgagtggggaaaaagcaataccgatgtagcagccaatccccatggctacctgccaacttactatgagaaagtccagatgcttctcagtgaccgtttcctaggtttctacatgatacctgataacggtccttggaactacaatttcatgggtgtgaagcataccgtaagcatgggctatggcttgaaactgggaacaccacgtgagttctttcacgaggagcatcggccgacacatttccttgagttcagcaaactcgaggagggtgaatttgccgagggtgatagagaagacatgttcaactagttgcgtaaaactgattgctgcgtactgatgtaaatattcatccgtgtgtgttttgtattaatttgaatgtgtgaattgtgatactaggaactaggaagaggcatttacctactcctgcatgcaatatgcctcggaggcttcttcactgctgtttttgtacctacagttcttcgttaattttt

SEQ ID NO: 994 - DNA, 7421 bp, Silene vulgaris
agcgccgccaggtacttccattcctccaccgccggcagttcaaccgtcgtacaccgtcttacaaccgccgcagttgccgcaacagccggaatctcccgccgatgcggaggccagactcgaggagaaggcgcgtaaatggatgcagctcaattccaagcgatacggcgataagcgtaagttcggctttgttgagacgcagaaagaggatatgcctcctgagcacgtccgcaaaatcattcgagaccatggagacatgtcatccaagaaataccgccacgataaacgggtgtatttgggagctcttaaatttgtaccccatgcggtttacaagctccttgagaatatgcctatgccttgggaacaggttcgtgatgtcaaggtgctttatcacattactggagcaatcacattcgtaaatgagataccatgggttgtcgaacccatatatctggcccagtggggtacaatgtggataatgatgaggagggagaagagagaccgtcgccattttaaaagaatgaggttccctccttttgatgatgaggagcctccattggattatgctgataatgttcttgatgtggaccccttggagccaatccagctggaattggatgaagaagaagattctgctgtgcatgcatggttttacgatcataagcctctcgttaagacaaagcttatcaatgggccaagttatcggaagtggcatctttctctaccaatcatggcaacactatatcggtttgctggccagttgctctccgatctggtggataggaattacttctatttattcgacatggaatcgtttttcactgcaaaagcgttgaatatgtgcatacctggaggtccaaagtttgagcctctttatcgtgatatggagaagggagatgaggactggaatgagttcaacgatatcaataaactcatcatcagatcacctcttcggacagagtacagaattgcttttcctcatctttacaacaataggccaaggaaagtaaggcttggcccttaccacacaccaatgattatgtatataaaaacagaggatcctgatcttccggcattttattatgaccccttaattcatccaataactgctgctcccaaggatcgtcgtgaaaagaaagtttatgaggaggatgaggatgattttgagcttccagaaggtgtagaaccactgctcacagatactcagttatacaccgacactactgctgctggtatttcacttttgtatgcaccaaggccgtttaatatgagatctggtcgtacaaggcgtgctgaagatataccacttgtgtcagagtggttcaaggagcactgccctccatcatatcctgttaaagtgcgagtcagttatcagaaattactcaagtgttttgttctgaatgagttgcatcaccgacctcctaaagctcagaagaaaaaacatcttttcagatcacttgcagctaccaagttttttcagagtactgagcttgactgggttgaagctggtcttcaggtgtgcaggcaagggtacaacatgctgaacctgttgattcatagaaaaaatttgaactatctgcatcttgattacaatttcaatttgaaacctgtcaagacactgactaccaaggagcgtaagaagtctcgttttggaaatgcatttcatctttgccgtgagattctgcgtctgacaaagcttgtagtggatgccaatgtccagtttcgtttgggcaatgttgatgcctttcaattggctgatggcctgcagtatatattttcgcacgtcggccagctaactggaatgtatcgttacaagtataggctcatgcgacagatccggatgtgtaaggacttgaagcacttgatttattaccgtttcaatacaggtccggttgggaagggacctggatgtggtttctgggcaccaatgtggagggtttggcttttcttccttcgtggtattgtgcctttgctggaaaggtggttgggaaatctgcttgcaaggcagtttgagggtcgtcactccaaaggcgtggcaaagactgttactaagcagcgtgttgaaagtcattttgacttggagcttcgtgctgctgttatgcatgatgttctcgatgcaatgcctgagggtattaagcaaaataaagcgagagtcatcttgcagcatttaagtgaagcttggcgttgttggaaagccaacatcccttggaaggttccaggtctgcctgttccaatcgaaaatatgatccttcgatatgtcaagtcaaaggcagattggtggacaaatgtagcccattacaaccgtgaacgtatcaggaggggagctacagttgataaaactgtttgtcgtaaaaatcttgggaggttgactcgcctatggcttaaggcggagcaagaacgccagcacaattatcttaaggatgggccatatgtcacaccagaagaagctgtagctatttacacaactactgtgcattggctggagtcgagaaagttttctcctataccttttcctcctttgtcttacaagcatgacaccaaactgctgattcttgctctggagaggctgaaggaatcatatagtgttgctgttagattgaatcagcagcaaagagaagagctgggtcttattgagcaagcttatgataacccacacgaggctttatcaagaatcaagcgtcatctgctcactcagcgtgcctttaaagaagttggcattgagttcatggatttgtatagttacctcattcctgtttatgagatcgagccccttgagaagatcacagatgcttatctagatcagtatttgtggtatgaaggggacaagaggcacctattcccaaattgggttaagcccgcagataccgagccacctcctcttttggtttataaatggtgtcaaggtatcaataacttgcagagcatatgggacacaagcgagggacagtgtgtggttatgctgcagacgaaatttgagaagttctttgagaagattgatttgacaatgcttaatcgactcttgcgtttaattcttgaccacaatattgctgactacgtcactgcaaagaataacgtggttttgtcatacaaggatatgagtcatacgaactcttatgggcttatacgcgggcttcaatttgcctcatttgtggtacagtattatggtcttgtattggatcttcttctcttgggtttaacacgtgcaagtgaaattgctggtccacctcaaatgccaaatgagtttatgacttattgggatacaaaggtggaaaccaggcatcccatccggctgtattctcgttatattgacaaggtgcacataatgttccgcttcactcacgaggaagcacgggatcttatccagcggtatcttactgagcaccctgaccctaataatgagaatatggttggatacaacaacaagaaatgctggccaagagatgctagaatgaggctcatgaaacatgatgtgaatctggggagaagtgttttctgggacatgaaaaatcgcctcccacgaagtattactaccttagagtgggagaatggttttgtgtctgtatacagtaaggataatcctaacctgctttttagtatgtgtgggtttgaagtaaggatattgcccaagattagaatgacacaagaggcttttagcaacacaaaagacggtgtttggaacttacaaaatgagcaaacgaaggagcgtactgctgttgccttcttgagggttgatgacgaacacctgaaagtgtttgaaaatcgtgttagacagattcttatgtcttcaggatctactacatttacaaagatcgtaaacaaatggaacactgccctgattggcctgatgacatacttccgtgaggcaactgtacatactcaggagctgttagatctactggtgaagtgtgaaaacaagatccagactcgtataaagattgggttaaactcaaaaatgcctagcaggtttcctcctgtcatattctacacaccaaaggaaattggtgggcttggaatgctctctatgggtcacatcttaattccacaaagtgaccttcgatatagtaagcagactgatgttggtgtgacccactttaggagtggaatgagccatgaagaggatcagctgattccaaatctttatcgttacatacagccttgggaaagtgagttcattgattctcaaagagtctgggctgagtatgcgttgaagaggcaggaagctcagtcacagaataggcgtcttactttggaagatctggaagattcttgggaccgtgggatacctagaatcaatactttgtttcagaaggaccgtcatactttggcctatgacaaagggtggagagtacgtacagatttcaaacaatatcaagtgttgaagcagaatcctttctggtggactcatcagcgccatgatggaaaactatggaacctgaataattacagaactgatgtcattcaggcattaggaggtgtggaaggaattttggagcatactctatttaagggtacgtatttccccacgtgggagggtctcttctgggaaaaggcttctggttttgaggaatcaatgaagtacaaaaagttgactaatgcacaaagatccggtctaaatcaaattcccaaccgtaggtttactctatggtggtctcctacaataaatcgtgccaatgtttatgtgggtttccaggtgcagcttgatttaactggaatattcatgcatggaaagattcctactcttaagatttctttaattcagattttccgtgcacatttatggcaaaagatccatgaaagcgttgtcatggatctttgtcaagttcttgatcaggagttggatgcgctggagattgaaacagttcaaaaggaaaccatccatcctcgaaagagttacaaaatgaatagctcgtgtgcggacatccttctttttgctgcacataggtggcctatgtcaaaacccagtttggtggcagagacgaaggatgtctttgaccagaaggcaagcaacaaatattgggtagatgtgcagcttcgttggggggactatgattcccatgatattgagcgttacaccagagccaagtttttggattacaccacagataacatgtctatctatccatctcctactggagtcatgatagggcttgatctggcttacaatctgcattctgcttttggtaactggtttcctggttcaaaacctctgcttgcacaagctatgaacaagattatgaagtcaaatcctgcgttgtatgttttgagagagcgtataaggaaaggtttgcagctgtactcttctgaacccactgagccatatttgtcatcccaaaactatggtgagatattcagcaatcaaatcatatggtttgttgatgatactaatgtctaccgtgtcacaattcataagacatttgaagggaatctaaccacaaagccgatcaatggtgcaatttttatatttaatccacggactggacaactgtttttgaaggttattcacacaagtgtgtgggctgggcagaagcgtcttggtcagctggccaagtggaaaacagctgaagaagttgctgcacttgttcgttctttaccggttgaagaacaaccaaagcaaattattgtgacacgtaaaggaatgttggatcctttggaagttcacttactcgatttccccaacattgttatcaaaggaagtgaactgcaacttcctttccaggcttgcttaaagattgagaaatttggtgacctcattttgaaggctactgagccacaaatggttttgtttaacatatatgatgactggttgaagagtatatcttcctacactgcattctctcgactcatcctcattcttcgttcacttcatgtcaacaatgaaaaggctaagatgttgctgaaacctgacagaactgtcgtcactgaaccacatcacatatggccttctctcacagatgatcaatggatgaaggtcgaggttgccttgagagacctgatcctttcagactatgccaaaaagaacaatgtgaatacatctgccttgacgcaatctgagattcgagatattatccttggagctgagatcactcctccatctcagcagagacagcaaattgctgagattgagaaacaggcaaaggcaaccagtcaattgactgctgtcacaacaaaaactacaaatgtgcatggtgaagaacttattgtcagcaccacgagtccctatgagcaagaaaagtttagctcaaagactgattggcgtgtccgagctatatctgctacaaatctctacttgagagtaaatcacatctatgttaactcggaggacataaaggaaactggatacacttacatcatgcccaagaacattttgaagaagttcatatgtatagcagatttgcggacacagatcgcaggatacttgtatggcgtaagcccgcctgacaacccgcaagtcaaagagatcagatgcattgcgatgccaccacaattaggaactcaccagcaggtgaatctgcctttgcagctcccagaacacgatttcctgaatgatttggagcctctagggtggatgcatacacagccaaatgaacttcctcagttatcaccacaggatgtgacaagtcatgctcgaatcttggagaacaacaaacagtgggatggagagaaatgcataatactaacatgcagtttcaccccgggttcatgttccttgaccgcctacaagcttactccagcaggttatgaatgggctcgtgcacaaaaggataccggaaccagccttcacggttaccttcctactcattcggagaaggtgcagatgctcctcagtgaccggtttcttgggttctacatggttcctgatagcagtccgtggaactacaacttcatgggagctaagcacgcacccaacctgaaatacggtgtcaaacttgggacgcccaaagagtactaccatgaggagcaccgaccaacacattacctcgaattcatcaaaatggaggagggagatagcgtggaggtagagagagaggataagttttcttaagtttttggctccattgagtggggaagaaagactatctcggaagtacttgtaggcttgaagtagtatgtaacctaattttgaatcagctgtatttcttttgtacttgtccttggaacgttgttgatttgtggtcgttttaaggccgctactcttcttttgagcttgtacatgagtcaccagagttcacgtttacgctactccgtttttacttccatttcccactcgacttttgttgtcttgtgtagtttgagctgcaagttatatattgtctaacagaagatgtaattttgttgttgctcggtcgacccttcatggaagaatagagctttcttaaaagagatgcttttatgaattgaattgcatagagcattcttgtagatcc

SEQ ID NO: 995 - DNA, 7161 bp, Arabidopsis lyrata
atgtggaccaatgatggtacgcctttagctcctcctggcacctacagttcgaggatgcagacaccaacacagcccgctgatcacccttcttacacgtcgccttctaatcggaatcctccgacggaacctacttctgaggatgcagaggcgaagcttgagaagaaggccagaacatggatgcagctaaattccaaacgggatcatggtgatatgtcatctaagaaacatggacttgacaaacgtgtatatcttggagcacttaagttcgttcctcacgcagttttcaagctcctggagaatatgcctatgccctgggaacaggtactcatttactttaagtgatctctatctcgctttagttgttctccttctctgctcaaaattttgaactcagatgtcttccaggtccggtacgtgaacgtggtaccatgggttgtggaacctatttacatggctcagtggggttctatgtggataatgatgagaagagagaagagggatcgtcgtcatttcaagagaatgcggtttccaccatttgatgatgaggagccccctctagactatgctgataacctgctggacgtggatcctcttgagccaattcagttggagctagacgaggaagatgattctgctctatactcttggttttacgaccacaagccacttgtaaaaacaaaactgatcaatagtccaagttaccagacgtggaatctctcacttccaattatgtcaacccttcacaggcttgcagcccagttgttgtctgatttggttgatcgcaactacttctacttgtttgacatgccatcattcttcacagcaaaggcactgaacatgtgcataccaggcggtcctaagtttgagcctttgtatcgtgatatggagaaaggagatgaggactggaatgaatttaatgacatcaacaagcttatcattcgatcccctctgcgaactgagtaccgagtagctttcccccatctgtacaataataggcccaggaaagtaaaactctgtgtctatcacactcctatgattatgtacataaagacagaggatcctgatcttcctgcgttttattatgatccattaattcacccaataagtaactcgagtaacactaataaggaacatcgcaaaagtaatggttatgatgatgatgaggatgactttgtgttaccagaaggagtgcaacctttgctgaataactccccactctacactgaaactacagctgctggcatttcattgttgtttgcccctcggcctttcaatatgaggtctgggaggactcggcgggcagaagatataccccttgttgcagaatggtttaaggagcactgtcctccagcatatcctgtcaaagttcgggttagttaccagaagcttttgaagtgttatgtactcaatgagctgcaccatagaccacctaagtctcagaagaagaagcacttgttccgatctcttgcagctacaaagtttttccagagcaccgaactggattgggttgaagtgggtctgcaagtctgccggcagggatataatatgctgaacctgttgattcacaggaagaatttgaactacctgcaccttgattataacttcaacctgaagcctgtgaaaactctgacaaccaaggaacgaaagaagtcacgttttggaaacgctttccatctctgccgtgagatcctccgggtgacaaagcttgtagttgatgcaaatgtccagttccgacttggtaatgttgatgcctttcaattggctgatggcctgcaatatattttttcccatgttgggcaattgacaggtatgtatcgttataagtacaggcttatgagacaaatcaggatgtgcaaggatttgaaacacttgatctattaccgtttcaatactggtcctgtgggtaaaggaccagggtgtggattttgggctccaatgtggagggtatggttgtttttccttcgcggaatagttcctcttctagaacgatggttagggaacctgcttgcacgtcaatttgaggggcgtcactcaaagggagtggccaaaacagtcacaaaacagagagctgaaagccattttgatttggagcttcgagcttctgtcatgcatgatgtcgttgatgcaatgccagagggtatcaatcaaaataaagcgcggacgatattgcagcaccttagtgaggcatggcggtgttggaaagctaatataccatggaaggtccctggattacctgtggcaattgagaatatgatcctccgatatgtcaagtctaaagctgattggtggacaaatgttgctcactacaatcgtgagcgtatcagaagaggggctactgttgataagacagtttgtagaaagaatcttggacggttgacccgtctttggctcaaggcagaacaggaacgacaacataattttcagaaagatggtccatatgtcactgcggatgaaggaatagcaatttatagcaccactgtaaattggctggaatctagaaaattttcaccaatcccattccctccattatcatataaacatgacacaaagttgcttatcttggcccttgagagacttaaagaatcatatagtgcagctgtgagattgaatcagcagcagagagaagagcttggtttaattgaacaagcttatgacaatcctcacgaagctttgatgcgaataaagcgtcatcttctcactcagcatagcttcaaagaagttggcatagagtttatggatctatatagccatttgattcccgtctatcaaattgatcccctggagaaaattactgatgcttatcttgatcaatatttgtggtatgagggtgacaagcgccacttgtttcccaactcgattaagcctgcagactcagagccgccaccgcttctggtttacaaatggtgtcaaggtatcaataatttgcaaggcatatgggacacaagtgatagtcagtgtgtggtgatgctccagacgaagtttgaaaaactctttgagaagattgattttacagtgttgaacagccttcttcgtttggttcttgatcataagcttgcaaactatgtgactggcaagaataatgtggttctgtcttataaggatatgagctatactaatacatatggactcattaggggactgcagtttgcatcgtttgttgttcagttttatggactagtgctagatcttttgctccttggtttgactcgagcgagtgaaattgccgggccaccgcagaggcctaatgagtttatgacctattgggatacaaaagttgagactcgccatcccataagactgtattctcggtatatagacaaagtgcatataatgttcaaatttacccatgaagaggctcgggatcttattcaacgtcatctcaccgagcgtcctgatcctaataatgaaaacatggtgggatataacaataaaaagtgctggccaagagatgcatggatgaggttaatgaaacatgatgtcaatcttggtagaagtgtcttctgggatatgaaaaatcgtcttcctcgaagcatcacaaccttggagtgggagaatggcttcgtctccgtgtacagcaaggataatccaaacttgcttttcagcatgtgtggatttgaagtccgcatgcttccaaaaattaggatgggccaagaagctttcagcagcacaagggatggtgtctggaatctgcagaatgaacaaactaaagagaggactgcagttgcttttctgcgggttgatgatgaacacatgaaggtgtttgagaatcgtgtgaggcagattcttatgtcgtcagggtcaacaacatttaccaaaatcgtcaataaatggaatacagctctgataggcctcatgacttacttccgtgaagccactgtgcatacgcaagagctcttggatctgcttgttaaatgtgaaaataaaatccaaacgagggttaagattggactgaactcaaagatgcctagtcgatttcctcctgttatcttctacactccaaaggaaattggcgggcttggaatgttgtcgatgggtcatattttgatcccacaaagtgaccttcggtacagcaagcaaacagatgttggtgtaagccatttcaggagtggaatgagccacgaggaagatcaactgattcctaatctttaccgttacatacaaccatgggaaagcgaatttattgattcacagctggtgtgggcagaatatgctttaaagaggcaggaagcacagacccataatagacgtctgacgttggaggatctggaagactcttgggataggggaattccgcgtataaatacgctgttccagaaggataggcacactttagcatatgataaaggttggagggtccggaccgacttcaaacagtaccaatccctgaaacaaaatcctttctggtggacacaccagaggcatgatggtaaattgtggaacttgaataattaccgaactgatgtcatccaagctcttggaggtgttgagggtattcttgaacacaccttatttaaaggaacatactttccaacgtgggagggtcttttttgggagaaggcatctggttttgaggagtctatgaaatataagaagctgacaaatgcgcagaggtctggtctgaaccagattccgaatagaagattcacgctttggtggtcaccaacaattaatcgagcgaatgtatatgtgggttttcaagtgcagttggatttgacaggaatatttatgcacggaaagattcctactcttaaaatatctttgattcagattttccgtgcccatttgtggcaaaagatccatgagagtgttgttatggacctttgccaagtactggatcaagagttggatccgttggagatagaaactgtgcagaaagagacaattcatccacggaagagttacaaaatgaatagctcttgtgctgatgttcttctttttgctgcctataaatggccaatgtctaagcctagtctagtggctgagtcaaaggatatgtttgatcagaaagcaagtaacaagtattggataaatgtgcaacttcgatggggagattacgactcccatgatattgaacgctatactagggccaaattcatggattacacaacggacaacatgtctatctatccatctccaacgggtgtaattattgggcttgatttggcctataacttgcattctgcctttggtaattggttccctggttcaaaaactctgcttgctcaagctatgaacaagatcatgaagtccaatcccgctctatacgtgttgagagagaggataaggaaaggtttgcagctgtactcatctgagcctacagagccatatttgtcatctcaaaactatggtgaaatattcagcaatcaaatcatatggttcgttgatgataccaatgtataccgtgtcacaatccacaagacatttgaaggaaatctaacaacaaagccaatcaatggtgtaatttttattttcaacccaagaacagggcaactattcctaaaggtcattcatacaagtgtttgggctgggcagaagcgccttggtcagctagcgaaatggaaaactgctgaagaggttgcggcacttgtgcggtctctccctgttgaagaacaaccaaaacaagttattgtgactcgtaaaggaatgttggatccccttgaggttcatctgttggatttcccaaacattgttataaagggaagtgaactccagcttccgttccaggcttgtcttaagatagaaaaatttggtgatctgattttgaaggccacagagccacagatggtcctcttcaatatctatgatgattggttgatgactgtttcttcgtacactgcctttcaaagactcattctgatccttcgcgctcttcacgtaaacaatgagaaggcaaagatgttattgaagcctgacatgtctgttgtcactgagccaaatcacatctggccctctctcactgacgaccaatggatgaaggtggaggttgctcttagagatctcatcctttctgactacgcgaagaaaaacaacgtgaatacgtcagctctgacacagtcagagatcagagatataatacttggagcggagattactcctccgtctcagcagaggcaacagatagctgagattgagaaacagtcaaagcaagcgagccagcttactgcagtcacaacaagaaccacaaatgttcatggtgatgaattgattagcaccaccattagtccgtacgagcaatctgcatttggatccaaaacagactggcgtgtgcgcgcaatttcagctactaacctctacctcagggtcaaccacatctacgtgaactcggacgacataaaggaaactggatacacctacgttatgcccaagaacatattgaagaagttcatatgcatagcggatcttcgaactcaaattgctggatatttatatgggataagtccgccggataatcctcaagtgaaggaaatccgttgtgttgtgatggtgccgcaatggggaaatcaccagcaagttcaactgccgtcgtcttttccggaacatcagttcttggatgatttagagcccctgggatggatgcacacacagcctaacgagcttcctcagttgtcaccacaggatgtgacttttcactcccgtgttctggagaataacaagcaatgggacggagaaaaatgcatcatcctgacatgtagtttcactccgggctcatgctctttgatgtcatataagctgacgcaagccgggtatgaatggggacggctgaacaaagacgcaggcagcaatccccacggttaccttcccacccactatgagaaggttcagatgctcttgagtgaccgtttcttcgggttctacatggttcctgataacggaccctggaactacaacttcatgggagttaatcacacggtgggcatgaactatagcttgaaacttggaacccccaaggagtactatcaccaagaccatcgacccactcatttcctcgagttcagcaatatggaggaggatggtgaccttgatcgtgaggacacttttgcttaagacgttttttggatgtatgatgtaaattaagtttgcaaattgttaatgatgagattgaaaagatttttctctattttaaaaaataataacttcacaagcaaattcacttacatgatt

SEQ ID NO: 996 - DNA, 3374 bp, Citrus sinensis
  misc_feature (1893)..(1893): n is a, c, g, or t
  misc_feature (2392)..(2392): n is a, c, g, or t
  misc_feature (2840)..(2841): n is a, c, g, or t
  misc_feature (2874)..(2874): n is a, c, g, or t
  misc_feature (3216)..(3216): n is a, c, g, or t
cacgcgtccgccttctcctactggggtgatgattgggcttgacctggcctataatttgcattctgcatttggtaactggttcccgggatcaaaaccgttgcttgctcaggcaatgaataagataatgaagtcgaatccagctttgtatgttctgagggagcgtataaggaaaggtctgcagttgtattcttcggagcccactgaacatatctatcttctcaaaactatggagagattttcagcaatcaaataatatggtttgttgatgataccaatgtgtatcgtgtcacaatccacaagacatttgaaggaaatctaacgactaagcccattaatggtgctatctttatattcaacccaaggactggccagctgttccttaaggtgatccacacaagtgtatgggcaggtcaaaagcgtcttggtcagctagccaaatggaaaacagcggaagaagttgctgctcttgtgcggtctctgcctgttgaagaacaacccaagcaaatcattgtgacccgtaaaggaatgcttgatccattggaggttcacttgctggatttcccgaacatagttattaaaggaagtgagttgcagctccctttccaggcctgcttgaagatcgagaaatttggagatttaattctgaaagctacagagcctcaaatggttttgttcaatatatatgatgactggttgaagagtatctcatcgtatactgcattctcccgacttattttgatccttcgtgcacttcatgtgaataatgagaaggcaaagatgttgctaaagccagacaaaacaatcatcacagagccacatcacatatggccttctctttctgatgatcaatggatgaaggttgaagttgccctaagagatctcatactttcagattatgccaagaagaacaatgtcaatacatctgctttgacacagtctgagatccgtgatattatacttggagctgagattacacctccttcccaacagaggcaacagatagctgagattgagaaacaggccaaagaagcaagtcaattgacagctgtaactacaaagactacaaatgtccatggtgatgaactcattgttacaaccactagtccttatgagcaagctgcatttggttccaaaacagattggcgtgtgagagcaatatcagctaccaatctctatcttcgagttaatcatatatatgtcaactcagaggacataaaggagactggctacacttacattatgccaaagaatattttaaagaaattcatctgcatagcagatcttcgaactcaaatttctgggtacttatatggtataagcccgccagataacccgcaggtcaaggaaattcgttgtattgccatgccaccacaatggggcactcatcagcaagttcatcttccttcggcactccctgagcatgatttcctgaatgatctggagcctttgggatggatgcacactcaaccaaatgagcttccacagctatcgcctcaggatctcacttctcatgcgcggattctagaaaacaataaacaatgggatggagagaaatgcattatcttgacttgtagtttcaccccaggttcctgctcgttaactgcatacaagcttactccaagtggttatgagtggggaagagttaacaaggacacaggaagcaatccccatggatatcttccaactcactatgagaaggtccaaatgcttctgagtgaccggttccttggtttctacatggttcccgacaacggtccatggaactataacttcatgggagtgaagcatacagtgagcatgaaatatggtgtcaagcttgggactcctcgagaatactaccatgaggaccataggccaactcatttcttggagttcagcaacttggaggagggngaaatggcagagggagatcgtgaggatacattctcataagcctattgatgctattttgaggtcgtaatctttcttgtgaattaaattgtagcatttgcttggaaactgctagactggagtagatttactttaccaacatggggatgaagcagtgccccatttttggtcgttataaaaacgtgttttacttctgggacagttgtaattctctgtagaatgatagtttgaggtgtaaatatatacggtaacgaggtttcataaattttctgttgatgctggatctaaaagtcctctatgtggtattaaggagtggccttgcagattaatttgtactattttatatgcgactctgtcgcagcttctaattctattgaaagttgctcaacagataaaagagagcgccttcacgccattctaaaatcatgtgacttgaaaattgaaataagtagaaacatttagtgaaatgtattctgtggaatatatggatgtaacacacttngctttcggctacattttccacggcccatcggcaacacccaatgagtttcacccgacggttccagcttcacttcttaaggtctagcagccaaaaggttcagcaaaaacaacagagttctgaagatgcatttacattaaattcattaaagaaaggggtacccacaaaccaaactcacagcactcttaaaaaacatgctttctgcattttctaataagatgcacatctggcgccaccctgtgcttagtagcaaaaaaccaaaatatgcagaagattcaaactctatatctaacagtccggaagttgcagagtagctcaactattgagctttctcaggttcaatctcctccttcacctgtttaagagaaatggagtttgtgctgtcctctgcgactgcttttccgtcgttatagtctgcaacctgatggctcttgaacagttcatcattttnnagttcagccaacttctccgtgctgtcctctgcnactgcttttccgtcgttatagtctgcaacctgatggctcttgaacagttcatcattttcgagttcagccagcttctcctttgattctcccttcagtaggtccaacacctcaagcatcgtgggtcttttctcaggcttactgtgagcacatgtgagcgcaacaaggatgactcttttcaattcttcttccacaaagtttccatttagccttggatctgccaattcgctgaacttcctttcacaagccagtggcaaagcccagtctgtaattgttcgtttaattgcagaattcactttttcaataggtttcttgccactggccagctctaacaagagaatgccnaagctgtatacatcacaactctctgatgctttccctaacattgcatattcaggggcaaggtagcctagggtacccttaactctagtagtcacatgtgtagcaccatcagggattagcttagcaaatccaaaatcggcaacgtgagccttaaaatcagc

SEQ ID NO: 997 - DNA, 1672 bp, Fagopyrum esculentum
acacgtaaaggaatgctagatccattggaagtccacttgttggatttccctaatattgttatcaagggaagtgaattacaactccctttccaggcttgcttgaagatcgagaagtttggtgatctcattttgaaggctacagagcctcaaatggtcttgttcaatatatatgatgactggctaagagcatttcatcttacacagccttttctcggctcattttgattctacgtgcacttcatgtaaacaatgaaaaggcaaaaatgttgctcaagcctgacagaactgttgtaacagaaccccaccacatttggccttctttgactgacgatcaatggatgaaggttgaggttgcactgagagatctcatactttcggactatgccaagaagaacaatgtcaatacctctgcgctcacacaatccgagattcgagatattattcttggagctgagattgccccaccatctcagcaaagacaacaaattgctgagattgagaagcaggctaaggagctagtcagctgacagctgtcactacaaaaacaaccaatgtccatggtgatgaattgattgtgaccacaactagtccatacgagcaacaagcatttggatccaagactgattggcgtgttagagcaatctcggccacaaatctgtatcttcgtgtgaatcatatatatgtgaattcagatgacattaaggagactggctacacttacatcatgcccaagaacatactgaagaagttcatctgcgtagcagatctgagaactcaaattgcaggttatctgtatggtataagcccacccgacaatccacaagttaaagaaatccgttgtatcgctatggtaccacaatggggcacgcatcaactggtgcatcttccttcggctctccctgatcatgagtttttgagtgacttggagcctttgggatggatgcacactcagcccaacgaacttccacagctatcaccacaggatgtgacctcacatgcccggatcctggagaacaacaagcaatgggatggtgagaaatgcatcatcctaacctgcagtttcacaccgggttcctgctcgttaactgcatacaagctgaccccaacgggatacgaatgggggcgagccaacaaagatacaggaagtaatcctcatggctatcttcctacacattacgagaaggtccaaatgcttctcagtgatcgtttcctgggtttctacatggtcccggataccggtccatggaactacaacttcatgggagtgaagcatacattgagcatgaaatacggcgtgaagttgggtgcgccacgagaatactaccacgaagatcaccggcctacgcacttcttggagtttagcaactcggaaatgggcgatgttgaaggagatcgcgaggacacattctcatgagggtattataaaatgtagttgttagaagaaggttgaagccttgtgtatttggttgtagctttttcaagtgaagattttgtgtatgaatagaaatatacctatttttgatgtgtgaatgtacctttcctgaggttagatattcaaggtattcgcatattcttggatattaaaataattatacctgcacgttgtttgtgttttctaaataactagcagctataataaggaaaattataataggcatttttactaaggttt

SEQ ID NO: 998 - DNA, 2405 bp, Helianthus annuus
aataagtactggattgatgaccagttgcgttggggtgattatgattctcatgatatcgagcgttataccagagccaagtttatggactacaccactgataacatgtccatctatccatcaccaacaggggtgatgatcggacttgatcttgcttacaacttgcattctgcttttggtaactggttccctgggtcaaagccgctacttgcccaggccatgaacaagattatgaagtcaaatccggctttatatgtgctgagggagcgaataaggaaagggttgcagttgtattcttcagagccaacagaaccgtatctttcatctcaaactatggagaaattttcagcaatcagattatctggtttgttgatgatacgaacgtctaccgtgtcaccattcataaaacttttgagggaaatcttaccacaaagccgattaacggtgctatattcatattcaatccccgcacaggacagctatttctgaaggtcattcacacaagtgtgtgggcgggtcaaaagcgtcttggtcaacttgccaagtggaaaacagcagaagaagtggctgctctggttcgttccttacccgttgaagaacaacccaaacaaatcattgtgacacgtaaaggaatgcttgacccgctagaagtccacttactcgattttcccaacattgtcattaagggaagtgagctacaactccccttccaagcctgtttgaaaatcgagaagtttggtgacttgattctgaaagcgtctgaaccgcaaatggtgctgttcaacatttacgacgattggctgaaaagcatatcgtcgtacaccgcgttctccaggctcattttgattctccgtgctttacatgtcaacaacgagaaagcgaaaatgttgcttaagcccgataagacgatcgtcaccgaaccccatcatatctggccctcacttaccgatgatcaatgggtgaaggtggaagttgcattaagagatctcatattgtcggactatgcgaagaagaataacgttaacacttctgcactcacgcaatctgaaatacgagatattattcttggtgccgaaattactccaccttcacagcagcggcaacaaatcgctgaaatcgaaaaacaggcgaaagaagctagccagttgacagctgtcacaaccaaaacaacaaacgttcatggagacgagcttattgtcaccaccacaagtccttacgaacaagccgcatttggttccaagactgattggcgtgtgcgagcaatatcagcaacaaatctctatcttcgtgtaaatcatatttatgtcaactctgaggacataaaggagacgggatacacatacatcatgccgaagaacgtcttgaagaaattcatatgcattgcagacttgcgaacccaaatttgcgggtacttgtacggtatgagcccacctgacaatcctcaagtgaaagaaatccgctgcattgccatgccaccgcagtggggtacacatcagcaagtccatctcccgtcggctctccccgaacacgacttccttaacgatctcgaacccttgggatggatgcacacgcaaccaaacgagcttcctcaactatctccacaggatcttacgtttcatgctcggattttggagaataacaagcaatgggacggggagaaatctatcattttaacttgtagtttcactccgggttcgtgctcgttgaccgcgtacaagcttacaccaactggttacgagtggggtcgtgcgaataaggattctggaagcaacccccacgggtatcttccaactcattacgagaaggttcagatgcttctaagtgaccgattcctcggtttctacatggttcctgataacggtccatggaattacaatttcatgggagtgaagcatacggttagtatgaaatacggagtgaagctcgggactccacgggagtattatcatgaagaccacagaccgacgcatttcttggaatttagcaatctggaagaggctgacgtggcagaaggtgatcgcgaggatacattttcttaaatggaagattatgtgcctcgaaaacaagatacttataagctggagctgttatgttaagcttattataatgccggtgtagatacgtattttgtttatcgaattgcgatagggcatgtaatccgctcttttccttctgcacaatagtcgtgtaaacgtgcaacgtttttgtatggaattcagttcatgtatcccaagctggtgagacatttatattaacatgttgatgtatttatcttctctttgaacatttagaaatgggtgagaatttatttacttgagatagtttatcttagttcctcttcaaacaaccaaacatgttatcattaattcataattcttaataaggtcgtgatagaaatttagatttta

SEQ ID NO: 999 - DNA, 1817 bp, Tropaeolum majus
taccacaagacatttgaaggaaatctcaacccaccaaacccattaatggcgccatcttatttttaacccgaggactggacagctattcttgaaggtcatccacacaagtgtatgggccggtcagaagcgtcttggtcagctggctaagtggaagactgctgaagaggttgctgctcttgtccggtctttgcctgttgaagaacaaccaaaacagattattgtgactcgtaagggaatgcttgacccactggaggttcacttgcttgatttccctaatattgttattaagggaagtgagctgcagctaccgttccaggcatgtttgaagattgagaaatttggtgatctgattttgaaagccacagagccgcaaatggttctgttcaacatttatgatgactggttgaagagcatatcgtcatacactgcgttttctagactcatattgattcttcgcgcccttcatgtgaacaacgagaaggcgaaaatgcttctgaagcctgacaaaactattgttaccgaggcacatcatatctggccttccctcactgatgatcaatggattaaggttgaggttgccttgagggatctcatattatcggattatgcaaagaagaacaatgttaacacatcagctctgacacagtctgagattcgtgatatcatacttggagctgagattactccaccttcacaacagaggcaacaaattgcagagattgagaaacaggctaaagaagccagccaattgacagcagtcaccacaaggactacaaatgtccatggtgatgaactcattgtcaccaccaccagtccgtatgaacaagctgcatttgggtctaaaactgattggcgtgttagagcaatctcagccactaacctttatcttagggtcaatcatatatatgtcaattcagaggacatcaaggaaacgggatacacttacatcatgcccaagaacatattgaagaagttcatttgcatagcggatttgaggactcaaatttctggctacttgtatggtgtaagtcctcccgacaatccacaggtcaaggaaattagatgtgttgccatgccacctcaatgggggactcaccagcaggttcatctcccctcagctcttccagagcatgatttcttaaatgatctggaacctctgggatggctccacacacaacccaatgaactccctcaattatcaccacaggatgtcacaagtcattctcggatattggagaataacaagcaatgggacggagaaaaatgtatcatcttgacttgcagtttcactccaggttcctgctctttaactgcttataagctcaccccaagtggttatgagtggggacgtgtcaacaaggatactggaagcaatcctcatggttaccttccaactcactacgaaaaggtccagatgctcctaagtgaccgtttcctagggttttacatgattcctgataatggtccatggaattacaactttatgggagtaaaacatacggcgagtatgagatatggagttaagcttggagcacctcgagaatactaccatgaagatcacagaccaacccattttctggagttcagcaacctggaagagggtgataacgcagaaggagaccgagaagatactttcaactaaatgatacgattttgttgtaataatacattgtaatatgtatgcacttgtcagttaccaggggcttttagatgacctgtaaatatatattttgatcaagtttcaggttcttacagttggaatggacaagtgttatactttgttcttattcacaagagacctggttaatgagatttaa

SEQ ID NO: 1000 - DNA, 7141 bp, Arabidopsis thaliana
atgtggaacattgatggtacgtccttagctcctcctggtaccgacggttcgaggatgcagacaccttcacatcccgctgatcatccttcttacacggcgccttctaatcggaatactccgacggttcctactcccgaggatgcagaggcgaagcttgagaagaaggcgagaacatggatgcagctaaattccaaacgggatcatggtgatatgtcatcaaagaaacatcgacttgataaacgtgtatatcttggagcacttaagttcgttcctcacgcagttttcaagctcctggagaatatgcctatgccctgggaacaggtccgggacgtgaaggtcttgtaccacatcactggagctattacatttgtgaacgaagtacgatgggttgtggaacctatttacatggctcagtggggttctatgtggataatgatgagaagggagaagagggatcgtcgtcatttcaagagaatgcggtttccaccatttgatgatgaggagccccctctagactatgctgataacctgttggacgttgatcctctagaggcaattcagttggagctagatgaagaagaagattctgctgtgtactcttggttttacgaccacaagccacttgtaaaaacaaaaatgatcaatggtccaagttaccagacgtggaatctctcacttccaattatgtcaacccttcacaggcttgcagcccagttgttgtctgatttggttgatcgcaactacttctacttgtttgacatgccatcattctttactgcaaaggcactgaacatgtgcataccaggcggtcctaagtttgagcctttgcatcgtgatatggagaaaggagatgaagactggaatgaatttaatgacatcaacaagcttataattcgatcccctctgcgaactgagtacaaagtagctttcccacatctgtacaataataggcccaggaaagtaaaactctgtgtctatcacactcctatggttatgtacataaagactgaggatcctgaccttcctgccttttattatgatccattaattcaccccataagtaactctaataacactaataaagaacagcgcaaaagtaatggttatgatgatgatggggatgactttgtgttaccagaaggactggaacctttgctaaataactcgccactctacactgacactacagctcctggcatttcattgttgtttgcccctcggcctttcaatatgaggtctgggaggactcggcgggctgaagatataccccttgttgcagagtggtttaaggagcactgtcctccagcatatcctgtcaaagttcgggttagttaccagaagcttttgaaatgttatctactgaatgagctgcaccatagaccccctaaggctcagaagaagaagcatttgtttcgatctcttgcagctacaaagttttttcagagcaccgaactggattgggttgaagtgggtctgcaagtctgccggcaggggtataatatgctgaacctgttgattcacaggaagaatttgaactacctgcaccttgattataacttcaacctcaagcctgtgaaaactctgacaaccaaggaacgaaagaagtcgcgttttggaaatgctttccatctctgccgtgagatcctccggctgacaaaacttgtagttgatgcaaatgtccagttccgacttggtaatgttgatgcctttcaattggctgatggcctgcaatatattttctcccatgttgggcaattgacaggtatgtatcgttataagtacaggcttatgagacaaatcaggatgtgcaaggatttgaaacacttgatctattaccgtttcaatactggtcctgtgggtaaaggaccagggtgtggattttgggctccaatgtggagggtatggttgtttttccttcgcggaatagttcctcttctagaacgatggttagggaatctgcttgcacgtcaatttgaggggcgtcactcaaagggagtggccaaaacagtcacaaaacagagagttgaaagccattttgatttggagcttcgagctgctgtcatgcatgatgttgttgatgcaatgccagagggtattaagcaaaataaggcgcggacgatattgcagcaccttagtgaggcatggcggtgttggaaagctaatataccatggaaggtccctggattacctgtggcaattgagaatatgatcctccgatatgtcaagtctaaagctgattggtggacaaatgttgctcactacaatcgtgaacgtatcagaagaggggctactgttgataagacagtttgtagaaagaatcttggacggttgacccgtctttggctcaaggcagaacaggaacgacaacataattttcagaaagatggtccatatgtcacagcggatgaaggaattgcaatttatagcaccactgtaaattggctggaatctagaaaattttcagcaatcccattccctccattatcatataaacatgacacaaagttgcttatcttggcccttgagagactgaaagaatcatatagtgcagctgtgaagttgaatcaacagcagagagaagagcttggtttaattgaacaagcttatgacaatcctcatgaagctctgatgcgaataaagcgtcatcttctcactcagcatagcttcaaagaagttggcatagagtttatggatctatatagccatttgattccagtctatcaaattgatcccctggagaaaattactgatgcttatcttgatcagtatttgtggtatgagggtgacaagcgccacttgtttcccaattggattaagcctgcagactcagagccgccaccgctcctggtttacaaatggtgtcaaggtatcaataatttgcaaggcatatgggacactagtgatggtcagtgtgtagtgatgctccagacgaagtttgaaaaactctttgagaagattgatttgacagtgttgaacagccttcttcgtttggttcttgatcccaagcttgcaaactatgtgactggcaagaataacgtggtgctgtcttacaaggatatgagctatactaatacgtatggactcattaggggactgcagttcgcatcgtttgttgttcagttttatggactagtgttagatcttttgctccttggtttgactcgagcaagtgaaattgccgggccaccgcagaggcctaatgagtttatgacctactgggatacaaaagttgagacacgccatcccataagactgtattctcggtatatagacaaagtgcatataatgtttaaatttacccatgaagaggctagggatcttattcaacgtcatctcaccgagcgtcctgatcccaacaatgaaaacatggtgggatataacaataaaaaatgctggccaagagatgcaaggatgaggttaatgaaacatgatgtcaatcttggtagaagtgtcttctgggatatgaagaatcgtcttccacggagcatcacaaccttggagtgggagaatggcttcgtctccgtgtacagcaaggataatccaaacttgcttttcagcatgtgtggatttgaagtccgcgtgcttccaaaaatcaggatgggtcaagaagcttttagcagcacaagggatggtgtctggaatctgcagaatgaacaaactaaagagaggactgcagttgcttttctgcgggctgatgatgaacacatgaaggtgtttgagaatcgtgtgaggcagattcttatgtcgtcagggtcaaccacatttaccaaaatcgtcaataaatggaatacagctctgataggcctcatgacttacttccgtgaagccactgtgcatacgcaagagctcttggatctgcttgttaaatgtgaaaataaaatccaaacgagggttaagattgggctaaactcaaagatgcctagtcgatttcctcctgttatcttctacactccgaaagaaattggcgggcttgggatgttgtctatgggtcatattttgatcccacaaagtgaccttcggtacagcaaccagacagatgttggtgtaagccatttcaggagtggaatgagccacgaggaggatcaactgattcctaatctttaccgttacatacaaccatgggaaagcgaatttattgattcacagcgggtgtgggcagagtatgctttgaagaggcaggaagctcaggcccaaaatagacgtctgacgctggaggatctggaagactcttgggataggggaattccgcgtataaatacgctgttccagaaggataggcacactttagcatatgataaaggttggagggtccggaccgacttcaaacagtaccaagccctgaaacaaaatcctttctggtggacacaccagaggcatgatggtaaattgtggaacttgaacaattaccgaactgatgtcatccaagctcttggaggtgttgagggtattcttgagcacaccttatttaaaggaacatactttccaacttgggagggtcttttttgggagaaggcatctggttttgaggagtctatgaaatataagaaactgacaaatgcacagaggtctggtctgaaccagattccgaatagaagattcacgctctggtggtcgccaacaattaatcgagcgaatgtgtatgtgggtttccaagtgcagttggatttgacaggaatatatatgcacggaaagattcctactcttaaaatatctttgattcagatattccgtgctcatttgtggcaaaaaatccatgagagtgttgttatggacctttgccaagtactggatcaagagttggaacctttggagatagaaactgtgcagaaagagacaattcatccacggaagagttacaaaatgaatagctcttgtgctgatgttcttctgtttgctgcccataaatggccaatgtctaagcctagtctaatcgctgagtccaaggatgtgtttgatcagaaagcgagtaacaagtactggatagatgtgcaacttcgatggggagattatgactcccatgatattgaacgctatactaaggccaaattcatggattacacaacggacaacatgtctatctatccatctccaacgggtgtaattattgggcttgatttggcctacaacttgcattccgcctttggtaattggttccctggttccaaacctctgcttgctcaagcaatgaacaagatcatgaagtcaaatcccgctctatacgtgttgagagagaggataaggaaaggtttgcagttgtactcatctgagcctacagagccatatctgtcatctcaaaactatggtgaaatattcagcaatcagatcatatggtttgttgatgataccaatgtataccgtgtcacaatccacaagacatttgaaggaaatctaacaacaaagccaatcaatggtgtgatttttattttcaacccaagaacagggcaactattccttaagatcattcatacaagcgtttgggctgggcagaagcgccttggtcagcttgcaaaatggaaaactgctgaagaggtcgctgcacttgtgcggtctctccctgttgaagaacagccaaaacaagttattgtgactcgtaaaggaatgttggatccccttgaggttcatctgctggatttcccaaacattgttataaagggaagtgaactccagcttccgttccaggcttgtcttaagatagaaaaatttggtgatctgattttgaaggccacagagccgcagatggccctcttcaatatctatgatgattggttgatgactgtttcttcgtacactgcctttcaaagactcatcctgatccttcgtgctcttcacgtaaacaatgagaaggcaaagatgttattgaagcctgacatgtctgttgtcactgagccaaatcacatttggccttctctcactgacgaccaatggatgaaggtggaggttgctcttagagatctcatcctttccgactacgcgaagaagaacaaagtaaatacatcagctctgacacaatcagagataagagatataatacttggagcggagattactccaccgtctcagcagaggcaacagatagctgagattgagaaacaggcaaaggaagcgagccagcttactgcagtcacaacaagaaccacaaatgttcatggtgatgaattgattagcaccaccattagtccgtacgagcaatctgcattcggatccaaaacagactggcgtgtgcgcgcaatttcagctactaacctctacctcagggtcaaccacatctacgtgaactcagatgacataaaggaaactggatacacctacatcatgccaaagaacatattgaagaagtttatatgcatagcggatcttcgaactcaaattgctggatatttatatgggataagtccgccggataatcctcaagtgaaggaaatccgttgtgttgtgatggtgccacaatgcggaaatcaccagcaagttcaactgccgtcgtctcttccggaacatcagttcttggatgatttagagcccctgggatggatacacacacagcctaacgagcttcctcagttgtcaccacaggatgtgacttttcacactcgtgttctggagaacaacaagcaatgggacgcagaaaaatgcatcatcctgacatgtagtttcactccgggctcatgctctttgacgtcatataagctgacgcaagccggatatgaatggggacggctgaacaaagacacaggcagcaatccccacggttaccttcccacccactacgagaaggtccaaatgctcttgagtgaccgtttcttcgggttctacatggttcctgagaacggaccctggaactacaacttcatgggagcgaatcacacggtgagcataaactacagcttgacactcggaacccccaaggaatactatcaccaagtccatcgacccactcatttcctccagttcagcaaaatggaggaggatggtgacctcgatcgtgatgactcttttgcttaagacttttttggatgtatggtgtatattgagtttgcaaattgttaatgattagactgaaaagatttgtctctattcaaaaattaatattaactttccaacaaattgagttacatgattaaataaaaaatgacttgaataacct

SEQ ID NO: 1001 - DNA, 1690 bp, Orobanche aegyptiaca
aagtaagttggctgctctagttacggtcattacctgttgaagaacagccgaagcaaatcatagtgacacgtaaaggaatgttggatcctcttgaagtgcacttgctcgatttcccgaatattgtcatcaaaggaagtgagctgcaattgccattccaggcttgtttgaagattgagaaattcggtgatttgatattgagggccacagaaccccaaatggtcttgttcaatatttatgatgattggttgaagtctatatcatcgtacacagccttctccaggctgatactgatcttgagagctctgcatgtcaacaatgagaaggcaaaaatgttgctgaagcctgacaagactattgtcacagaacctcaccacatctggccttctttatcagatgatcaatgggccaaggtggaagttgccctcagagatctgatactttcagactatgccaagaagaacaacgtgaacacatcggcattaacccagtctgagatgcgtgatataattctcggagccgagattactccaccttcacaacagcggcaacaaattcttgaaattgagaaacaagcaaaggaggctagtcaggcaacagcagtcaccacgtttaccacaaatgtgcacggtgacccgatcatcgttacaactgttagtccttatgaacaagcagcatttgggtcaaaaactgactggcgtgtcagagctatatccgccaccaatctccatcttcgagtcaatcacatatatgtgaactccgaagacatcaaggaaacgggatatacttatatcatgcccaagaatatcttgaagaagttcatctgcgtagctgacctgcgcactcagatttctgggtacctttacggcgtaagtcctccagacaatccccaggtcaaggagatccgctgtattgccatgccaccacagtggggtagtcaccagcaggttcatcttccatcgtctcttcctgagcatgatttcctgaacgacttggagccattagggtggatgcatacacagccaaacgagcttcctcagctatcaccacaggatcttgcggctcatgctcgggtattgtcaaacaacaaacaatgggatggagagaaatgcataattctgacctgcagttttactcctggttcctgctctttgactgcatataagttaaccccatcagggtatgagtggggtaagagcaacagtgacgcagcaagcaacccacatggttacttgccaacttactatgagaaagtccaaatgctcttgagtgatcgcttccttggtttttacatggtacctgataacggcccttggaattacaattttatgggtgtgaaacatactgcaagcatgaagtatggtgtgaaactaggcacgccccgcgaattttatcacgaggatcaccggccgacacatttcctggagttcagcaatctggaggaaggtgaaactgcagcgggtgatagggaagatactttcacataaatccatcccaagtacaagtttttgtcatcattgtgcttcagaggatatgtagtgtttttttgtaacttcaagatgcgcagagcttttcttctgttgtaaatatgtgttgatgataacaatttagttgtattgaatatgtgcaaactgtttagtgctttgtccgacctgcctaaatgtcacctttgcctagaatggtctcgtccaat

SEQ ID NO: 1002 - DNA, 6450 bp, Arabidopsis lyrata
atgcaaagaggagaacgtgggattttgtttcccaatttaaaagaaagaaattggtctcgacaaagagtctggttcgattgcggtttccgccgtttgatgatgaagagccggtgttggattatgcggttggagcttgatttggaggatgattcttgtgtgtataattggttttatgatcataagccacttttgaagacgaatatgatcaatggtccgagtgacaagaggtggaatctttcacttccgattatggcaacgcttcataggcttgcgggtcagttgctttctgatttggttgatagaaactatttctacttgtttgatatgccatcgttcttcacagcaaaggcattgaatatgtgtatacctggtggtcctaagtttgaacctttgtatcgtgatatggagaaatatgacgaggaatggaacgagtttaatgatatcaacaaggttatcactcgatcacggctgcgtactgaaggcagaattgctttcccttacttgtacaataacaggccaaggaaagtcaaactatgtgcgtatcacactccaatggttatgttcattaagacagaggatcctgatcttcctgcgttttattatgatccgttgattaacccaataagtaacacttttcatgacaggaaggtatgtgatgatgatgaggatgactttgtattacctaacggagtggagcctctgctacaagagactcagctttacactgacactacaactgatgggatttcgttgttgtttgccccaagacctttcaatatgaggtctgggaagacgcgacgggcagaagatataccgttggtgtcagagtggttcaaggagcactgtccaacatcacatccagtcaaagttcgggttagttaccagaagcttttgaaatgttatgtgctgaatgatttgcactgtagaccacctaaacctcagaagaaaaagcacttgttccggtctcttgcaggtacaaaatttttccaaagcactgaacttgattgggttgaagctggtctgcaagtttgtcggcaggggtataatatgttgaatctgttgattcataggaagggtttgaattacctgcatcttgattacaacttcaacctcaagcctgttaagactttgacgactaaagagcgtaagaagtcacgttttgggaatgcttttcatctctgtcgcgagattctccgcctgactcgtggtatgtatcgttataagtacagactgatgagacaaattaggatgtgtaaggatttaaaacacttgatctattaccgtttcaatactggtcctgtgggtaaaggaccagggtgtggattttgggctccaatgtggagagtgtggttgtttttcctccgtggaatagttcctttacttgaacgatggttagggaatcttcttggacgtcaatttgaggggcgtcactcaaaaggaatggcaaagaccgtcacaaaacaaagagtcgaaagccattttgatttggagcttcgatctgctatcatgcatgatatcgttgatgccatgccagagggaaccaagcagaataaagtgaggacaatagaacagcaccttagcgaggcatggcggtgttggaaagctaatatcccgtggaaggtccctggactgcctctgccagttgagaatttgatcctccgatatgtgaagcataaggctgattggtggacaaatattactcacttcaatcgtgagcgtatcagaagaggggctactgttgataagacagtttgtagaaagaatcttggaaggttgactcgtctttggttaaaggcagaacaggaaagacaatacaattacctgaaagacggttcacctgtcactccggacgaagctgtggcaacttatagaacgacccaagagtggctggaagctaggagattttcaccaattccattccctcctctgtcgtacaaacacgagacaaagttgctcatcctcgcccttgagagactgaaagaatcatgtggaggtgaaaggttgaaccagcagcagcgagaagagcttggtctaattgaacaagcttatgacaacccgcatgaaactctagcgcgaattaaacgtcatcttttcacgcagcgtcagttcaaagaagtgggcattgagtttatggatctctacagctatgtgattccggtctatgaaattgatcctttagagaaaattacggatgcctatcttgatcaatacttgtggtacgaggctgacaagcgccacttgtttcccaactggattaagcctgcagactcagagccgccacctcttctggtttacaagtggtgtcagggtatcaacaatttgcaaggcatatgggacacatctgatggacagtgtgtggtgatgctccagacaaagttggaaaagttgtttgagaaggttgatttcacattattaaacaagcttcttcgtttgattgttgaccccagtattgcagactacgtgactgccaagaataatgtggatctgtcttataaagatatgagacatactaactcgtatggtctcattagaggacttcaattctcatcctttgttactcagttttatggactagtgcttgatcttttgcttcttggtttgactcgagcgaacgagattgctgggccaccgcagaagcctaacgagtttatgacctattgggatacaaaagttgaaacacgccatcccataagactatattctcggtatgtagacaaagtgcacataatgttaaaatttacccatgaagaggttcgagatcttattcaacggtatcttagggagcatcctgatcccaataatgagaacatggtgggatataacaacaagaagtgctggccgagagatgcaaggatgaggttgatgaaacatgatgtcaatcttggtagaagtatcttctgggaaatgaagaaccgtcttcctcggagccttacaacttttgagtgggagaatagctttgtctctgtgtacagcaaggacaatcctaatctgctgttcagcatgtgtggatttgaaatccgcatacttccaaaagccaggatgagccaagaagctttcagcaacataggggatggtgtgtggaatctacagaatgaacagacaaaagagaagactgcagttgcttttctgcgagttgatgaagaacaaattaaggtgtttgagaatcgtgtgaggcaaattttaatgtcgtcagggtcggccacatttaccaaaatcaccaataaatggaacacagctttgataggtctcatgacttactttcgtgaagccactctacatacgccagagctcattgatctgttggttaaaggtgaaagtaaaatccaaacaaggattaagattgggctgaattcaaagatgcctagtcgatttcctcctgttgttttttacaccccgaaggaactcggtgggcttggaatgttgtctatgagtcatatactgatcccagaaagtgaccgtcggtacagcagacaaacagacgttggtgttacccactttaggagtggaatgagtcaagaagaggatctgaagatacccaatctttaccgttacatacagccatgggaaagtgagtttattgattcacagcgtgtgtgggcagagtatgctttaaagaggcaggaatcacaagcccaaaatagacgtcttacacttgaggatctggaagactcctgggataggggaattccgcgtataaacacgctttttcagaaggataggcacacattagcatatgataaaggttggagagtccggactgacttcaagcagtaccaagtcctgagacaaaattctttctggtggactcatcagaggcatgatgggaagttgtggaacctgaacaattatcgaactgatgtaatccaagctcttggaggtgttgagagtattcttgagcacaccttatttaagggaacatacttcccaacatgggagggtcttttctgggagaaggcatctgggttcgaggagtcaatgaaatataagaagctgacgaatgcacagaggtctggtctgaaccagattcctaatagaagattcacgctctggtggtcgccaacaatcaatcgagcaaatgtttatgtcggtttccaagtgcagttggatctaactggaatattcatgcatggaaagattcctacccttaagatatctttgattcagatttttcgtgcccatatgtggcaaatgatccacgagagcgttgttatggatctttgccaagtattggaccaacatatggatgagatggggatagatattgtgcagaaggagacaattcatccaaggaagagttacaaaatgaatagctcttgtgctgatattcttatgtttggtgcctctaaatggccaatgtcgaagccaagtctggtgaccgactcgaatgatatgtttgatcagaaagctagtaagaaatattggatagatgtacagcttcgatggggagattatgactctcatgacattgaacgttacactagggccaagttcatggattatacaacggataacatgtctatctatccatctccgacaggtgtgatgattgggattgatttggcatacaatgtgtattctgcttttggtaattggttccctgattcaaaatctttgattgctaaagcaatgaacaagattattaagtcaaatccgacattatatgggttgagagaaaggataaggaaaggtttgcagctatactcatctgagcctacagagccaaatttgtcatctcaaaactatggcgaaatattcagcaaccagataatatggtttattgatgataccaacgtctatcgtgtgacaatgcataagacatttgaaggaaatctgacaacaaagccaatcaatggtgcagcttttattttcaatccaagaactgggcagctattcctgaaggttatgcatacaagcgtttgggctggtcagaagcgtcttggtcagcttgcaaaatggaaaactgctgaagaggttgctgcacttgtgcggtctttccccgttgaagaacagccaaaacaagttattgtgactcgtaagggaatgttggaccccattcagactaccatgaaggattttcccaacattgttatcaagggaagcgaactgcagcttccattccaggcttgcctgaagattgagaaattttgtgatctgattttgaaagctactgagccgcagatgaacctcttcaatatctatgatgattggttgacgagcatatcttcttacactgccttctcaagactcattctcatcctccgtgctcttcatgtcaacaatgagaaggctaagatgttactgaagcccgacaagtctgttgtcactgagacacatcacatctggccttctctcactgacgaccaatggatgaaggtggaggttgctcttaaagatctcatcctttttgactacgccaagaagaataacctgaatatatcagctttgacacagtcagagataagggatattattcttggagctgagattactccaccgtctcaacaaaggcaacaaatagctgagattaataaacaggccaaagaagtgagacagcttagtgcagtcacaacaaggaccactaatgttcatggtgatgaactcattgtcaccactattagtccctatgaacagtctgcatttggttccaaaacagattggcgagtgcgggcaatctcagctactaacctccaccttagggtcaaccacatttatgtgaactcatatgatgtaaatgaaacaggatacacctacataatgccaaagaacatcttgaagagattcatacgcatagcagatcttcgtactcagattgctgggtatatgtatggtataagtccccttgataatcctcaggtcaaggaaatacgatgcgttgtgatggtgccacagcggggatcacaccagcaagttcacttgccttcatctcttcctgagcatgatttcttaaaggattttgagcccctaggatggatgcacacacagcctaatgagcttcctcagttgtcgccacaagatgttacatcacatgcacgttttctggagaataacaagcaatgggacagagaaaaatgtatcatcttgacttgcagtttcactccaggctcatgttctttgacctcatataagctgacggaaactggatatgaatggggacgtctcaacaaggacagtggcagcaatccccaaggctatcttccgacacactatgacaaggttcaaatgctattgagtgaccggttccttgggttttacatggttcctgataacggaccatggaactataactttatgggggtgaagcatacagagagcatgaaatatagtgtgaaactcggaaaccccaaggagtactatgacaatgagcatcgacccactcattatctggagttcagcaatatggaagaggatagaaacttcagcgagagagatcgtgaggactgttatgcttga

SEQ ID NO: 1003 - DNA, 1581 bp, Pteridium aquilinum
aaaggaatgcttgatccattggaagtgcacttgctcgactttcctaatattgttatcaagggtagtgaattgcagcttcccttccaagcttgcttgaagatagagaaatttggggatttgatactgaaagccacagagcctcaaatggtgctttttaacatctatgatgactggctaaagacagtgtcatcttatacagcatttcaaaggttgatacttattcttcgtgctttgcatgtgaataatgaaaaggcaaagatgcttctaaagcctgacaagagtatcatcacagagtcgcatcacatatggcctagtctgtcagatgatcaatggatgaaagtggaagttgctttaagagaccttatcctttctgattatgccaagaaaaacaatgtgaatacctctgcccttacgcaatcagaaattagggatattatactgggtgctgaaataaccccaccatctcagcaacgtcagcaaattgctgagatagagaaacaggcaaaggaagccagccaactcactgcagttaccacaaagacaactaatgtccatggtgatgatttaattgttactacaaccagtccatacgagcaagcagcatttggatccaaaactgattggcgtgtacgagctatatcagccaccaacctttacctccgagttaaccatatctatgtcaactctgatgatattaaggaatctggttacacgtacatcatgcccaagaatgttttgaagaagttcatatgtatagctgacttgagaactcagattgctggatatctttatgggttgagccctcctgacaatcctcaggtgaaggagattcgttgcattgtcatgcctccacagtggggaacacatcaacaagtgcatctaccttctgctcttcctgagcatgagtatttaggcgagctggagcctttaggctggatgcatacacaaccgaatgaattccctcaattgtctcctcaggatgtgacaagccatgctcggatgctggaaaataataaatcctgggatggggagaggtgcattatattgacttgcagttttactccgggttcttgttctctgaccgcatataagctgacaccatcaggttatgagtgggggcgtcttaataaagatagtgggagcaatccacatggctatctcttgacccattacgagaaagtgcagatgcttctcagtgataggttcctggggtattacatggttccggacaacggcccttggaattacaactacatgggtgtcaagcattcgacaagcatgaagtatggcataaagttatcaataccgaaggagtactatcatgaggatcatagaccaactcacttcttggaatttagcaatctagaaggagatcatgtggatgcagaccgagaagatgttttacttagagtccgaacagagatcgaattttagtacgattgtctcaatctagaggtagattacgttgatgcgatcgggatatgtttttctgaagagcgagacttgggatttcaacagattcgctgaagacggatgttagaccgagtaggattgttttaaactcaccacttcttactatgg

SEQ ID NO: 1004 - DNA, 2031 bp, Triticum aestivum
tcaaatcctgctctgtatgtgctgagggagagaataagaaagggtcttcagttgtattcatctgaacccaccgagccatatttgtcttcgcagaactatggagagatattcagcaatcaaatcatatggtttgtggatgacacaaatgtctatcgagttaccattcacaaaaccttcgagggtaacctgaccaccaaacctatcaacggtgctatctttattttcaatccaagaactgggcaactatttctgaaggtcatccacacaagtgtatgggcaggacaaaagcgtctagggcagctggccaagtggaaaactgccgaggaggttgctgcgttagttcggtctcttcctgtagaagagcagccaaagcaaattattgtgacaaggaagggtatgttggatccattggaagtccatctgcttgatttccctaacattgttatcaagggcagtgagttgcagctgccattccaagcttgcttgaagattgagaagtttggcgatcttattctcaaggctacggaaccacagatggttctttataacatatacgatgactggctgaaaagtatctcgtcctacaccgcattctctcgtcttgtgcttatattacgagcattacatgtcaataatgagaaggccaagatgttgctgaagcctgacaagacaattgttacggaaccacatcatatctggccatctttgaccgacgagcagtggctgaaggtcgaatgtgcgctcagggatctcattctttctgattatgcgaagaaaaacaacgttaatacttctgcacttacgcaatctgagattcgtgatataatacttggtgctgaaatagctccaccatcacagcagaggcaacagattgctgagattgagaaacagtcccgagagacaaatcaggtaactgcacagacaacaaggacagttaatgtgcatggagatgagctcatcgtcacaacaaccagtccgtatgagcaagcagcgtttgcatcgaagacagattggcgtgtcagggccatctctgctacgaacctgtatctccgtgtcaaccacatttatgttaactcggatgatataaaggagactggctatacttacatcatgccaaagaatatattgaagaagttcatatgcatagcagatctgcggacacaggttgcaggtttcctgtatgggctgagtccacaggataatccccaagtcaaggagatcagatgcatatccattccgccacagcatggaactcaccagatggtgactttgccagcgaatctcccagagcatgagttccttgctgacttggagccgttgggatggatgcatacccagccaaatgaagctcctcagctatcacctcaggatttgacatcacatgctaaaattttggagaacaacaagcagtgggatggtgagaagtgcatcattttgacctgcagcttcaccccaggatcgtgctcgttgactgcatacaaactgacaccaagtggttatgagtgggcccgtggcaacaaggacaacgggagcaacccacaagggtacctcccaactcactacgaaaaggtccagatgcttctcagcgaccgcttccttggattctacatggttcctgacaacgctccatggaactacaacttcatgggagtcaagcacgacccactgatgaagtacagcatgaagctgggcacaccccgcgacttctatcatgaggaccacaggccgacgcacttcctggagttcagcaacattgaggagggcgaggtcgcggagggggacagggaggacaccttctcgtagttgtagccaccttagcacgcccctccgccctatgctagcatatcaaaacctgcaatgagatcggctcaattttggatggagatctctgtaacctgtaaactttgacgtgacatgttgtatgatgttttccgtctctcaagaccaataccatgtgttgtaagcctccttcaatcacggtgctgtataagtgcataatgataacagttgaaacattttacttggtggcct

SEQ ID NO: 1005 - DNA, 1208 bp, Triticum aestivum
gcagcacagacaagccctagggttttagcactgctcgagcgcgcgcccggcgacgcaaacccgcagacaaactttccggccatgtcggcggcggcagcagctgcggacacgtactccccggccgcggaggctgggagcaagcgccgggagaggagggaggagctgcggcgccacctcgccgaggatgccgattggccccgggccgacggccgctccttgcacgactgccgccccgcatttatgcaaacagggccaactactgctgcatcagggtctgcttatgcagaatttgggaagacaaaggtcattgtgtcagtgtttggcccaagggagagcaagaaagcaatgctgtacagtgacactggtaggctcaattgcagtgtgagctatacaacattcgccactggtatacgtggacaggggctggaaaacaaggagtactctggaatgcttcacaaagccctggaaggcgcagtaatgctacatacttttccgaagacaactgttgatgtttttgcgttggttcttgagtctggtggcagcgatcttcccattataatatcttgcgctagtcttgcactggcagatgctgggattatgatgtatgaccttgttacatcagtatccgtgtcctgtttagggaagaacgttatcatcgatccaacctcagacgaggaggcatggcaagacggaggcctcatggtatcttacatgccggcccgcaaggagattacacaacttacgctgactggggagtggactgacggcaaaatcaccaatgcagtagagctctgtatggatgcttgcagtaagctctgcgagatattgcgggagcgcttgaaagaccccgcgagcttggcgagcgaatgacatttgagcagacacatgttttcagattcgcaacagatatccttagctgtagaggttttgtagggaaggaggacagggctgatgtttggaggagcacaatttacatggctgtggtgattgtttcttttggcaaaagagcgaattgtttagccgagagaaaatcttgtaggtgtgctagtcatgtcttttagtatgcatttggaacctgagacttttcggaactttgtatcatccctatatggattgtttatgatgtcaaagctattgccctgtattttgggctgacagcctgggactgggatcctaaaaaatttgtgctgctgctattatctcaaaaa

SEQ ID NO: 1006 - DNA, 1205 bp, Triticum aestivum
  misc_feature (765)..(765): n is a, c, g, or t
  misc_feature (1046)..(1047): n is a, c, g, or t
  misc_feature (1049)..(1049): n is a, c, g, or t
  misc_feature (1055)..(1055): n is a, c, g, or t
  misc_feature (1061)..(1061): n is a, c, g, or t
  misc_feature (1066)..(1066): n is a, c, g, or t
  misc_feature (1070)..(1070): n is a, c, g, or t
  misc_feature (1100)..(1100): n is a, c, g, or t
  misc_feature (1103)..(1103): n is a, c, g, or t
  misc_feature (1139)..(1139): n is a, c, g, or t
gcagcacagacaagccctagggttttagcactgctcgagcgcgcgcccggcgacgcaaacccgcagacaaactttccggccatgtcggcggcggcagcagctgcggacacgtactccccggccgcggaggctgggagcaagcgccgggagaggagggaggagctgcggcgccacctcgccgaggatgccgattggccccgggccgacggccgctccttgcacgactgccgccccgcatttatgcaaacagggccaactactgctgcatcagggtctgcttatgcagaatttgggaagacaaaggtcattgtgtcagtgtttggcccaagggagagcaagaaagcaatgctgtacagtgacactggtaggctcaattgcagtgtgagctatacaacattcgccactggtatacgtggacaggggctggaaaacaaggagtactctggaatgcttcacaaagccctggaaggcgcagtaatgctacatacttttccgaagacaactgttgatgtttttgcgttggttcttgagtctggtggcagcgatcttcccattataatatcttgcgctagtcttgcactggcagatgctgggattatgatgtatgaccttgttacatcagtatccgtgtcctgtttagggaagaacgttatcatcgatccaacctcagacgaggaggcatggcaagacggaggcctcatggtatcttacatgccggcccgcaaggagattacacaacttacgctgactggggagtggactganggcaaaatcaccaatgcagtagagctctgtatggatgcttgcagtaagctctgcgagatattgcgggagcgcttgaaagaccccgcgagcttggcgagcgaatgacatttgagcagacacatgttttcagattcgcaacagatatccttagctgtagaggttttgtagggaaggaggacagggctgatgtttggaggagcacaatttacatggctgtggtgattgtttcttttggcaaaagagcgaattgtttagccgagagaaaatcttgtaggtgtgcnngncatgtnttttantatgnattnggaacctgagacttttcggaactttgtatnatnccatggattgtttatgatgtcaaagctattgccctntattttgggctgacagcctgggactgggatcctaaaaaatttgtgctgctgctattatctcaaaaa

SEQ ID NO: 1007 - DNA, 1073 bp, Leymus cinereus x Leymus triticoides
  misc_feature (4)..(6): n is a, c, g, or t
  misc_feature (9)..(10): n is a, c, g, or t
gcannnctnnagcgcgcggccggcgacgcagacgcgcagacgcgcagacacactttccggccatgtcggcggcagcagcagctgcggacacgtactccccggccgcggaggctgggagcaagcggcgggagaggagggaggagctgcggcgccacctcgccgaggacgccgattggccccgcgccgacggccgctccttccacgactgccgccccgcatttatgcaaacagggccaactactgctgcatcagggtctgcttacgcagaatttgggaagacaaaggtcattgtgtcagtgtttggcccaagggagagcaagaaagcaatgctgtacagtgacactggtaggctcaattgcagtgtgagctatacgacttttgccactggtatacgtggacaggggttggaaaacaaagagtactctggaatgcttcacaaagccctggaaggcgcagtaatgctacatacttttccgaagacaactgttgatgtttttgcgttggttcttgagtctggtggcagtgatcttcccattattatatcttgcgctagtcttgcactggcagatgctgggatcatgatgtatgaccttgttacatcagtatctgtgtcctgtttagggaagaacgttatcatcgatccaacctcagacgaggaggcatggcaagacggaggccttatggtatcttacatgccggcccgcaaggagatcacacaacttacgctgactggggagtggactgatggcaaaatcaccaatgcagtagagctctgtatggatgcttgcagtaagctctgcgagatattgcgggagcgcttgaaagacaccgcgagcttggcgagcgaatgacatttgagcagacacatgttttcagaatcgcaacagatgtccttagctgtagaagttttgtagggaagggaggccaggcctgatgtttggaggagcacattttacatggctgtggtgattgtttcttttggcaaaagggcgaattgtttagccgagtgaaaatcttgtaggtgtgcaagccatgtcttgtattgtgatttcggaacctgagacttcctcgga

SEQ ID NO: 1008 - DNA, 1160 bp, Brachypodium distachyon
gaaaaaaacctcagccctcctccctcgccactagggtttaagcgcagctcgagcaggcggccggcgacgcagacgcacacctagtttccggccatgtcggcggcggcgggcactgcggggacttactctccggctgcggaggccgggggcaagcggcgggagaggaaggaggagctgcggcgccacctcgccgaggacgccgactggccccgggccgacggccgctccttccacgactgccgccctgcttttatgcaaacaggaccaactaccgctgcatcagggtctgcttacgcagaatttgggaagacgaaggtcattgtgtcagtgtttggcccaagggagagcaagaaagcaatgctgtacagtgacactggtaggctcaattgcaatgttagctatacaacatttgcaactggtatacgtgggcagggattggacaacaaagagtactcagaaatgcttcataaagccctggaaggcgcagtaatgctggatacttttccgaagacaactgttgatgtttttgcgttggttcttgagtctggcggcagtgatcttcccatcatcatatcttgcgctagtcttgcattggcagatgcaggaatcatgatgtatgaccttgttacatcagtatctgtgtcctgtttagggaagaacgttatcatagatcccacctcggacgaggaggcatggcaagatggaggtcttttggtatcttacatgccgacccgcaaggagattacacaacttactctgacaggggagtggtctgatggcaaaatcaccaatgcagtagagctctgtatggatgcttgcagtaagctctgtgagatattgcgggagcgcttgaaagattctacaagcttggctagtgaatgacatttgagccgtttcgtgttctcagaattgcaactgatatcctcagctgtacaaattttgtaggcaagggtggccaatcctgatgcttgtggcagcacattgacatggttttggttatcattatcgttcttctagcaaaagattgaattgtgaagcagagagaaaatacctgttagcgtgtatgccctgggatttttcggcactttgtatcctcctgtgtatcgttttactatgtcaaagctgttgccctgtattctgtgggctggcatgccagaaaa

SEQ ID NO: 1009 - DNA, 1145 bp, Oryza sativa
gcgagctcacacagccatcgtctctctcgagccgtcgctgaagccaaaaaaccgagcgagctgcgctactaggcaatacacgcagtttccggcgatgtcggcggcggcggcggctactgatgggacgtactctccggcggcggccgcgggggaaaagcggagggagaggaaggaggagctgcggcgccacctcgccgaggacgccgactggccccgcgccgacggccgctccttccacgactgccgtcccgcatttatgcaaacaggaccaacaactgccgcatcaggatctgcttatgcagaatttgggaagacaaaggtcattgtgtcagtgtttggaccaagagaaagcaagaaagcaatgttgtacagtgataccggtagactcaattgcaatgtgagctacacaacatttgccacccctatacgtggacagggaatggacaacaaggagtactccgcaatgctccataaagccctggaaggcgcagtgatgctacacacttttccaaaaaccactgttgatgtctttgcgttggttcttgagtctggtggcagtgatcttcccatcattatttcttgtgctagtcttgcgttggctgatgccggaatcatgatatatgaccttgttacatcggtatctgtgtcctgtttcgggaagaacattatcatcgatccaacctctgacgaggaagcatggcaagacggcagcattatggtggcgtacatgccagcccgcaaggagatcactcagctaacacttactggagagtggtctgatggcaaaatcaccaatgcggtagagctctgcatggatgcttgtagtaagctctgtgacatactacgggagcgcttgaaagatgctgccagcttggctgagtgaataattgctttagcagcgagatgtccaagacttaaaacatatccttagctgtacaaattttgtaggcaagggaggaggctaaggcctgatgtttgcgagattacatgattatgctgattgtttacttcatggcaaagcagctaattgttctgagagaaagtagcatggtttgtatattgttttgtactcctgaccttcagacttgtaaacattgggatgatgcattgacgcggcactcctgtcgttattcgtttcatgtatt

SEQ ID NO: 1010 - DNA, 1361 bp, Oryza sativa
actcccgtcccaaacccttccccgaatcactccaccgaaagcggcgctgctgaggaaggccgacgcggccacggccacgctctccgccgccgccaccgccaccgccaccgtctcgtcgctgcatagttcgccggcctcccgtctctctcgaatctagagacgcacgccgagctcagagacccgatcctgctaaggtttggttggtagctcgagcagccgacggcgacgacgcacacccagttcccggcgatgtcggcggctgccaccgctgggacctactctccggcttctgccgcgggggaaaagcgtcgggagaggaaggaggagctgcggcgccacctcgccgaggacgccgactggccccgcgccgacggccgctccttccacgactgccgtcctgcatttatgcaaacaggaccaacaaccgctgcatcaggatctgcttatgcagaatttgggaagacaaaggtcattgtgtcagtgtttggaccgagagaaagcaagaaagcaatgttgtacagtgatactggtagactcaattgcaatgtgagctacacaacatttgccactcctatacgtgggcagggaacagataacaaggagtactccgcaatgcttcataaagctctggaaggcgcagtgatgttgcacacttttccaaagaccactgttgatgtttttgccttggttcttgagtctggtggcagtgatcttcccatcattatttcttgtgctagtcttgcgttggctgatgctggaatcatgatgtatgaccttgttacatcagtatctgtgtcctgttttgggaagaacataatcattgatccaacctctgacgaggaagcatggcaagacggcagccttatggtggcgtacatgccagcccgcaaagagatcacgcagctaactcttactggagagtggtctgatggcaaaatcacgaacgcggtggagctctgcatggatgcctgcagtaagctctgtgacatacttcgggagcgcttgaaagatgcttccagcttggctgagtgaataaagttttagcagcaggatgttgcaagctcaaacagatatccttagctgtacaaattttgtaggcaagggaggctgatgcctgatgtttgcgggactacatgattatatgctgattgtttcctttgcaaaacagctaattgttcagagagaaagtagcattgtctgtatgttgttttgtactactcctgattgtaatactttatagatgaagccataaaagaatgcaaaattagcttattgtgggatctaaaggacatagctaatattttgaaaatggttccatgtgagataaggatcaattgaaaagaatgaaagaaacaaggaaa

SEQ ID NO: 1011 - DNA, 1095 bp, Setaria italica
cgcgcgcgtagcttcaggcgatgtcggcgcaggcggggacagggacgtactccccggcggctgcggcaggggacaagcggcgggagaggagggaggagctgcggcgccacctcgccgaggatgctgactggccccgcgccgacggacgctccttccatgactgccggccagcgtttatgcaaacaggaccaactactgctgcatcagggtctgcttatgcagaatttgggaagacaaaggtcattgtctctgtgtttgggccaagagaaagtaagaaagcaatgatgtatagtgatgttggtaggctcaattgcaatgtgagctatacgacatttgccactccagtacgtggacagggagcggacaacaaagagtactcatcaatgcttcataaagctttggaaggcgcagtaatgctacacacttttccaaagaccactgttgatgtttttgccttggttcttgagtctggtggcagtgatctaccaatcattatatcgtgcgctagtcttgcactggcagatgctggaatcatgatgtatgacctcgttacatctgtatcggtgtcctgttttggaaagaacatcatcatcgatccaacctcggatgaggaagcatggcaagacggaagcctcatggtagctttcatgccagcccgcaaggagattacccaactcacactcactggagaatggagtgatggcaaaatcaccaatgctgttgagctctgcatggatgcttgcagtaagcttggtgaaatactgcgcgaccgcttgaaagatactgccaccttgacgaacgaatgacactgctgaggcaacacttgctacaagtatccttagctgtataaaaaagcctgtttgagtgagcatacatggttatggtgattaattgattatttccatcatggcaaaagagtgaattgtcaagcagggaagaagttgcagggtgtcatgtgtgtcatgtaatgtactcctgacttctgaccttcggcttcatgaagtgcctgtatttttctctgcactctaagactgttgctcacttgctgtaccgtatcattggattcttagtatactgacctttattttgtgttcg

SEQ ID NO: 1012 - DNA, 1314 bp, Panicum virgatum
cacacgtctccactccagctagtccggcgcagggtctccctctgttccgccgctgttgttcgaccaggccaccggcggcggcgcgctcatagtatccggcaatgtcggcgcaggcggggacagggacgtactccccggcggctgccgcgggggacaagcggcgggagaagagggaggagctgcggcgccacctcgccgaggatgccaactggccccgcgccgacggacgctccttccacgactgccggccagcgtttatgcaaacagggccaactacggctgcatcagggtctgcttatgcggaatttgggaagacgaaggtcattgtatcagtgtttgggccaagagaaagtaagaaagcaatgctgtacagtgatgtcggtaggctcaattgcaacgtgagctatacaacatttgccactccagtgcgtggacagggagcagacaacaaagagtactcatcaatgcttcataaagctttggaaggcgcagtaatgctacacacttttccaaagaccactgttgatgtttttgccttggttcttgagtctggtggcagtgatctacccatcattatatcatgtgctagtcttgcactggcagatgctggaatcatgatgtatgaccttgttacatctgtatccgtgtcttgttttggaaagaacatcatcatcgatccaacctcagatgaggaagcatggcaagatggaagcctcgtggtagctttcatgccagcccgcaaggagatcacccaactcacactcactggagagtggagtgatggcaaaatcaccaatgcggtagagctctgcatggatgcttgcagtaagcttggtgacatactgcgcgaccgcttgaaggatactgccactttgacaagcgaatgacattgttgaggcaacacttgcaccaacatccttagctgtacaaaaaaattgtaggcaagggaggttgatagtccagatgcttgagtgagcatacatggttatggtgattggctgattatttccatcatggcaaaagagtgaactttcaaaccgggaagaagttgcagggcggtgttatcatgtaatgtactcctgacctctatcgaaccttttggttttcatgaatcgcctgcatttttcctctgtactgtaatactgttgctctcccgtatcctggattctcaagatcctgttttgggctagagtacaaaacctctttttttttccccatgcggttttagtctgttttggatatggcaacatcacatgacttgctatgtaatttatacaattgcatataaaatccctgcattttaagcggagcaat

SEQ ID NO: 1013 - DNA, 1237 bp, Zea mays
atctatcaaaaaccctagcaaagccacctcaactctcctgctggtccggcgcaggctccgctccgttcccccgctgtagttcgagtgttcgacccggcggccggcggcgacgcgctcgtggtttccagcgatgtcggcgcaggcgggtccagggacgtactccccggcggcggccgcaggagacaggcggcgggagaggaaggaggagctgcggcgccacctcgccgaagacgccgactggccgcgggccgacggccgctccttccacgactgccggccagcgtttatgcagacaggaccaactactgctgcatcagggtctgcttatgcagaatttgggaagacaaaggtcattgtatcggtttttggaccaagggaaagtaagaaagcaatgatgtacagtgacgttggtaggctcaattgcaatgtgagctatacaacctttgccactccagtgcgtggacagggagcagacaacaaagagtattcatcgatgcttcataaagctctggaaggcgcagtaatgctgcacacttttccaaagaccactgttgatgtttttgccttggttcttgagtctggtggcagtgatcttcccatcattatatcatgcgctagtcttgcattggcagatgctggaatcatgatgtatgaccttgttacatctgtatccgtgtcctgtttcagaaagaacatcatcatcgatccaacctcagacgaggaagcatggcaagacggaagccttgtggtggctttcatgccagcccgcaaggagatcacgcagctcacgctcactggagagtggagcgatggcagaataaccaatgcagtagagctctgtatggatgcttgcagcaagctgggtgacatattgcgtgaccgcttgaaagataccgctaccttgacgtgtgaatgacgtgttagagagagcactggcaacaacagatgttcttagctgtacaaattctgtaggcaggggaggctgatcggcctgatgtttgagtgagcatgatgcatggttatgatgatggtctccttcacggcaaaagctgtcaaaccgggaagaaattgcagggcagtgtgtatttggcatgtaacgtacttctgactgacctttgccttcatgtagcatctgtatctttctttttccgcgtactgtaacacttcttactctaccaggagctggaatttttttggttcgggtgaaaaaacattttgctgctctcagcttttcacc

SEQ ID NO: 1014 - DNA, 1209 bp, Sorghum bicolor
ctccagcagtccggcgcagcttccgttcccccgccgtagttcgaccaggcggccggagcgcgacgcgctcgtggtttgcagcatgtcggcgcaggcgggtacagggacgtactccccggcggtggccgcaggggacaagcggcgggagaggaaggaggagctgcggcgccacctcgtcgaggacgccgactggccccgggccgacggccgctccttccacgactgccggccagcgtttatgcagacaggaccaactactgctgcatcagggtctgcttatgcggaatttgggaagacaaaggtcattgtatcggtgtttggaccaagggaaagtaaaaaagcaatgatgtacagtgatattggtaggctcaattgcaatgttagctatacaacctttgccactccagtgcgtggacagggagcagacaacaaagagtactcatcaatgctttataaagctttggaaggcgcagtaatgctacacacttttccaaagaccactgttgatgtttttgccttggttcttgagtctggcggcagtgatcttcccatcattatatcatgcgctagtcttgcactggcagatgctggaatcatgatgtatgaccttgttacatctgtatccgtgtcctgttttggtaagaacatcatcatcgacccaacctcagacgaggaagcatggcaagatggaagccttgtggttgctttcatgccagcccgcaaggagatcacacaactcacgctcaccggagagtggagtgatggcagaataaccaatgcagtagagctctgtatggatgcttgcagtaagctcggtgacatattgcgtgaccacttgaaagataccgccaccttgacgagtgaatgatgtggcagagacaacacttgcaacaacagatatccttagctgtacaaaatctgtaggcaagggaggcttgttggcctgatgtttgagtaagcatgcatggttgtctccttcatggcaaaagggtgaactgtcaagctggggagaaattgcagggcagtgtgtatttgccatgtaacatctcctgacttctgacctttagcttcatgtagcatctgtatcttgcttttttctgcttactgtaatattccttgctctacaatgacctgcattcttttgatactgcccttaatttttggttcgagtgagaaaaacattttgagccgctctgagatttttaccca

SEQ ID NO: 1015 - DNA, 969 bp, Triticum aestivum
acccacgacgcagctgccgctagaggtacagaacaatggcggccgccgcaggcgacggcggcagcgtcccgccgaagaccccaatagcggaggcgcctcccgcttctcgtccgcacgtgacccgcaatgccatgccgtgggagaggtgcgtcgccggcgtccaattggctctcaaagatccgaaggtggtgttcctgagggagcagatcgagaaagccgggtgcaccgtatggccgacgtttttccgggcggccatctgcacgtccagcgggaactacgcaagcggcgtcggggtacaagtttgctgtaatcacatgcgaaggcaagatgagataactcaggtcataattcatgagttagtacatgtttatgatgactgtgttgtcaagaacatcgactggaaaaactgcgctcaccaggcttgctctgagattcgagctaatcatcttagtggcaattgccattacaaacgtgaactgatgaaaggcttcctgaagataaaggggcatgagccagaatgtgtcaaaagacgtgcactgctttctgtcaagaacaacccgcactgttcagaaaaagctgcagaagctgcagttgagaaggtgtgggatatgtgctacaacgacccacgcccgtttgataaggctctatgaagtgaaagctgccagggcagttttgttaactttcagacgggttctatgaagtgtatcctgtgggacagtctagtttctcttcagacgggctccatgaagtacagtacttagcaaagcgttgcaacaaaatctggaaatttggtgctggagcaaaactttgaatgccatgatattagtccagacaatctaacagattattccatgtaattcaattgttttacatggcatatagggacagctgactgagctctaaataagagtggctgtgaatgattaattctttataccagctaagtattacttaagaaaaaaaaaaaaa

SEQ ID NO: 1016 - DNA, 975 bp, Triticum aestivum
tgccgctagaggtacagaacaatggcggccgccgcaggcgacggcggcagcgtcccgccgaagaccccaatagcggaggcgcctcccgcttctcgtccgcacgtgacccgcaatgccatgccgtgggagaggtgcgtcgccggcgtccaattggctctcaaagatccgaaggtggtgttcctgagggagcagatcgagaaagccgggtgcaccgtatggccgacgtttttccgggcggccatctgcacgtccagcgggaactacgcaagcggcgtcggggtacaagtttgctgtaatcacatgcgaaggcaagatgagataactcaggtcataattcatgagttagtacatgtttatgatgactgtgttgtcaagaacatcgactggaaaaactgcgctcaccaggcttgctctgagattcgagctaatcatcttagtggcaattgccattacaaacgtgaactgatgaaaggcttcctgaagataaaggggcatgagccagaatgtgtcaaaagacgtgcactgctttctgtcaagaacaacccgcactgttcagaaaaagctgcagaagctgcagttgagaaggtgtgggatatgtgctacaacgacccacgcccgtttgataaggctctatgaagtgaaagctgccagggcagttttgttaactttcagacgggttctatgaagtgtatcctgtgggacagtctagtttctcttcagacgggctccatgaagtacagtacttagcaaagcgttgcaacaaaatctggaaatttggtgctggagcaaaactttgaatgccatgatattagtccagacaatctaacagattattccatgtaattcaattgttttacatggcatatagggacagctgactgagctctaaataagagtggctgtgaatgattaattctttataccagctaagtattgcttaagatgttcccttttttctccctttcaaaaaaaaaa

SEQ ID NO: 1017 - DNA, 1031 bp, Triticum aestivum
ggaacccacgacgcagctgccgccagaggtacagaacaatggcggccgccgcaggcgacggcggcagcgtcccgccgaagaccccaatagcggaggcgcctcccgcttctcggccgcacgtgacccgcaatgccatgccgtggcagaaatgcgtcgccggcgttcaattggctctcaaagatccgaaggtggtgttcctgagggagcagatcgagaaagccgggtgcaccgtatggccgacgcttttccgggcggccatctgcacgtccagcgggaactacgcaagcggcgtgggggtacaagtttgctgtaatcacatgcgaaggcaagatgagataaatcaggtcataattcatgagttagtacatgcttatgatgactgtgttgtcaagaacatcgactggaaaaactgcgctcaccaggcttgctctgagattcgagctaatcatcttagtggcaattgccattacaaacgtgaactgatgaaaggcttcctgaagataaaggggcatgagccagaatgtgtcaaaagacgtgcgctgctttctgtcaagaacaacccgcactgttcagaaaaggctgcagaagctgcagttgagaaggtgtgggatatgtgctacaacgacccacgcccgtttgataaggctctatgaagtgaaagctgccagggcagttttgttaactttcagccgggttctatcaagtgtatcctgtgggacagtctagtctctcttcagacgggctccatgaagtacttagcaaagcgttgcaacaaaatctggaaatttggtgctggagcaaaactttgaatgccatgacattagtccagacaatctaacagattattccatgtaatgcaattgttttacatggcatatagtgacagctgactgagctataaataagagtggctgtgaatgattaattctttataccagctaaatattacttaagatattcccttttttctaaaaaaaaaaaaaaaaaaaaaaaaaaaaaaaaaaaaaaaaaaaaaaaaaaaaaaaaaaaaa

SEQ ID NO: 1018 - DNA, 942 bp, Triticum aestivum
gacccacgctgccgcgatgggagcacgaggacactgacacgatgaaggagtagaaacggtacccacgacgcagctgccgccagaggtacagaccaatggcggccgccgcaggcgacggcggcagcgtcccgccgaagaccccaatagcggagtcgcctcccgcttctcgtccgcacgtgacccgcaatgccatgccgtgggagaagtgcgtcgccggcgttcaattggctctcaaagacccgaaggtggtgttcctgagggagcagatcgagaaagccgggtgcaccgtatggccgacgcttttccgggcggccatctgcaggagcggcgggaactacgcaagcggcatgggggtagtagtttgctgtaatcacatgcgaaggcaagatgagataactcaggtcataattcatgagttagtacatgcttatgatgactgtgttgtcaagaacatcgactggaaaaactgcgctgaccacgcttgctctgagattcgagctaatcatcttagtggcgattgccattacaaacgtgaactgatgaaaggcttcctgaagataaaggggcatgagccagaatgtgtcaaaagacgtgcgctgctttctgtcaaggtgaacccgcactgttcagaaaaagatgcagaagctgcagttgagaaggtgtgggatatgtgctacaacgacccacgcccgtttgataaggctctatgaagtgaaagctggtagggcagttttgttaactctcagacgggttctatcaagtgtatcctgtgggacagtctagtttcccttcagacgggctccatgtaagtacttcagcaaagcgttgcaacaaaatctggaaatttggtgctggggcaaaactttgaatgtcatgatattagtccagacaatctaacagattattccatgtaatccaattgttttacatggcatatagtga

SEQ ID NO: 1019 - DNA, 913 bp, Triticum aestivum
  misc_feature (885)..(886): n is a, c, g, or t
ggtacccacgacgcagctgccgccagaggtacagaccaatggcggccgccgcaggcgacggcggcagcgtcccgccgaagaccccaatagcggagtcgcctcccgcttctcgtccgcacgtgacccgcaatgccatgccgtgggagaagtgcgtcgccggcgttcaattggctctcaaagacccgaaggtggtgttcctgagggagcagatcgagaaagccgggtgcaccgtatggccgacgcttttccgggcggccatctgcaggagcggcgggaactacgcaagcggcatgggggtagtagtttgctgtaatcacatgcgaaggcaagatgagataactcaggtcataattcatgagttagtacatgcttatgatgactgtgttgtcaagaacatcgactggaaaaactgcgctgaccacgcttgctctgagattcgagctaatcatcttagtggcgattgccattacaaacgtgaactgatgaaaggcttcctgaagataaaggggcatgagccagaatgtgtcaaaagacgtgcgctgctttctgtcaaggtgaacccgcactgttcagaaaaagatgcagaagctgcagttgagaaggtgtgggatatgtgctacaacgacccacgcccgtttgataaggctctatgaagtgaaagctggtagggcagttttgttaactctcagacgggttctatcaagtgtatcctgtgggacagtctagtttcccttcagacgggctccatgtaagtacttcagcaaagcgttgcaacaaaatctggaaatttggtgctggggcaaaactttgaatgtcatgatattagtccagacaatctaacagattattccatgtaatccaattgttttacatggcatatagtgnnagttctctgagctctaaataagagtgg

SEQ ID NO: 1020 - DNA, 1149 bp, Triticum aestivum
gagccgccttcgccccctcgccgacctcgagagctatcatcccacggaccagccgccgccgccgccgtcgagcactcgagcgccgcggagaccacaactggtcctagggtttcgattcaagcaggatggggaagtcgaagagcaagggcgccaagttcgccgccgtcaagaagatcatcagcaagaagaccatcaagaagtacaaggaggaggtgctggacccccggaagaaggacaccgagaaggagaagctcggccggaatgtgccgcaggtgtcgtcggcgctcttcttcagctacaacatggcgctcgggccgccctaccgggttattgttgacaccaacttcatcaatttctccatccagaacaagttggatttggagaaaggaatgatggactgcctttatgcaaaatgtaccccctgcatcactgattgtgttatggccgagcttgaaaagttaggacaaaaatatcgtgtggctttgagaattgctaaggatcctaggttccagaggctggcgtgcacacacaaaggaacttatgctgatgactgtatcgttgagagaattactcagcacaaatgctacattgttgccacttgcgatagagatttaaagaggagaataagaaaggttcctggtgttccaatcatgtatatcacccaacacaggtactcaatagaacgactccctgaagccacaattggtggagcaccaagaatctaattagccatgcgatggtaccaaacgccatcacacttgcccaggttccttgatttaggatggatatgagtactgctatgctgaaccaagctgattgtaaccacttcaaaatcgtgtaccaacctccttaggggcatcgttttcataaattttggaagaaactttagaagaaagtgtatcgttgtcctctgttttgaactgaactgtagccaacttcccagcttgcttggtgttgttaatgttgcagactctagaatatattttatgtaatatgtaagtgttgtcatatggttcagtgctttggcatgcttctggttcattgcactcagttgccaagccaacatattgttctgggtcttggattttgtaaactatctgttctgaaaggaaatgagctcagtgtactcgtaaaaaaaaaaaaaaacga

SEQ ID NO: 1021 - DNA, 1116 bp, Triticum aestivum
cgccccctcgccgacctcgagagctatcatcccacggaccagccgccgccgccgccgtcgagcactcgagcgccgcggagaccacaactggtcctagggtttcgattcaagcaggatggggaagtcgaagagcaagggcgccaagttcgccgccgtcaagaagatcatcagcaagaagaccatcaagaagtacaaggaggaggtgctggacccccggaagaaggacaccgagaaggagaagctcggccggaatgtgccgcaggtgtcgtcggcgctcttcttcagctacaacatggcgctcgggccgccctaccgggttattgttgacaccaacttcatcaatttctccatccagaacaagttggatttggagaaaggaatgatggactgcctttatgcaaaatgtaccccctgcatcactgattgtgttatggccgagcttgaaaagttaggacaaaaatatcgtgtggctttgagaattgctaaggatcctaggttccagaggctggcgtgcacacacaaaggaacttatgctgatgactgtatcgttgagagaattactcagcacaaatgctacattgttgccacttgcgatagagatttaaagaggagaataagaaaggttcctggtgttccaatcatgtatatcacccaacacaggtactcaatagaacgactccctgaagccacaattggtggagcaccaagaatctaattagccatgcgatggtaccaaacgccatcacacttgcccaggttccttgatttaggatggatatgagtactgctatgctgaaccaagctgattgtaaccacttcaaaatcgtgtaccaacctccttaggggcatcgttttcataaattttggaagaaactttagaagaaagtgtatcgttgtcctctgttttgaactgaactgtagccaacttcccagcttgcttggtgttgttaatgttgcagactctagaatatattttatgtaatatgtaagtgttgtcatatggttcagtgctttggcatgcttctggttcattgcactcagttgccaagccaacatattgttctgggtcttggattttgtaaactatctgttctgaaaggaaatgagctcagtgta

SEQ ID NO: 1022 - DNA, 1106 bp, Leymus cinereus x Leymus triticoides
  misc_feature (38)..(39): n is a, c, g, or t
  misc_feature (43)..(44): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (53)..(53): n is a, c, g, or t
  misc_feature (58)..(58): n is a, c, g, or t
  misc_feature (61)..(61): n is a, c, g, or t
  misc_feature (290)..(290): n is a, c, g, or t
  misc_feature (293)..(293): n is a, c, g, or t
  misc_feature (419)..(419): n is a, c, g, or t
  misc_feature (973)..(973): n is a, c, g, or t
cacacggagccgccgccgccgccgccgtcgagcactcnngcgnngcngngngngcgtngcnggctgcggccggtgctagggcttcggttcgaggcaggatggggaagtcgaagagcaagggcgccaagttcgccgccgtcaagaagatcatcagcaagaagaccatcaagaagtacaaggacgaggtgctggaccctcggaagaaggacaccgagaaggagaagctcggccggaatgtgccgcaggtgtcgtcggcgctgttcttcagctacaacatggcgctcgggccnccntaccgggttatcgtcgacaccaacttcatcaatttctccatccagaacaagttggatttggagaaaggaatgatggactgcctctatgcaaaatgtaccccctgcatcactgattgtgttatggcngagcttgaaaagttaggacaaaaatatcgtgtggctttgagaattgctaaggaccctaggttccagagactagcatgcacacacaagggaacttatgctgatgactgtatcgttgagagaattactcagcacaaatgctacattgttgccacttgcgatagagatttaaaaaggagaataagaaaggttcctggtgttccaatcatgtatatcacccaacacaggtactcgatagaacgactccctgaagccacaattggtggagcaccaagaatctgattagccatgcgcttgtaccaaacaccatcacacttgcccaagttccttgatttaggatggatatgagtactgccgtgctgaatcgagctgattgtaaccacttcaaaattgcgtaccaacctccttagggcatcgttttcataaattttgaaagaaactttagaagaagtgtatggttgtcctttgttttgaactgaactgtagccaacttcccagcttgcttggtgttgttaatgttgcagtcaagaatatattttatgtaatatttaagtatngtcatatggttcaatgctttggcatgcttctggttcattgcactaaattgccaagccaacatatgtgccgtgttctggattttgtaaaccatctgttctgaaatgaaatgagctcagtgtagagtgcaatgca

SEQ ID NO: 1023 - DNA, 1053 bp, Triticum aestivum
gccccctcgccgacctcgggagccatcatccacggacccgccgccgccgtcgagcactcgagcgcagcggagcggaccacagccggtgctagggcttcggttcgagggaggatggggaagtcgaagagcaagggcgccaagttcgccgccgtgaagaagatcatcagcaagaagaccatcaagaagtacaaggacgaggtgctggacccgcggaagaagcacaccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttggatttggagaaaggaatgatggactgcctttatgcaaaatgtaccccctgcatcactgattgtgttatggctgagcttgaaaagctaggacaaaaataccgtgtcgcgttgagaattgctaaggaccctaggttccagagattagcgtgcacacacaagggaacttatgctgatgactgtattgttgagagaattactcagcacaaatgctacattgttgccacctgcgatagagatttaaagaggagaataagaaaggttcctggtgttccaatcatgtacatcacccaacacaggtactcgatagaacgactccctgaagctacaattggtggagcaccaagaatctgattagccatgcgctggtaccaaacaccatcacagttgcccagattccttgatttaggatggatatgagtactgccgtgctgaatcgagctgattgtaaccacttcaaaattgtgtaccaacctcctcagggcattgttttcataaattttggaagagactttagaagaaagtgtatcgttgtcctttgttttgaactgaactgtagcctacttcccagcttgcttggtgttgttaatgctgcagattcgaggatatattttatgtaatatgtaagtgttgtcatatggtccaatgctttggcatgcttctggatcattgcactcagttgccaagccaacatat

SEQ ID NO: 1024 - DNA, 1054 bp, Triticum aestivum
ggccccctcgccgacctcgggagccatcatccacggacccgccgccgccgtcgagcactcgagcgcagcggagcggaccacagccggtgctagggcttcggttcgagggaggatggggaagtcgaagagcaagggcgccaagttcgccgccgtgaagaagatcatcagcaagaagaccatcaagaagtacaaggacgaggtgctggacccgcggaagaagcacaccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttggatttggagaaaggaatgatggactgcctttatgcaaaatgtaccccttgcatcactgattgtgttatggctgagcttgaaaagctaggacaaaaataccgtgtcgcgttgagaattgctaaggaccctaggttccagagattagcgtgcacacacaagggaacttatgctgatgactgtattgttgagagaattactcagcacaaatgctacattgttgccacctgcgatagagatttaaagaggagaataagaaaggttcctggtgttccaatcatgtacatcacccaacacaggtactcgatagaacgactccctgaagctacaattggtggagcaccaagaatctgattagccatgcgctggtaccaaacaccatcacagttgcccagattccttgatttaggatggatatgagtactgccgtgctgaatcgagctgattgtaaccacttcaaaattgtgtaccaacctcctcagggcattgttttcataaattttggaagagactttagaagaaagtgtatcgttgtcctttgttttgaactgaactgtagcctacttcccagcttgcttggtgttgttaatgctgcagattcgaggatatattttatgtaatatgtaagtgttgtcatatggttcaatgcttttgcatgcttctggttcattgcactcagttgccaagccaacatat

SEQ ID NO: 1025 - DNA, 1137 bp, Avena sativa
ggccgccctcccctccctcggccaccttgcccgccggccagacaacttctccagtcgaagctgctgggttcgattcgccttcttcgccacaaaattcgaatcgcagccactgggttctagtcgcttaccccgctcgagccgccgccgccgcctacttagccgggagccctgagttgaggatggggaaggcgaagagcaaaggcgccaagttcgccgccgtgaagaagatcatcagcaagaaaaccatcaaaaagtacaaggatgaggtgctggaccccaggaagaaagatgccgagaaggaaaagctcgggcggaatgtgccgcaggtctcgtcggcgttgttcttcagctacaacatggcgctcgggccgccataccgggttattgtggacaccaacttcatcaatttctccatccagaacaagttggatttggagaaaggaatgatggactgcctttatgcaaaatgtaccccgtgtatcactgactgtgttatggctgagcttgaaaagctaggacaaaaatatcgtgtggctttgagaattgctaaggaccccaggttccagagattagcatgcacacacaagggaacatatgctgatgactgtatcgttgatagaattactcagcacaaatgctacatcgtcgccacttgtgatagagatttaaagaggagaataagaaaggttcccggtgtcccaatcatgtatatcacgcaacacaggtactcgatagaacgactccccgaagccacaattggtggagcaccaagaatctgatttgcccagatgcagagaagttggcgaacatgtctcaccgtcgcacttgttgcccaagatcctggatttaggatggctaagcatagagttgggctgagttgagctatttgtagccatttcaaaattttgtaccaatctcgtcaggatattattttcccatgaactttttaagaaactttatcaaaggacctgtttagttttctttcgtcttaaactgcagtgtagccaacttcccagctttcttgatggtgttgatgtttgtgttgagttgtggaactaaaaaatatgtgatatgtaagaggtccctatgtaatatgtacgtgggcatggttattatatggttcaatactttggcatc

SEQ ID NO: 1026 - DNA, 1043 bp, Avena sativa
tctcgccgtcgccgacctggagagctatcattacacggagccgccaccgccaccgccgccgtcgagtgcagtggagagcgcgtagaggctgcagctggtcctaccgtcctaggcttcgatttgacgatggggaaggccaagagcaagggcgccaagttcgcggccgtcaagaaaatcatcagcaagaagaccatcaagaagtacaaggaggaggtgctggaccctaggaagaaggacgccgaggcggagaagctcggccggaatgtgccgcaggtctcctctgcactgttcttcagctacaacatggcgctgggtccgccttaccgggttattgtcgacaccaacttcatcaatttctccatccagaataagttggatttggagaaaggaatgatggactgcctttatgcaaaatgtaccccttgtataactgactgtgttatggctgagcttgaaaagttgggacaaaaatatcgtgtggctttgagaattgctaaggaccctaggttccaaagattagcatgcacacacaagggaacttatgctgatgactgcatcgtggacaggattactcagcacaagtgttacattgttgccacttgtgatagagatttaaagaggagaataagaaaggttcctggtgttcccatcatgtacatcacccaacacaggtactcgatagaacggcttcctgaagcaacaatcggtggagcaccgaggatctgattcgcccatatacagagaagttgcggaacatgtttcactgtcgcacttgcccaagctcctgggcttaagacggataagaatactgctgtgctgagctgagtttagttgttactttaaaactttagaacagactttacaagagggcatgtttacttgttcaatgagggcgatgtatatcttgcagtcatcaagaatttctggattgttctccgctatgatcttttggagcgtattgagcagtcaaattagtaacatggtcttgtgtggtcaaatgacagtgctctttgaaacatgttcaaacagcggaccagctaggc

SEQ ID NO: 1027 - DNA, 1024 bp, Triticum aestivum
  misc_feature (13)..(13): n is a, c, g, or t
  misc_feature (761)..(761): n is a, c, g, or t
ccacggacccgcngccgccgccgtcgagcactcgagcgcagcggagcggaccgcagccggtggtagggcgtcgagtcgagggaggatggggaagtcgaagagcaagggcgccaagttcgccgccgtcaagaagatcatcagcaagaagaccatccagaagtacaaggaagatgtgctggacccgcggaagaaggacaccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttggatttggagaaaggaatgatggattgcctttatgcaaaatgtaccccttgcatcactgattgtgttatggctgagcttgaaaagttaggacaaaaatatcgtgtggctttgagaattgctaaggaccctaggttccagagattagcgtgcacacacaagggaacttatgctgatgactgtattgttgagagaattactcagcacaaatgctacattgttgccacctgcgatagagatttaaagaggagaataagaaaggttcctggtgtgccaatcatgtatatcacccaacacaggtactcgatagaacgactccctgaagctacaattggtggagcaccaagaatctgattagccctgagatggtaccaaacaccatcacacttgcccaggttccttgatttaggatggatacgagtactgccgngctgaatcgaactgattgtaaccacttcaaaattgtgtaccagcctcctcagggcgtcgttttcataaattttgaaagaaactttagaagaaagtgtatggttgtcctttgttctgaactgaactatagccaacttcccagcttgctttgtgttgttaatgatgcagagtcaagaatatattttatgtaatatgtaagtgttgtcatatggttcaatgcttttgcatgcttctggttcattgcactcagttgccaagccaaca

SEQ ID NO: 1028 - DNA, 1071 bp, Brachypodium distachyon
gcaaacccttccccagaccccagcccctctcgcgcgcgccgacctcgagagctattacaaggaggcgccgccgtgcagtgaaaagcgcgtcgcggctgcagcacgtgctaggcttcgatttgaggatggggagggcgaagagcaagggccccaagttcgccgccgtcaagaagatgatcagcaagaagaccatcaagaagtacaaggatgaggtgcttgaccctaggaagaaggataccgagaaggagaagctcggccggaacgtgccgcaggtttcctcggcgctcttcttcagctacaacatggcgctcgggccgccatatcgggttattgtcgacaccaacttcatcaatttctccatccagaacaagttggatttagagaaaggaatgatggactgcctttatgcaaaatgtaccccttgtatcactgactgtgttatggctgagcttgaaaagctaggacaaaaatatcgtgtggctttgagaattgctaaggatcctaggttccaaagattagcatgcacacacaagggaacttatgctgatgactgtatcgttgagagaattactcagcacaaatgttacattgttgccacttgcgatagagatttaaagaggagaataagaaaggttcctggtgttccaatcatgtacattacccaacacaggtactcgatagagcgactccctgaagcgacaattggcggagcaccaagaatctgatttccggatgcagagaagttggggaaacatttctcactatcacacttgccaaaggtcctgagcagggatggataagaatactgttgtgctgagttgagctaattgtaatcacttcaaagttttgtactaaccttatcaggttatcatgtttcatcatttataagaggatctgtttagttgtcctaagttggaactccagtgtagccaacatcccagcttcttggttgtgttgatgatgtggacttgcagactttcagtaatagttcacatgtaatatgcaagtcttgttacattgttcaatcctttgctcatgcttgattacagagtatcctgtcccttcattgtt

SEQ ID NO: 1029 - DNA, 1084 bp, Setaria italica
cgcaaagccgcaagcccgcaaaccctttctcgctcgccgtcttcgagaggcatcagagggagccgccgccgccgccgtcgccgccgagagcgaggtacccgcggttgttagggtttgggtctcgatggggaggtcaaagagcaaggggcccaagttcgcggcggtgaagaagatcatcagcaagaagactatcaacaagtacaagcaggatgtgctgaaccacaataagaaggacgccgagaaggagaagctcggccggaatgtgccgcaagtttcgtcggctctgttcttcagctacaacactgcgctggggccgccttatcgggtgattgtggacaccaacttcatcaacttttccatccagaacaagctggatttggagaaaggaatgatggactgcctttatgcaaaatgcaccccgtgtatcactgactgtgttatggctgagcttgaaaagctgggacagaagtatcgcgtggccttgagaattgccaaggaccctaggttccaaagattagcatgcacacacaaggggacttatgctgatgactgcattgtggatagggttactcagcacaaatgctacattgttgctacatgtgatagagatttgaaaaggaggataaggaaggttcctggtgttccaatcatgtatattacacaacacaggtactcgatagaacggcttcctgaagctaccattggtggagcaccaagaatctgatgagcacaaacataagaagatggcgaacttcactgtcgcactcatgcttgcccatgttgtcacagtttttgcctggagctgccgcttggaccaagtcatggacaagaatgccggtgtgccatgttgagccagctgtaacaacttacaaaattttgtaccggcccatgatgttactatttgctgtcgaaatgtaatagtttctgtttacaatcttgaccagagtaatttgctggaggttcagtttccaccgttggtttggcagcccagctgtatttgtttgtgctgtaggctgtagctttctacatgttcaatctgagctcaacatatgatctgattcttcagaactaacctgtttggaaa

SEQ ID NO: 1030 - DNA, 1047 bp, Pennisetum glaucum
gaggtcgaagagcaagggccccataaagacccaaaccctttctccttcgctcgccgtcttcgagaggcatcggagggagccgccgccgccaccgccgccgccgccgcgtgcagtaacgagagccaggtacacgcacttattagggtttgggtctttatggggaggtcgaagagcaagggccccaagttcgcggcggtgaagaagatcatcaccaagaagaccatcaacaagtacaagcaggatgtgctgaaccccaataagaaggacgccgagaaggagaagctcggccggaatgtgccgcaggtttcgtcggctctgttcttcagctacaacacggcactcgggccgccttatcgggtgattgtggacaccaacttcatcaacttctccattcagaacaagctggatttggagaaaggaatgatggactgcctttatgcaaaatgcaccccgtgtatcactgactgtgttatggccgagcttgagaagctgggacagaagtatcgtgtggccttaagaattgccaaggaccctaggttcaaaagattagcatgcacacacaagggaacttatgctgatgactgcattgtggagagggttactcagcacaaatgctacattgttgctacatgtgatagagatttgaaaaggaggataaggaaggttcctggtgttccaatcatgtatattacacggcacaggtactcaatagaacggcttcctgaagccacaattggtggagcgccaagaatctgatgagctcgaacataagaagatggcgaacttcactgtcgcactcctgcttgcccctgttgtcacaagatgcctggagctgccgtttggaccaagtcatggacaagaatgcccgtgtgccttgttgagctagctgtaacaacttacaaaattctgtaccggcccatgatatttgttatcgaaatgtaacagtttctgtttaaaatcttgaccagagtgatttactggaggttgaagtttcaccgttggcttggttgcccagctgtatttgttggtgctgtagtctaacatgtt

SEQ ID NO: 1031 - DNA, 1221 bp, Oryza sativa
cactctcctcgaacgcgcgacgccgccgccagagtctccggctcgccgcacttcccgcctcgccgtcgccgtcgccgtcgccgtcgcccctcccgccggtaggagaaggtagctcggcgcctcggtgacttggcgtcgcgctctgcgcccctgccgctctcggtcggtaggctctcgtctcacgcggccccttccaccgcttcacgccgccggcagtgagcagtcagctgcgaggacccgctccaccgagagagctaacgccgccgccgcccgcggtgcgcgtagtgctcgagactgctgctggtgttgatagtgttatctgggatttttagtctgaggatggggagggcgaagagcaagggccctaagttcgccgccgtcaagaagatcatcaccaagaagaccatccagaagtacaaggaggatgtgttgaaccccaagaagaaggataacgagaaggagaagctcgggcggaatgtgcctcaggtctcttcggcgctgttcttcagctacaacacagcgctcgggccgccataccgggttattgtggatacaaacttcatcaatttctccatccagaacaagttggatttggagaaaggaatgatggactgcctttatgcaaaatgcacaccatgtatcacggattgtgttatggcggagcttgaaaagctgggacaaaagtatcgtgtagcattgagaattgcaaaggaccctaggttccagagattagcatgcacacacaagggaacttatgctgatgactgtatcgtagagagggttactcagcacaagtgctacatcgtcgcaacatgtgatagagatttgaaaaggaggataagaaaggttcctggtgttccaatcatgtatatcactcggcacaggtactcgatagaacgactccctgaagctacaatcggaggagcaccaagaatctgatcggcacggacataaaaaatggggaatgtttcactgttcaacttgctggccaagaatactgctgtagtagccttttgaaacaaatgctgtagtgagctgtgctaattgtaaccacttcaaagttttgtaccaacctcatgaggatattactgttatcgagatccaagagatgtgtttgcttccttcttcgtgtgtctatgccatttgaatgaggatattactggaaggaagcaaagttttgaatttacttgttatgaaagagaaggcgctatcttttgctga

SEQ ID NO: 1032 - DNA, 937 bp, Zea mays
ccgccgacctctcgacagcattagacgcaggcgccgccgactgccgtggagagcgcgaggtagctgcgggtgctagggtttggctcgagatggggaaggcaaagagcaagggccctaaattcgcggcggtgaagaagattatcaccaagaaaaccatcaataagtacaaggaggatgtgctgaaccacaagaagaaggacgcggacaaggagaaactcggccggaatgtgccgcaggtttcgtcggcgttgttcttcagctacaacacagcattggggccgccgtatcgggtgattgtggataccaacttcatcaatttctcgatacagaataagctggatttggagaagggaatgatggattgcctttatgcaaaatgtaccccatgtatcacggactgtgttatggctgagcttgaaaagctggggcagaagtatcgtgtggccttgagaattgccaaggaccctaggttccaaatattagcatgcacacacaagggaacctatgctgatgactgcattgtggagagggtcactcaacacaaatgctacatagttgctacttgtgatagagatttgaaaaggaggataagaaaggttcctggtgttccaatcatgtacatcacaagacataggtattcgatagaacggctccctgaggccacaattggtggagcaccaagaatctgatcggtgcagacatgagatgttctgggatgtaatactgtggcggtacttgtccatctgaccaagtcactgtttcatgtttgaagccacggcaaggactaggataagaatgctgctttgtaggttgagcttactgtaactactaagaaatttttattatgtaccaaccttatcatttctacaatgttgcgggatgtctgaagtaattctttgttaaaagatcgggtatcctgctcccttttgcttctcaa

SEQ ID NO: 1033 - DNA, 1492 bp, Zea mays
agtctgcagccagtagcacgagcaccggagcacgagattgttttctccaatggcggagccgcggagcagtggagcaagaccgagcgaccggccaacgcccaatgggccaagcaggaaggagaggcaggaagcagcaagccagagatggaggccaccgcggccgcggacggacaagcaggcggtcggccggccaggtgaggagcgtgctgcggcggctgtgctgcgcgtgcctgttgttggactgaatacctaggttttgctctttactgggccgatttaaggtatggcgcgggccatacttggccataacgggccctccgcccctgtccctccctcctccagtcctccggatcaggccgtcaacaaacgaggacagcagtcagcagcactctcacatccaacggcccagacggcgagcaacacaaacccaacgaatcaaattcgactacttgggccgtgttgggcaataaaagcccaacttatcaaaccagagcgagcccaccaagcagccgccttcttcctttgcagaggcggaaacccgaaaacccttcctcttccgccgacctctcgacagcattagacgcaggcgccgccgactgccgtggagagcgcgaggtagctgcgggtgctagggtttggctcgagatggggaaggcaaagagcaagggccctaaattcgcggcggtgaagaagattatcaccaagaaaaccatcaataagtacaaggaggatgtgctgaaccacaagaagaaggacgcggacaaggagaaactcggccggaatgtgccgcaggtttcgtcggcgttgttcttcagctacaacacagcattggggccaccgtatcgggtgattgtggataccaacttcatcaatttctcgatacagaataagctggatttggagaagggaatgatggattgcctttatgcaaaatgtaccccatgtatcacggactgtgttatggctgagcttgaaaagatggggcagaagtatcgtgtggccttgagaattgccaaggaccctaggttccaaagattagcatgcacacacaagggaacctatgctgatgactgcattgtggagagggtcactcagcacaaatgctacatagttgctacttgtgatagagatttgaaaaggaggataagaaaggttcctggtgttccaatcatgtacatcacaagacataggtattcgatagaacggctccctgaggccacaattggtggagcaccaagaatctgatcggtgcagacatgagatgttctgggatgtaatactatggcggtacttgtccatctgaccaagtcactatttcatgtttcagtccacgacaaggactaggataagaacgctgctttctaggttgagcttactgtaactactaagaaatttttattatgtaccaaccttatcatttctacaatgttgcgggatgtctgaagtaattctttgttaaaagatcgggtatcctgctctcttttgcttctca

SEQ ID NO: 1034 - DNA, 1531 bp, Zea mays
agtctgcagccagtagcacgagcaccggagcacgagattgttttctccaatggcggagccgcggagcagtggagcaagaccgagcggccggccaatgcccaatgggccaagcaggaaggagaggcaggaagcagcaagccagagacggaggccaccgcggccgcggacggacaagcaggcggtcggccggccaggtgaggagcgtgctgcggcggctgtgctgcgcgtgcctgttgttggactgaatacctaggttttgctctttactgggccgatttaaggtatggcgcgggccatacttggccataacgggccctccgcccctgtccctccctcctccagtcctccggatcaggccgtcaacgaacgaggacagcagtcagcagcactctcacatccaacggcccagacggcgagcaacacaaacccaacgaatcaaattcgactacttgggccgtgttgggcaataaaagcccaacttatcaaactagagcgggcccaccaagcagccgccttcttcctttgcggaggcggaaacccgaaaacccttcctcttccgccgacctctcgacagcattagacgcaggcgccgccgactgccgtggagagcgcgaggtagctgcgggtgctagggtttggctcgagatggggaaggcaaagagcaagggccctaaattcgcggcggtgaagaagattatcaccaagaaaaccatcaataagtacaaggaggatgtgctgaaccacaagaagaaggacgtggacaaggagaaactcggccggaatgtgccgcaggtttcgtcggcgttgttcttcagctacaacacagcattggggccgccgtatcgggtgattgtggataccaacttcatcaatttctcgatacagaataagctggatttggagaagggaatgatggattgcctttatgcaaaatgtaccccatgtatcacggactgtgttatggctgagcttgaaaagctggggcagaagtatcgtgtggccttgagaattgccaaggaccctaggttccaaagattagcatgcacacacaagggaacctatgctgatgactgcattgtggagagggtcactcagcacaaatgctacatagttgctacttgtgatagagatttgaaaaggaggataagaaaggttcctggtgttccaatcatgtacatcacaagacataggtattcgatagaacggctccctgaggccacaattggtggagcaccaagaatctgatcggtgcagacatgagatgttctgggatgtaatactatggcggtacttgtccatctgaccaagtcactatttcatgtttcagtccacgacaaggactaggataagaacgctgctttctaggttgagcttactgtaactactaagaaatttttattatgtaccaaccttatcatttctacaatgttgcgggatgtctgaagtaattctttgttaaaagatcgggtatcctgctcccttttgcttctcaatcttgtgcgctacaagccataatcccaatagagtggct

SEQ ID NO: 1035 - DNA, 1160 bp, Sorghum bicolor
agccgccttcttccttgcggaggccgaaaaccctctcttccgccgacctctcgagacgcatcagaagtcgccgccgccgccgccgcctgccgactgccgtggagagcgcgagggagctgcgggtgctaaggtttggctcgagatggggaaggcaaagggcaagggccctaaattcgcggcggtgaagaagattatcaccaagaaaaccatcaacaagtacaaggaggatgtgctgaaccacaagaagaaggacgcggacaaggagaagctcggccggaatgtgccgcaggtttcgtcggcgttgttcttcagctacaacacggcgctggggccgccgtaccgggtgatagtggataccaacttcatcaacttctccatacagaataagctggatttggagaagggaatgatggattgcctttatgcaaaatgcaccccgtgtatcactgattgcgttatggctgagcttgaaaaacttggacagaagtatcgtgtggccttgagaatcgccaaggacccaaggttccaaagattagcatgcacacataagggaacttatgctgatgactgcattgtggagagggtcactcagcacaaatgctacatagttgctacttgtgatagagatttgaaaaggaggataagaaaggttcctggcgttccaatcatgtacatcacaagacacaggtattcgattgaacggctccctgaggccacaattggtggagcaccaagaatctaaccagtccatacatgaaatgctgtggaatgtttcactgtggcagcactttgtccatgtgaccaagtcactgtttcatgtctgaagccactgtgcagactgaggaaggataagaatgctgctgtctaggttgagctcactgtaactactaagaaatcttgtaccagcttcaccattttactgttatcatccagatgtaatagcttccgtctacaatgtttctggttgtctgaagtaattcttcgttagaagatcaggcatcctcttcccattcaattgtacggtagaccattttttttttaaaagtactgcagcttgcttctcaatcttgtgctgttgatgctgatgttcaacactttgacattattgttctgaacacggtactggctccttgcatgatcttatagtatttacattgagt

SEQ ID NO: 1036 - DNA, 944 bp, Saccharum officinarum
cggaggcgaaaacccgaaaaccctttctcttccgccgacctctcgcgacccaacagacgaaggcgccgccgccgtctcctgccgcctgccgtggagagcgcgaggtagctgtgggtgctaggttttggctcgagatggggaaggcaaagggcaagggccctaaattcgcggcggtgaagaagattatcaccaagaaaaccatcaacaagtacaaggaggatgtgctgaaccacaagaagaaggacgcggacagggagaagctcggccggaatgtgccgcaggtttcgtcggcgttgttcttcagctacaacacggcactggggccgccgtaccgggtgattgtggataccaacttcatcaacttctccatacagaataagctggatttggagaagggaatgatggattgcctttatgcaaaatgtaccccatgtatcactgactgtgttatggctgaacttgaaaaacttggacagaagtatcgtgtggccttgagaatcgccaaggacccaaggttccaaagattggcatgcacacataagggaacttatgctgatgactgcattgtggagagggtcactcagcataaatgctacatagttgctacttgtgatagagatttgaaaaggaggataagaaaggttcctggtgttccaatcatgtacatcacaagacacaggtattcgatagaacggctccctgaggccacaattggtggagcaccaagaatctgatcagggcagacatgagatgttctggaatgtttcactggggcaacactttgtccatgtgaccaaaacactggttcatgtctgaaaccactgcgtgggctgaagaaggataagaatgctgctgtctagggtgaacccactgtaactactaaaaaaatcttgtaccagcctcaccactttactggtatcatccagatgtaaatagctcccgtt

SEQ ID NO: 1037 - DNA, 972 bp, Cenchrus ciliaris
  misc_feature (521)..(522): n is a, c, g, or t
  misc_feature (526)..(527): n is a, c, g, or t
  misc_feature (529)..(529): n is a, c, g, or t
  misc_feature (551)..(551): n is a, c, g, or t
  misc_feature (553)..(553): n is a, c, g, or t
  misc_feature (565)..(565): n is a, c, g, or t
  misc_feature (678)..(678): n is a, c, g, or t
  misc_feature (732)..(733): n is a, c, g, or t
  misc_feature (735)..(735): n is a, c, g, or t
  misc_feature (737)..(737): n is a, c, g, or t
  misc_feature (748)..(748): n is a, c, g, or t
  misc_feature (750)..(751): n is a, c, g, or t
  misc_feature (753)..(753): n is a, c, g, or t
cttcgagaggcatcggagggcgccgccgccgcgtgcagtaatgagagccaggtacccgcagttattagggtttgggtcttcatggggaggtcgaagagcaagggtcccaagttcgcggcggtgaagaagatcatcaccaagaagaccatcaacaagtacaagcaggatgtgctgaaccccaataagaaggacgccgagaaggagaagctcggccggaatgtgccgcaagtttcgtcggctctgttcttcagctacaacacggcgctcgggccgccttatcgggtgattgtggacaccaacttcatcaacttctccatccagaacaagctggatttggagaaaggaatgatggactgcctttatgcaaaatgcaccccgtgtatcactgactgtgttatggctgagcttgaaaagctgggacagaagtatcgtgtggccttaagaattgccaaggaccctaggttccaaagattagcatgcacacacaagggaacttatgctgatgactgcattgtggaganngttnntnagcacaaatgctacattgttgntncatgtgataganatttgaaaaggaggataaggaaggttcctggtgttccagtcatgtatattacacggcacaggtactcgatagaacggcttcctgaagccacaattggtggagcgccaagaatntaatgagctcaaacataagaagatggcgaacttcactgtcgcactcgtgcttgnncntnttgtaacaggngnntngagctgccgtttggaccaagtcatggacaagaatgcccgtgtgccttgtcaagctagctgtaacaacttacaaaatttttttttttaaaagggggatttgttatcgaaatgtattagtttttgtttaaaatcttgaccatttttttaaggggggaggttcagtttccaccgttggcttgtttttccagctgtatttgttggtgctgtagttctctttca

SEQ ID NO: 1038 - DNA, 1187 bp, Panicum virgatum
ccccccactctcccgtgagtcctgcacccctgcccgtgacggcggcgcatctcgtcctcgcgacggccaccgcgcagagccgcaaaccctttctttcttgctcgccgtcctcgagaggtttcagaaggaggcgccgccgctgaccgtgacgagagcgaggtatccgcggttgttagggtttggctcgagatggggaaggcgaagaacaagggccccaagttcgcggtgatgaaaaagatgatcaccaagaagagtgtcaacaagtacaagaaggatgtgctgaaccccaacaagaaggacgccgagaaggagaagctcggccgcaatgtaccgcaggtctcgtcggctctgttcttcagctacaacacggcactcgggccgccttatcgggtgattgtggacaccaacttcatcaacttctccatccagaacaagctggatttggagaaaggaatgatggactgcctttatgcaaaatgcaccccatgtatcacggactgtgttatggctgagcttgaaaaactgggacagaagtatcgtgtggccttgagaattgccaaggaccctaggttccaaagattagcctgcacacacaagggaacttatgcagatgactgcatcgtggacagggttactcagcacaaatgctacattgttgccacatgtgatagagatttgaaaaggaggataaggaaggttcctggtgttccaatcatgtatattactcgacaccagtactcgatagaacgactccccgaagccacagttggtggagcaccaagaatctaatgagcacatacatgagaagattgtgaatttcactgatgaactagtgcttgttcatgttgtcatagtttttgcctgaagctgctgcttggaccaatgacagaatcatggacaagaatgccgctgtgcttgttgagctagctgtagcaacttataaattttgtcccagtacatgatgttactcttattatcgaaatgtaatagtttctgtttatggtcttgcctgaactttagagtaatgtactactggttcagtttccgctgttggcttggctgcccagttatatctgttggtgctgtagcattcttctgacatgttctgaggctctgagctccaaatatgatctgattctcgaggtctaacctgtttgaaaaaagaaggaaaatttagcataccccac

SEQ ID NO: 1039 - DNA, 1012 bp, Elaeis guineensis
  misc_feature (109)..(110): n is a, c, g, or t
  misc_feature (112)..(112): n is a, c, g, or t
  misc_feature (115)..(116): n is a, c, g, or t
tccgccctctgatcttgccctggtttctttatttagcggcggctctcgtcggcggtctttttgtcggtggtgcgtcgtcctccccttgagctcccaaaccgaacgaggnnanctnnttttagggttttgcagcgatggggaaggcgaagaaaggccccaaattcgccgtcgtgaagaggctcgtgagctccaaaacccttcgaaaatataaggaagaagttctaaacccgaagaagaaagatctcgagaaggacaagcttccccggaacgtgccggccgtttcttcagctctgttcttcaagtataatactgcacttggcccgccttacagggtcatcgtggatactaacttcatcaacttctctatacagaataagttggatttggagaagggaatgatggactgcctctatgcaaaatgtactccttgtatcacaaactgtgttatggctgagcttgaaaaacttggacagaagtatcgtgtggctctaaggattgccaaggactctaggtttgagagactaccctgcacgcataaaggaacttatgctgatgattgcattgttgaaagggtcactcagcacaagtgttacattgttgctacctgtgatagagacttgaaaagaaggatacgcaagattcctggagtgcctatcatgtacattacacagcataaatattcaattgagcggctgccagaagccacaattggtggagctccaagaatttgatggcaagggtactctcagcaagtggagccatctctattttatgtcaggtgccagctgctggttattagttcctttgtttttttttttttttgtatgtcttttctggagggaaaactttgcagtagaattcatactttagcgtctggatattgctgtcttgctgatgtagctaactattttcctgcctgaaatcttagtcgttcataatgtttagatctttcgtatgatttattgacatcaagaagaaaatggagttcataattggcacctttcgtttgact

SEQ ID NO: 1040 - DNA, 1450 bp, Abies balsamea
accctactgcgattcctttaagcaagaacttatggaaataaaaccctaatttgattctttctaactctcgatagctatacctgtttagaattcgagggggaaacagattcattgccttatgcttgaaatccttctacaacacgttatgtatttttcgtaattttttacgccgataggcgttcctttgcggaggctcgttctctggacactgttaccagattcgctgacccctggccggttatgtgtcgatcccaacatcctcccgtttaggtggtgttcaagttttcctgtcctgtgttcgttttgagcttcagcgggacgggccatttaccccgcatctctacagctgccacgcctctttccgcgagacgagctgccatgggttacataggttagtgtcataggtgttgatgttccatatcagcgggaacagagcaacaccggcccagtccttcagtgccagggcattttagttgcatcaaaggtttgaatcagaggcattttcataccagggttctccatcaaacatggggaaatcaaagaagactcctaagtatgccaagatgaaaagtattatcagcgccaaagcaatccgaaaacacaaagaagaggtgcttaatccaaacaagaagaatgcggagaagcagaagctgcctagaaatgtacccaacgtctcttcagcactcttcttcaaatacaacactgcattggggccaccatatcttgttttggttgataccaatttcatcaatttctcaatccaaaataagcttgacttggagaaagcaatgatggactgcctgtatgcaaaatgtactccttgtatcacagattgtgtgatggctgaactcgaaaaactgggacagaagtatcgtgttgctctaagaattgcgaaggatcctcggtttgaaagattgccttgcacacacggaggcacttatgcagatgactgcattgtagaacgtgttacccagcataaatgctatattgtagctacatgtgatcgggatttaaagcgccgaattaggaagattcccggtgtacctattatgtacattacacaacacaagtactccattgaacgtttgccagaagcaaccattggaggcgcaccacgattttagagttgatgcttgacgtcaataaggtgaaatagaacaattccacaagggcttttaagagcactaccattctgcactgatggtctgacaacagtctggacaagatagctcctcagtcaaatgtaatgtcctgaaaacttgaagcacatcttatggattttgttatttctttgtaagtttcagtccaagaatattggaagtatggtaggttattattctaggaatgtttcttttttagattgtattgtcaactaattagtaaaatttcaagcaacaaggtacctaaagcgtacctgtattgtactcaagatgttgatgtggagattacc

SEQ ID NO: 1041 - DNA, 1630 bp, Pinus pinaster
cttgaactagaacatattatgtgggtgtcgggtgtacatttatgaattttatagaaaattatgaattctatagaaaaagagaaaagttagaaaattttgattgttaccatcttaatttaaatttaggttactttataatatttaacagaaatagaatgattactaagagtcaaatcttttaaacttcttttaagctatgtttaaatggtttaatgaattcggagattagataacacgaggttgagataggaagaagccgaatgtgcacacgaattctactcctgctacgagtccctggagtactactatgttcaccgacgtatgacaagaaaaatatcacgagcctccgtcctgtagcaggtgaagggtagggtttcattgatgttgcagatgagacgagaataagatgcttttgtttcaacgtaatccgatgtcttccgcagatttgtagatgagatattgtgccgaaggaggagcgaagaggattaatactgcggtggttcaaacaagcctccaactcacacattcttctcccggacacagaagtccattttctgtacatcatactctctgtagggttcaccatcagacatggggaaatcaaagaagactcctaagtttgccaagatgaaaagtattatcagcgccaaagcgatccggaaatataaggaagaggtgcttaatccaaacaagaaggatgcggagaagcagaagctgcctagaaatgtacctaatgtctcttcagcgctcttcttcaaatacaacacagcattggggccaccgtatcttgttttggttgataccaatttcatcaacttctcgatccaaaataagctcgacttggagaaagcaatgatggactgcctgtatgcaaaatgtactccttgtatcacagactgtgtgatggctgaacttgaaaagctgggacagaagtatcgtgttgctttaagaattgcgaaggatcctcggtttgaaagattgccttgcacacacgaaggcacttatgcagatgactgcattgtagaacgtgttacgcagcataaatgctatattgtagctacatgtgatcgggatttaaagcgtcgaatcaggaagattcctggtgtacctattatgtacattacccaacacaagtactctattgaacgtttgccagaagcaaccattggaggggcgccacgattttagagttgatgcttgatgttagtaaggtgaaatagaacaataccgtaaggtcgtacttttcgagagcactccgactctgcactgatggtcagacaactgtctgaacacgatagctcctgattcagatattaatgtcctgaaaagttgaagaatagtttagtatacggattgttatttctttgtaactcaggccagaatattgaggggtgaggttatcattccaggaatactattttttttgtgttgtcagcagttgaaaaattcaagcggaaggtcctaaagagtatgttatattcaagatgttgatttggagattaccattgccttgatagtaaacagttgatactgcaacaattttgatatttctcttttcccttcagaaagggcatttcatttcacatcatttggtcttttattttaagtaagttttactttaaaacccttt

SEQ ID NO: 1042 - DNA, 1372 bp, Pinus taeda
gagaagtgacggcggggagagggcaacggcggttgactaacagcaacactaccatttcaagagagaataagaccgcccctatctatatatatgcttcggctccggcaacaagactggttcttttgtttctcctccgcagacacgcccccatcagactaagttttcgattagcggctttggtgaatagcgataaaatcgtcaaagtgattgaagcgggtctgttgaggagatagacggaggtaaatcccattatagaggagagtcgtccagaattcaattttcatagtttaattgtactgtgagtgggggttcgacactactcggttgctgctccgatttcctgggttcaccatcaaacatggggaaatcaaagaagactcctaagtttgccaagatgaaaagtattatcagtgccaaagcaatccggaaatataaagaagaggtgcttaatccaaacaagaaggatgcggagaagcagaagctgcctagaaatgtacccaatgtttcttcagcactcttcttcaaatacaacaccgcattggggccgccgtatcttgttttggttgataccaatttcatcaacttctcgatccaaaataagcttgacttggagaaagcaatgatggactgcctatatgcaaaatgtactccctgtatcacagactgtgtgatggctgaactggaaaagctgggacagaagtatcgtgttgctttaagaattgcgaaggatcctcggtttgaaagattgccttgcacacatggaggcacttatgcagatgactgcattgtagaacgtgttacgcagcataaatgctatattgtagctacatgtgatcgggatttaaagcgtcgaattaggaagattcctggtgtacctattatgtacattacccaacacaagtactctattgaacgtttgccagaagcaaccattggaggcgcgccacgattttagagttgatgcttgatgttagtaaggtgaaatagaacaatttcgcaagtccttacttttcgagagcactccgactctgcactgatggtcagacaactgtctgaacaagatagctcctgattcagatattaatgtcctgaaaagttgaagcatagtttagtatacagattgttatatctttgtaattcaggccaagaatattgaaggttgaggttatcattctaggaacgttatttttttgtgttgtcagcagttgaaaaattcaagcagaaagttctaaagagtatattatagtcaagatgttgatttggagattaccattgtcttgatagtaaactgtcgatactacaacaattttgaaatccatatttctctattctcttcccaagggcatttcatttcaaaaaaaaaaaaaaaaaa

SEQ ID NO: 1043 - DNA, 1490 bp, Pinus taeda
cggccgggggtcaaatcgttcaaacggtttaatgaattcggagattagataacacgaggatgagataggaagaagccgaatgtgcacacgaattctactcctgctacgagtccctggagtagtactatgttcaccgacgtatgacaagaagaatatcacgagcctccgtcctgtagattgaagttagacaaaatcgcaagagttttaaaaccagtgtcatatcaattgacagtgatggtcaggtgaagggtagggtttcattgatgatgcagatgagacgagaatatgatgcttttgtttaagcgtaatctgatgtcttccgcagatttgtagacgagatattgtgccgaaggaggagcgaagaagattaatactgtggtggttcaaacaagtctccaactctcacattcttctctcggacacggaagtccattttctgtacatcatactctctgtagggttcaccatcaaacatggggaaatcaaagaagactcctaagtttgccaagatgaaaagtattatcagcgccaaagcgatccggaaatataaggaagaggtgcttaatccaaacaagaaggatgcggagaagcagaagctgcctagaaatgtacctaatgtctcttcagcgctcttcttcaaatacaacaccgcattggggccgccgtatcttgttttggttgataccaatttcatcaacttctcgatccaaaataagctcgacttggagaaagcaatgatggactgcctgtatgcaaaatgtactccttgtatcacagactgtgtgatggctgaacttgaaaagctgggacagaagtatcgtgttgctttaagaattgcgaaggaccctcggtttgaaagattgccttgcacacatggaggcacttatgcagatgactgcattgtagaacgtgttacacagcataaatgctatattgtagctacatgtgatcgggatttaaagcgtcgaatcaggaagattcctggtgtacctattatgtacattacccaacacaagtactctattgaacgtttgccagaagcaaccattggaggggcgccacgattttagagttgatgcttggtgttagtaaggtgaaatagaacaataccgtaaggtcgtacttttcgagagcactccgactctgcactgatggtcagacaactgtctgaacacgatagctcctgattcggatattaatgttctgaaaagttgaagaatagtttagtatacggattgttatttctttgtaactcaggccaagaatattgaggggtgaggttatcataccaggaatgctatttttttgtgtgttgtcagcagttgaaaaattcaagcagaaggtcctaaagagtatgttatagtcaagatgttgatttggagattaccactgccttgatagtaaacagttgatactgcaacaattttgaaatccatatttctcttttctcttcacaaagggcatttcatttcaaaaaaaaaaaaaaaaaa

SEQ ID NO: 1044 - DNA, 964 bp, Pseudotsuga menziesii
cgaacaccaggatagacgctggttgcgagggaaaaggcattttcatatcagggttctccatcaaacatggggaaatcaaagaagactcctaagtttgctaagatgaaaagtattatcagctccaaaacaatcaagaagtacaaagaagaggtgcttaatccaaacaagaagaacgcagaaaagcagaagctgcctagaaacgtaccgaatgtctcttcagcactcttcttcaaacacaacactgcattggggccaccatatcttgttttggttgataccaatttcatcaacttttcaatccaaaataagcttgacttggagaaagcaatgatggactgcctctatgcaaaatgtactccttgtatcacagactgtgtgatggctgaacttgaaaagcttggacagaagtatcgtgttgctttaagaattgcgaaggatcctcggtttgaaagattgccttgcacacatgaaggcacttatgcagatgactgcattgtacagcgtgttacccagcataaatgctatattgtagctacatgtgatcgggatttaaagcgtcgaattaggaagattcctggtgtacctattatgtacattacccaacacaagtactctattgaacgtttaccagaagcaacaatcggaggcgcaccacgattttagagttgatgcttgataaggtgaaatagaacaattttacgagggtgtctcattttcgagagcactcccactctgcactgatgctcagacaacagtctgaacaagatagctcctcgttcagatgttaatgttctgaaaacttgaagcatagcttacggatttctttgtaactctcagtccaaagaatattggaagtgtgagcttattgttccaggaatattcttttatatgtgttgtgagcactttgaaaaattcaagcacaagttcctaaagagtgtattgtactcaagatgttgacttggag

SEQ ID NO: 1045 - DNA, 750 bp, Centaurea maculosa
  misc_feature (354)..(354): n is a, c, g, or t
  misc_feature (399)..(399): n is a, c, g, or t
  misc_feature (438)..(438): n is a, c, g, or t
  misc_feature (456)..(456): n is a, c, g, or t
  misc_feature (535)..(535): n is a, c, g, or t
  misc_feature (537)..(537): n is a, c, g, or t
  misc_feature (540)..(540): n is a, c, g, or t
  misc_feature (561)..(561): n is a, c, g, or t
  misc_feature (570)..(570): n is a, c, g, or t
  misc_feature (585)..(585): n is a, c, g, or t
  misc_feature (665)..(665): n is a, c, g, or t
  misc_feature (670)..(670): n is a, c, g, or t
  misc_feature (710)..(710): n is a, c, g, or t
  misc_feature (717)..(717): n is a, c, g, or t
ataattagggttttagggtttgcaagtgaatcgggttttccagaaagagagatggggagagcgaagaagggtcctaaattcgcagtgatgaagaaacttgcatctcacaaagccatcaaacaacataaagaagaggttttgaaccctaataaaaaagacttaacaaaggagaagctccctagaaatgtaccttatgtttcttctgctctcttctttacctacaacacggctcttggaccgccttatcgagttttggtggataccaacttcatcaatttctccatccaaaataaattggacttggagaagggtatgatggactgcttatatgcaaaatgcactccttgtattacngattgtgtgatggctgaacttgagaagcttggtcagaaatatcgngttgctctcagaattgccaaggatcctagatttgaaagncttccttgcactcacaanggaacttatgctgatgactgcattgttgaaagagttactcagcacaaatgttatatggtagcaacatgtgatagagatntnaancgtaggattcgcaagataccnggtgtgccnattatgtacatcacncagcataaatactctattgaaagattgcctgaagcaactatgggtggagctccaagaatatgacatttgggcgtttttgnatgtntcgatgatagagttttatgttacccgaagaatagatctanagaaatnagctcactactaagcaactacggatcttcgaga

SEQ ID NO: 1046 - DNA, 1406 bp, Pinus taeda
cggccggggaacggcggttgactaacagcaacactaccatttcaagagagaataagaccgcccctatctatatataggcttcggcttcggcaacaagactggttcttttgtttctcctccgcagacggacttggctgtttttttctgaagtttcctgtttgtgaagttcttgagacgcccccatcagactaagttttcgattagcggctttggtgaatagcgataaaatcgtcaaagtgattgaagcgggtctgttgaggagatagacggaggtaaatcccattatagaggagagtcgtccagaattcaattttcatagtttaattgtactgtgagtgggggttcgacactactcggttgctgctccgatttcctgggttcaccatcaaacatggggaaatcaaagaagactcctaagtttgccaagatgaaaagtattatcagtgccaaagcaatccggaaatataaagaagaggtgcttaatccaaacaagaaggatgcggagaagcagaagctgcctagaaatgtacccaatgtttcttcagcactcttcttcaaatacaacaccgcattggggccgccgtatcttgttttggttgataccaatttcatcaacttctcgatccaaaataagcttgacttggagaaagcaatgatggactgcctatatgcaaaatgtactccctgtatcacagactgtgtgatggctgaactggaaaagctgggacagaagtatcgtgttgctttaagaattgcgaaggatcctcggtttgaaagattgccttgcacacatggaggcacttatgcagatgactgcattgtagaacgtgttacgcagcataaatgctatattgtagctacatgtgatcgggatttaaagcgtcgaattaggaagattcctggtgtacctattatgtacattacccaacacaagtactctattgaacgtttgccagaagcaaccattggaggcgcgccacgattttagagttgatgcttgatgttagtaaggtgaaatagaacaatttcgcaagtccttacttttcgagagcactccgactctgcactgatggtcagacaactgtctgaacaagatagctcctgattcagatattaatgtcctgaaaagttgaagcatagtttagtatacagattgttatatctttgtaattcaggccaagaatattgaaggttgaggttatcattctaggaacgttattttttttgtgttgtcagcagttgaaaaattcaagcagaaagttctaaagagtatattatagtcaagatgttgatttggagattaccattgtcttgatagtaaactgtcgatactgcaacaattttgaaatccatatttctctattctcttcccaagggcatttcatttcaaaaaaaaaaaaaaaaaa

SEQ ID NO: 1047 - DNA, 1489 bp, Pinus taeda
cggccgggggtcaaatcgttcaaacggtttaatgaattcggagattagataacacgaggatgagataggaagaagccgaatgtgcacacgaattctactcctgctacgagtccctggagtagtactatgttcaccgacatatgacaagaagaatatcacgagcctccgtcctgtagattgaagttagacaaaatcgcaagagttttaaaaccagtgtcatatcaattgacagtgatggtcagcaggtgaagggtagggtttcattgatgatgcagatgagacgagaatatgatgcttttgtttaagcgtaatctgatgtcttccgcagatttgtagacgagatattgtgccgaaggaggagcgaagaagattaatactgtggtggttcaaacaagtctccaactctcacattcttctctcggacacagaagtccattttctgtacatcatactctctgtagggttgaccatcaaacatggggaaatcaaagaagactcctaagtttgccaagatgaaaagtattatcagcgccaaagcgatccggaaatataaggaagaggtgcttaatccaaacaagaaggatgcggagaagcagaagctgcctagaaatgtacctaatgtctcttcagcgctcttcttcaaatacaacaccgcattggggccgccgtatcttgttttggttgataccaatttcatcaacttctcaatccaaaataagctcgacttggagaaagcaatgatggactgcctgtatgcaaaatgtactccttgtatcacagactgtgtgatggctgaacttgaaaagctgggacagaagtatcgtgttgctttaagaattgcgaaggaccctcggtttgaaagattgccttgcacacatggaggcacttatgcagatgactgcattgtagaacgtgttacacagcataaatgctatattgtagctacatgtgatcgggatttaaagcgtcgaatcaggaagattcctggtgtacctattatgtacattacccaacacaagtactctattgaacgtttgccagaagcaaccattggaggggcgccacgattttagagttgatgcttggtgttagtaaggtgaaatagaacaataccgtaaggtcgtacttttcgagagcactccgactctgcactgatggtcagacaactgtctgaacacgatagctcctgattcggatattaatgttctgaaaagttgaatagtttagtatacggattgttatttctttgtaactcaggccagaatattgaagggtgaggttatcataccaggaatgctatttttttgtgtgttgtcagcagttgaaaaattcaagcagaaggtcctaaagagtatgttatagtcaagatgttgatttggagattaccactgccttgatagtaaacagttgatactgcaacaattttgaaatccatatttctcttttctcttcacaaagggcatttcatttcaaaaaaaaaaaaaaaaaa

SEQ ID NO: 1048 - DNA, 838 bp, Helianthus annuus
acacacagaagagatggggagatcaaagaagggtcctaaattcgcagtaatgaagaaattggtctctcataaagcaatcaaacaacataaagaagaggttttgaaccctaataaaaaagatttaacgaaggagaatctccccagaaacgtgccttatgtttcctctgctctgttcttcacgtacaatacagctttaggacctccttatcgagtgttggttgataccaatttcatcaatttctccattcaaaataaactggacttggagaaaggaatgatggactgtttatatgcaaaatgcactccatgcatcacggattgtgtgatggctgaactcgagaaacttggtcaaaaatatcgtgttgctttgagaattgctaaggatcctagatttgaaaggcttccgtgcactcacaaagggacttacgctgatgactgcatagttgaaagagttactcagcataagtgttatatggtagcaacatgtgatagagatttgaagcgtaggattcgtaagatacctggggtaccaattatgtatatcactcagcacaagtactccattgaaagattgccagaggcaacaatgggtggagctccaagaatatgatgtttgagtgtgttgctgcatgttatcaatgacgagctttaaggacagataatgcacaaattgctgactgctgttcaaggatgtgttctccttttatatttttattttatgcgttttgtcttgtgacacataaatacgtgatatgaaagttgtaccttttaaacgagtaacgcttgacgaatatgttttccatgaccgtgagccgtttgtatttcatgttgaaggttc

SEQ ID NO: 1049 - DNA, 1227 bp, Pseudotsuga menziesii
ttgacggaaggaaatcgcctatgttgaggacaatcgcccagaacccagcctattgtgcatagtttaattcaactgttggctgagggctccactctcggttggtgctccgatttcgcggcattttcatatcagtgttctcgttcaaacatggggaaatcaaagaagactcctaagtttgctaagatgaaaagtattatcagctccaaaacaatccagaagtataaagaagaggtgcttaatccaaacaagaagaatgcggaaaagcagaagctgcctagaaatgtaccgaatgtctcttcagcactcttcttcaaacacaacactgcattggggccaccatatcttgttttggttgataccaatttcatcaacttttcaatccaaaataagcttgacttggagaaagcaatgatggactgcctctatgcaaaatgtactccttgtatcacagactgtgtgatggctgaacttgaaaagctgggacagaagtatcgtgttgctttaagaattgcgaaggatcccaggtttgaaagattgccttgcacacatgaaggcacttatgcagatgactgcattgtacagcgtgttacccagcataaatgctatattgtggctacatgcgatcgggatttaaagcgtcgaattagaaagattcctggtgtacctattatgtacattacccagcacaagtactctattgaacgtttaccagaagcaacaattggaggcgcaccacgattttagagttgatgcttgatgtcagtaaggtgacatagagcaattccatgagggtgtctcattttcgagagcactcccactctgcactgatggtcagacaacagtctgaacaagatagctccttgttcagatattaatgtcctgaaaacttgaagcatagcttgcgggttttgttatttctttgtaactctcagtgcaaagaatattggaagtgtgagattattattccggaaatgttcttttatgtgttgtcagcacattttaaaaattcaagcacaaggtcctaaagaatgtattgacttggagattaccattgccctgatagtaaaaagttgatactgcagcagttttgaagctcacaattatctaatctattcacaaagggcatttcaatttcacatcattagtctttattttgttttaagaagtttgtgtactcttatgggtgattctaatcccttttgattttattatagctatataacacaa

SEQ ID NO: 1050 - DNA, 985 bp, Fragaria vesca
acgcgaatcggtcttctccatcctctctctctggtctttactagggtttatctaacacagagaacaaaagggttttagggtcttgctccagaacccgaattgttcatcttggtttgctctgtgatccaaaagagagatggggaaggcaaagaaaggccccaaattcgcagtcatgaagaaggtggtcaccaaaaaagccatcaaaaattacaaagaggaggtcttgaatccaaagaagaaggatatcagcaaagaaaagctgcccagaaatgtgccgaatgttccttcggctttgttctttgagtacaacactgctttggggccgccttaccgggttttggttgataccaacttcatcaatttctctatccagaacaagttggatttggagaaggggatgatggactgcctctatgcaaagtgcactccttgtatcacagactgtgtaatggcagagcttgagaagttgggtcagaaatatcgtgtagctctgaggattgctaaagatccccgttttgagagactactgtgtactcataaaggaacctatgctgatgactgtcttgttgagagagtcacccagcataaatgctacattgtcgctacatgtgatagagatttaaagcgaaggatccgaaagatccctggtgtgccgatcatgtatatcactcaacacaagtactcaattgaacggttgcctgaagcaacaatcggtggagctccaaggtattgatgatgggaatcaatcctcctgaagaatggtttctacctgtgattcgcatcatatgctcagaccaaccaactatgccatggtagaaagttcttaccaacttattggaacttttttgagaagacatgttagtgcatatgtattactatagttgaatctccttgtaggactctgctagttttagcttgattgtaactccagagctatcatctgtactggaacagcttataattatcaggtttccacatgcaagag

SEQ ID NO: 1051 - DNA, 722 bp, Solanum lycopersicum
gttagggttttgagaattggagcacattcttgaaattgcactgcagaacccctttgtccagtttcagatttttgagaaccaaaaatggggaaagcaaaaaaggctcccaaatttgcagtgatgaagaaaatggttactcacaaagcaatcaaggagcataaagaggcagttttgaaccctaataagaaagatttaactaaagagaagctcccaagaaacgtgccttatgtttcttctgcactcttcttcaagtacaacacagctttagggccgccgtatcttgttttagttgatactaactttattaatttctctattcagaataaattggacctggagaaagggatgatggattgcttgtatgccaaatgtactccttgcattacagactgtgtcatggctgagcttgagaagctgggtcagaaataccgtgttgctcttagaattgcaaaagatccccgattcgaaaggcttccctgtactcacaaagggacatatgccgatgattgtattgttgagagagttacacagcacaagtgctatattgtcgcaacatgtgatcgagatttgaaacgtagaatacgcaaggtccctggtgtaccaatcatgtacatcactcaacacaagtactctattgaaaggttgcctgaagcaacgattggtggagctccaagattttgatgatatggaagctaacaatgaattcccaagcgctggatggt

SEQ ID NO: 1052 - DNA, 1051 bp, Ipomoea nil
ggggcttctccacttttctctcgtctctcaccgcctcacgccctccgccctccgccctcggcgacgctccggtcagactgtccctcgcttcatcgactcagcggcgaccgtacgggactcaggcactcagtggctctgcggacctcacctcagccactcagcactctgtggctctgcttcactaagtcactgaactccgaacaactgtgatcgcacaatgggaaaagctaagaagtcccccaaattcgccgttatgaagaaaattgtgactcataaagctatcaaacagcataaagaggaggttttgaacccaaagaagaaagatttgagcaaagagaagctcccgcggaacgtgccttatgtttcttctgccctcttcttcaagtataacactgccttgggacccccttatagagtgttggtcgataccaactttatcaatttctccattcagaataaattggatttggagaaaggaatgatggattgcttgtatgcaaaatgcactccttgtattacggactgtgtgatggctgagcttgagaagctgggtcaaaaataccgagttgccctcagaattgccaaggatcctcgatttgaaaggcttccttgtactcataaaggaacttatgctgatgactgtcttgttgatagggttacccagcacaagtgctatattgttgcaacgtgtgatcgagatttgaagcgaaggatccgtaagatacctggtgtaccaatcatgtatatcactcaacacaaatactcaattgaacggatgcctgaagcaacaattggtggagctccaagaatttgatggtaatctgtcaatctggctgcgagctgtaaccggctagctaaatacatgatcaaagcatctctaccccaagaaacaaacttcagagaggagcgaggaaggagggtatttggaatgaaattttgtttcaaaattgatactctatagcaattgcattagttcctccattgtaacaattttggttctagtaccgtacctggtggctttaccaccactgtccatgtattattattatat

SEQ ID NO: 1053 - DNA, 638 bp, Capsicum annuum
gcacgaggctcagtttcagattttgagaaccaaaaatggggaaagcaaaaaagggtccgaaatttgcagtgatgaagaaaatgattactcacaaagcaatcaaacagcataaagaggaaattttgaaccctaaaaagaaagatttgaataaagagaagctccctagaaacgtgccttacgtttcgtctgcactttttttcaagtacaacacagcattggggccgccttatcttgttctagttgatactaactttatcaatttctccattcagaataaattggatttggagaaagcgatgatggattgcttgtatgctaaatgtactccttgcattacggactgtgtcatggctgagcttgagaagctgggtcagaaataccgtgttgctcttagaattgcaaaagatccccgatttgaaaggcttccctgtactcacaaagggacatatgctgatgattgtattgttgagagagttacacagcacaagtgctatattgtcgcaacatgtgatcgagatttgaagcgtagaatacgcaaggtccctggtgtaccgatcatgtacatcactcaacacaagtactctattgaaaggttgcctgaagcaacgatgggtggagctccaagattttgaggacgt

SEQ ID NO: 1054 - DNA, 1051 bp, Solanum lycopersicum
gacccgctctatatcacgttagggttttgagaattggagcacattcttgaaattgcactgcagaacccctttgtccagtttcagatttttgagaaccaaaaatggggaaagcaaaaaaggctcccaaatttgcagtgatgaagaaaatggttactcacaaagcaatcaaggagcataaagaggcagttttgaaccctaataagaaagatttaactaaagagaagctcccaagaaacgtgccttatgtttcttctgcactcttcttcaagtacaacacagctttagggccgccgtatcttgttttagttgatactaactttattaatttctctattcagaataaattggacctggagaaagggatgatggattgcttgtatgccaaatgtactccttgcattacagactgtgtcatggctgagcttgagaagctgggtcagaaataccgtgttgctcttagaattgcaaaagatccccgattcgaaaggcttccctgtactcacaaagggacatatgccgatgattgtattgttgagagagttacacagcacaagtgctatattgtcgcaacatgtgatcgagatttgaaacgtagaatacgcaaggtccctggtgtaccaatcatgtacatcactcaacacaagtactctattgaaaggttgcctgaagcaacgattggtggagctccaagattttgatgatatggaagctaacaatgaattcccaagcgctggatggtggttccaattgcctacgtcttgtcactacgacaagacttccatctctctgcagtgttggattataatagctgaaacatcattatcaattttgtaccttaggaatttctgtatcccaatgatatgaatctttttcatttttctggtttctgatagaaaagaaaatccgcatttggatctacttgcggtctctgtgtatatactgttgtgctgaagcgcataccttgctacagaactattatcaatgctattagctgtaattcctcagccacaatgtcttaccgcgaatgaatacacagtttgagtatttatcc

SEQ ID NO: 1055 - DNA, 1511 bp, Aristolochia fimbriata
gtctctctcaccttctcctatgctttcatctgcatccaaatttcttaatttttgtattttctccaccacactattgtcttgccggatttcggccaggaattgaggtgcttccagaccgtcacttgctatcaggctgtcgcgaacaatctccaccgcgctttaaggagagcaagcctgtgtatatcagtatcagctgtaaactgccggaaatccgtcatcccactttcgctcgggagcctgtgcccttctgtattttgcacggggtttgtcttcatttaaacagttttctaaggttttcaagacatgggtaaggcaaagaaatccccaaaatttgcggcaatgaaaaagcttgtcagctccaaaactcttcgacaatataagaaagatgttttgaatcctaacaagaaggatctcgacaaggacaaactccctcgcaatgtaccaagtgtttcttcagcccttttcttcaagcataatactgctcttgggcctccttacagagtcatagtagataccaacttcataaatttctctatccaaaataagttggatttggagaaagggatgatggattgtctttatgcaaaatgcactccttgcatcacagactgtgtcatggcagagcttgagaagttgggccagaaatatcgcgttgctttgagaattgccaaagatcctcggtttgagcgattaccatgtacacacaagggaacctatgctgatgactgcattgttgatagggtcacccagcataaatgctacattgttgctacatgtgatagagacttgaagcgaaggattcgcaaggtccctggtgtgcctatcatgtatatcaccatgcatagatattcaattgaaaggctgcctgaagcaactattggcggagctccaagaatatgatcttggagaaattattcagcgacagggtggtcctgcctgctacattttgtgcacaagatttccaggagctttatcaaacatatacatatgatgtggctggctctgtttgttgtttctctattataagctagattgaactttacctgttatctgctacgattcctaacggaggtaaccggttgtgtatgggccaatgcgttaggttggaaattttgtagtggtgaaacattcagcaatattttacaaaaaaaaaaaagggaaagagaaagttggctatatctgtttgtcgtcatgcttgattggaggcaggttatgtccactattttgtatgcatattcatatcaatccaccaagtcggagcatcagtcagaattgaggcaggttactcggtttgtcttgttgagattcttatgtaatggacagcgttttttggattttcagggtaaaatgatacccgtacaaaaggtgtttgagtgtttaatcacttacatgtctggaaaaccgaccattctgccctttaacaggttcagcttctataaaaccggttatctgccataaaactgaaatatctcagaattgctttatacctcaaatttattgaaagctttatt

SEQ ID NO: 1056 - DNA, 1156 bp, Malus domestica
ctaaattccctttctcccttcccactcccgtaaccctctctcccgacccgccgtctgttcttcctagcccctctctcccgcggtatgttcttctggtagcctctctcagtatctcttttctcctccctcgtgcagtggacacctggacggaataattcttgtcatctctgctctagtcgtcactacatctctgcattctccagattccaccccaggggtttttcagagaacactataaaaatagggtttaaggtttttgcactatctgtaaactttggttgtctctgtgattcgaaagatggggagagctaaaaaaggcccgaaatttgcagtcatgaagaaggtggtcacctccaaagcaattaaaagctacaaagaggcggttttgaatccgaacaagaaggatctcacgaaagaaaagctacccagaaatgtgccaaatgtttcttccgcgctgttctttaaacacaacactgctttgggaccgccttatcgggttttggttgataccaacttcatcaatttctctatccagaataagttggatttggagaaaggaatgatggattgcctgtacgcaaagtgcactccttgtatcacggattgtgtaatggcagagcttgagaaattaggtcagaaatatcgtgtggctctgaggattgctaaggatcctcgttttgagagactactctgcactcataaaggaacctatgctgatgactgtattgttgaaagagttacccagcacaaatgctacattgttgctacatgcgatcgagatttaaagagaaggatccgaaaggtccctggtgtgccaatcatgtacatcactcaacacaagtattcaattgagcggttgccagaagcaaccataggtggagctccaagattttgatgattggcgtgtgacctctacaaagcaaagactggttctactccgattctgaacaatgcagttcatcaaggctgaattgcgcacttttgggttaggtgaattttcttcataggaacctgtaaacgtttctaacatttctttattacagttataagagaagaaatcgaagtgcacttgtagcagtgttagtgttatgattttacttatgaaactctgaactgtagtaattatatccgtttttcgatttgtctaaaaaaaaaa

SEQ ID NO: 1057 - DNA, 1231 bp, Ricinus communis
atcgcccatcattgctgccattcccgtcgcccatctgctgttcccgttgcttcccgtcgcctatcgttgccgctgttcccgtcgcttcctgtcgcccatcgttgcttcttcccgtcgcccatcgttgccgctgttcccgtcgcttcctgtcgcccatcgttgttgctcttcccgtcgcccatcgttggtgctgttcccgtcaggtaagaccccagctgtcgtgaagacgccagagagaggtttttgctagggttttattccggagaaaagaaaaaaagtcattttcttttgcatcgccgaagctaccgcaccgcctctaacctccttcatcttctccatcggtttcgttactacagctcttctggttttattataatttcaagtgtacacaatgggaagagcaaaaaaaggacctaaatttgcagcaatgaagaagataatcacctcaaaagcaattaaacattacaaagaagaggttttgaatcctaagaaaaaggacctctccaaggacaagctccccagaaatgtgccacaagtttcttctgcgctttacttcaaatacaacaccgcgttggggccaccctacagggtgttggttgataccaactttatcaatttctccatccaaaataaattggatttggagaaggcgatgatggattgtttgtatgcaaaatgtacaccttgtatcacagattgtgtgatggcagaacttgagaagttaggtcagaaataccgtgtagctctcaggattgctaaggatccacgctttgagagacttccctgtattcataaagggacttatgctgatgactgcattgttgacagagttactcagcataaatgttatatagttgctacatgtgaccgagatttgaagcggaggatacgcaaggtccctggtgtgccaatcatgtacattacacaacacaaatactcaattgagcggttgcctgaagcaacaatgggtggagctccaagattttgagacatcatacaggaaaaggagatgacggttttgacacctctaatgagctgggctgttttcttccatcaaaagatagtaatagaatttggcaccagatctataatagttcaaatctctactttgacattttgcttatatcgtcctgtaattatttttcttcttaattaatgactttcagcttctgtactgcttgttggaacggaaaggtcttactaatgttttaaagtcttgagttgagagttg

SEQ ID NO: 1058 - DNA, 1126 bp, Ricinus communis
cccaacattaatccctaattcaatcaagcctccaccctcgcaaaaccttgctgccgtcgcctcccttgctgctgtctcctcgtggtgtcgcctccacccgctgctgcattcttcatcggctgctgcattcttcatcggctgctgtcgccttaaggtaaatttctgtcgcccttcttgttgttggtatacgaagtgcacagtctgtttgctttgtgtatcgccgaagctaccgcaccgcctctaacctccttcatcttctccatcggtttcgttactacagctcttctggttttattataatttgaagtgtacacaatggggagagcaaaaaaaggacctaaatttgcagcaatgaagaagataatcacctcaaaagcaattaaacattacaaagaagaggttttgaatcctaagaaaaaggacctctccaaggacaagctccccagaaatgtgccacaagtttcttctgcgctttacttcaaatacaacaccgcgttggggccaccctacagggtgttggttgataccaactttatcaatttctccattcaaaataaattggatttggagaaggcgatgatggattgtttgtatgcaaaatgtacaccttgtatcacagattgtgtgatggcagaacttgagaagttaggtcagaaataccgtgtagctctcaggattgctaaggatccacgctttgagagacttccctgtattcataaagggacttatgctgatgactgcattgttgacagagttactcagcataaatgttatatagttgctacatgtgatcgagatttgaagcggaggatacgcaaggtccctggtgtgccaatcatgtacattacacaacacaaatactcaattgagcggttgcctgaagcaacaatgggtggagctccaagattttgagacatcatacaggaaaaggagatgacggttttgacacctctaatgagctgggctgttttcttccatcaaaagatagtaatagaatttggcaccagatctataatagttcaaatctctactttgacattttgcttatatcgtcctgtaattatttttcttcttaattaatgactttcagcttctgtactgcttgttggaacggaaaggtcttact

SEQ ID NO: 1059 - DNA, 1155 bp, Vigna unguiculata
catcttccacagaaccttgtgccgccattcttttcgaacccttgacggcgaacctgcgcgctctcaatctcttacgcgccgcttctgactaacacagggttttgaataatctcgtccattctctgataatgggtaaagctaaaaagggtccaaagtttgctgttaggaagaagattatcacttccaaagcaataaaaagctacaaagaagaggttttgaacccagagaaaaaggatattgtgaaggaaaagttgcccagaaacattccaagtcattcttcggcacttttctttcaatacaatactgccctgggacctccttaccgggttttagtggataccaacttcatcaatttctcaatccagaataaattggatctggagaaagggatgatggactgcttgtatgcaaaatgcactccttgtatcacagactgtgtgatggcagaacttgaaaagttaggccaaaaatatcgcgtagctctaaggattgccaaggatcctcgatttgagagaatactatgtactcacaaagggacatatgctgatgactgccttgtcgagagagttactcagcataagtgctacattgttgcaacatgtgatcgggacttaaagaggagaattcggaagattcccggtgttccaataatgtacatcaccaaacacagatattcaattgagcggttgccagaagcaacaatgggtggcgcaccaagaatttgatgcagtcaaaccaaaaccggtaaagcttgctataccaaaagtatggacactaagaagtacgaaatcctgctacagtacctgcatgtttggtctttttgctgtctggaattaattctaccggaagctcgagaatgaacaaaaagcaactcttcaatgggtattatacctgaatttttctcagtctaacttataggtgtaggatctgtcaatggtcagcagaattctgagaattcttgaaacgatgtttttttttttttcttttcttttttattgcttgagaaggactttattttcctttagtctaatatgtattagttgatccttaaagtgtcagaagactgaatcagaggagaattcaagactactattttacttctttaaaagccaagcctcgttctcaaaaaaaaaattgtttcaaatttttgtgttt

SEQ ID NO: 1060 - DNA, 862 bp, Vitis vinifera
tttcaattttgtaatcttctattggctgtcaatccatcaaaacatgggaaaagcaaagaaagcccaaaaatttgctgtcatgaagaagatggtcacctccaaagcacttaaaaaacacaaagaagaggttttgaaccctaccaagaaggacgaaaacaaagagaaaacctccagaaatgtgccatatgttccgtccgctcttttcttcaagtacaacactgctttggggccgccttatcgggttttggtggataccaatttcatcaatttttctattcagaataaacttgatctggagaaagggatgatggactgcttatatgcaaaatgcactccttgtatcacggattgtgtgatggcagagcttgagaagttaggtcagaaataccgcgtggctctgaggattgcaaaggatcctcggtttgaaagattactctgtactcataagggaacttatgctgatgactgtattgttgatagagttactcagcataaatgctacattgttgctacatgcgatcgagacttgaagcgaaggattcgcaaggtccctggtgtgccaataatgtacattacaaaacaccagtattcaattgagcggttgcccgaagcgacaattggtggagctccaagaatttaaactgtgattggtagcttacaggcgtgaggaagacaggtgattctgtttttgctaattatcaattttgtttacttgttgtaactaaaaccatctctagattcaggtggaattatgaatttttgttgatctacttctccttttttagagaccacagattctacagtgtaatttctatcaaatggggtgcttcttgctcattcaacttaagagttctgattgttt

SEQ ID NO: 1061 - DNA, 1003 bp, Solanum tuberosum
gatcacgttagggttttgagaattagagcacattcctgaaattgcactacagttgcaggagcttttcgtgcagttcagattttgagaaccaaaaatggggaaagcaaaaaaggctcccaaatttgcagtgatgaagaaaatggttacacacaaagcaatcaaggagcataaagaggcagttttgaaccctaataagaaagatttaactaaagagaagctcccaagaaacgtgccttatgtttcgtctgcactcttcttcaagtacaacacagctttggggccgccgtatcttgttttagttgatactaactttattaatttctccattcagaataaattggatttggagaaagggatgatggattgcttgtatgccaaatgtactccttgcattacagactgtgtcatggctgagcttgagaagctgggtcagaaataccgcgttgctcttagaattgcaaaagatccccgattcgaaaggcttccctgtactcacaaagggacatatgctgatgattgtattgttgagagagttacacagcacaagtgctatattgtcgcaacatgtgatcgagatttgaagcgtagaatacgcaagattcctggtgtaccaatcatgtacatcactcaacacaagtactctattgaaaggttgcctgaagcaacgattggtggagctccaagattttgatgatatggaagctaacaatgaattcccaagcgctggatggtggttccaattgcctacattttgtcactacaacaagacttccttctctctgcagtgttggatgataattgctgaaatatcattatcaattttgtaccttaggaatttctggatccccatgatatgatccttttcaattggcaggtttttgataggaaaagaaaattctgcctttgggatgaacttccgtttttggttatattgtttgctgaagccatacctttctagattattaccacaatgtctcacagcgaatgatacacaaagtttgag

SEQ ID NO: 1062 - DNA, 1028 bp, Solanum phureja
gacccgctccatatcacgttagggttttgagaattagagcacattcctgaaattgcactacagctgcaggagcttttcgtgcagttcagattttgagaaccaaaaatggggaaagcaaaaaaggctcccaaattcgcagtgatgaagaaaatggttactcacaaagcaatcaaggagcataaagaggcagttttgaaccctaataagaaagatttaactaaagagaagctcccaagaaacgtgccttatgtttcgtctgcactcttcttcaagtacaacacagctttggggccgccgtatcttgttttagttgatactaactttattaatttctccattcagaataaattggatttggagaaagggatgatggattgcttgtatgccaaatgtactccttgcattacagactgtgtcatggctgagcttgagaagctgggtcagaaataccgcgttgctcttagaattgcaaaagatccccgattcgaaaggcttccctgtactcacaaagggacatatgccgatgattgtattgttgagagagttacacagcacaagtgctatattgtcgcaacatgtgatcgagatttgaagcgtagaatacgcaagattcctggtgtaccaatcatgtacatcactcaacacaagtactctattgaaaggttgcctgaagcaacgattggtggagctccaagattttgatgatatggaagctaacaatgaattcccaagctctagatggtggttccaattgcctacattttgtcactacaacaagacttccatctctctgcagtgttggatgataattgctgaaatatcattatcaattttgtaccttaggaatttctgtatcccaatgatatgaatccttttcattttgctggtttccgatagaaaaaaaaatctgcatttgggatgtacttgcggtttgtgtgtatattgttgtgctgaaacgcatacctttctagaattattagccacaatgtctcacagcgaatgaatacacaaagtttgagtatttatcc

SEQ ID NO: 1063 - DNA, 690 bp, Petunia hybrida
ggaattggtacacgatttagaaattaaacactttcctagtagaagagctcgcccaatctcagaaccaaaaaatggggaaagcaaagaaagctcccaaatttgcagtgatgaagaaaatggttactcacaaagctattaaacaccaaaaagaggaggttttgaaccctaataagaaagatttgactaaagagaagctccctagaaacgtgccttatgtttcctctgcgcttttcttcaagtacaacacagctttaggaccgccttatcgggttcttgtcgatactaactttatcaatttctccattcagaataaattggatctggagaaaggaatgatggactgtttgtatgccaaatgtactccttgtataacagactgtgtaatggccgagcttgagaagctgggtcagaaataccgtgttgctcttagaattgcaaaagatccccgttttgaaaggctgccctgtgttcacaaagggacatacgctgatgattgtattgtcgagagagttactcagcacaagtgctatattgtcgcaacatgtgatcgagatttgaagcgaagaatacgcaaggtccctggtgtaccaatcatgtacattactcaacacaagtactccatagaaaggttgcctgaagcacaattggtggagctccaagatattgagtatgtgtttcgagcagtcagca

SEQ ID NO: 1064 - DNA, 1100 bp, Cedrus atlantica
aacagaagagcagcgggcattttcataccagggttttggggttcggcttcaaacatggggaaatcaaagaagactcagaagtttgccaagatgaaaagtattatcagctccaaagcaattcggaaatataaagaagaggtgcttaatccaaacaagaagaacgtggagaagcaaaagctgcctagaaatgtacccaatgtttcttcagcactcttcttcaaatacaacaccgcgttggggccgccatatcttgttttggttgataccaatttcatcaatttctcaatccaaaataagctcgacttggagaaagcaatgatggactgcctgtatgcaaaatgtactccttgtatcacagactgtgtgatggctgaacttgaaaagctgggacagaagtatcgtgttgctttaagaattgcaaaggatcctcggtttgaaagattgccttgcacgcatgaaggcacttatgcagatgactgcattgtagatcgtgttacccagcataaatgctatattgtagctacatgtgatcgggatttaaagcgtcgaattaggaagattcctggtgtacctattatgtacattacccaacacaaatactctattgaacgtatgccagaagcaaccataggaggcgcaccacgattttagagttgatgcttgatgtcagtaaggtgaaatagaacaattccataagggtctctcattttttgagatcactcccactctgcactgatggtcagacaacagtctgaacaagatagctcctcgttcagatattactgtcttgaaaacttgaagcatagcttacggattttgttacttctttgtaactctcagtccaagaatattggaagtgtggttattattctaggaatgttcttttttatgtgctgtcaagaattgaaaaattcaagcacaaggtcctaaagcttgtattgtactcaagatgttaacttggagattatcattgccttgatagtagaccgttgatactgcaacaatttcgaagttcataattctctatactcttcacaaagggcatttcacgatgattagtctttattttaagaagttttcgtgcttgtctgggtgattct

SEQ ID NO: 1065 - DNA, 978 bp, Cephalotaxus harringtonia
aaatggaggtctcttgcttgtgctggagatttgtggcaagcgattagagtatggtgtggaggttgtgatttggagttttagcttttggcatggcatcgtagctgattaagcagaagctttcttgaggtggaaaagttctccatcaaggatgggaaaatcaaagaaggctcccaaatttgctaagatgaaaaaaatcattagccataaatcaatccgcagttacaaagaggaggtacttaatccaaacaagaaaaatacggggaaggagaaactgcctagaaatgtaccaaatgtctcctccgcactcttttttaagcacaatactgcattggggccaccatatcaagttttggttgataccaatttcatcaacttctcaatccagaacaagttagacttggagaaagcaatgatggactgcctgtacgcaaaatgtactccttgcatcacagactgtgtgatggctgaactcgaaaagctgggacagaagtaccgtgttgccttaagaattgcaaaggatcctcggtttgatagactaccgtgttcacataaaggctcttatgcagatgactgcattgtagaacgtgttacccagcataagtgctatatagtagctacctgtgatagggatttaaaacgacgaatacgaaagattcctggtgtacctattatgtacattactcaacacaaatattctattgaacgcttgccagaagcaaccataggaggcgcaccacgattttagtgttaatgctcgccagcaataaggtgaacaacgaacaactatgtgaggagtgtctcttggttcttttatggcactgttattcagcaaaactggtcggtcaaatgatgattagattggtaactttgttcatatatttttgttctaaaagctcaaaccatattcaagggcttttgttccattttgtaatgctcaatcagaggattattggaaaaagacagataatgtcctttttt

SEQ ID NO: 1066 - DNA, 2083 bp, Citrus clementina
caaaagatctaccgtaaatagaaccctaaaaattctgtaacggcattttcgtcggcccaaactaaacccctgcgctcaggcttaggttaaaaatccaaaagccacctgcatgtctctcaatcgcactcgcagtcgcagattctaaaacggcccgtcgccgactctgagactctcttctacttgttcaacctcaacctagtaatcttacaattagatttttacgatttttggagaagcagggaagccggtttctggtgagataactgaaagtcttgctcttagtgataaatttgtaagctttcaatcaaagagatggggaaagccaaaaaggctcctaaatttgccgccatgaagaagatcatcaccaaaagagctataaaaaattacaaagaggatgttttgaatcccaacaagaaagaccttactaaggaaaagatgccaagaaatgtgcctaatgtttcttcggcacttttcttcacacacaacactgccttgggaccgccttaccgggtcttggtggataccaactttattaatttctccatccagaataaattggatttggagaagggaatgatggactgcttatatgcgaaatgcactccttgtattacggattgtgtgatggcagagcttgagaagctaggtcagaagtaccgagtagctctgaggattgctaaggatcctcgttttgagagattaccctgtactcataaagggacctatgctgatgattgtcttgttgaaagagttactcagcataaatgcttcatagttgctacatgtgatcgagatctgaagcgaaggatacggaaggttcccggagtgcctatcatgtacataacccggcacaagtattcaattgagcggctgccagaggcaacagttggtggagctccaagaatttgataatgggaggaggatcattcaattgagaatcatctgtgctgctgtcctaactcaatgttgagccttaagatgttctaaatattagaacttttgcgtaggaatgatgatagctcgatgaaatgatgtgtgtatcagtattgtgattgaggcacttattttgtgccttgtgtaattctattaatgatatttttcctactaaatattcccagttttcattctgtcgtttatatcccgtcagccaatcgcgatgaaaaaagcaatatttgtatgtttgttgggacttcgttgtccctcccgcagattcattgattaatttatgttttcaatgatgctaatgccttgcctaccatggagatgggaggacataatagaagttaaatgaggaattactgtgacagctggttgaaccaccaatttttggtatttgaaacctaacaaacattcattgaaagattgattgtatagatgcttgttctgagttccctcctttacaaaccttcatgcccattttcattacaactgaagtgtaccaccagatccgaaatgaaaaaaactagtatacatttgccattcatcgacatggccagaaggatgcggttaagttacatacaaaacccacacatatcctttctggcaaaaattagaccagaggggagagaaatcaaaaattaaaagaatcatctaatcaaaactactttgaaagatgccagctgccaaagaatcaaatggactctagaatcattgatgtaatattgttgttgagttcgaattttccgtctcttctggtggaggtttcacatattttcctattactttttggcgtctctttctcttttgtctggtttgtttgtctttactttgctgcttccttttctcctttagcttattccgaagatgcctttctttctcaaatacaccttgccaaacgacctcacctgttgacggccataaccaccgtcttctagggtgatcagaatctgcctcctcggccatgtcctcatccatgctttttaaagtgctgtatgagaaccatctgacccacatttgacctctccgactcttaaacttgtgttgctcttgcattgcaccagtctcagggttcacatataccatccgtcttgcactgtgataagcccagacatttacaagtagctcaagcaggcgtgagtaacaa

SEQ ID NO: 1067 - DNA, 2085 bp, Citrus sinensis
caaaagatctaccgtaaatagaaccctaaaaattctgtaacggcattttcgtcggcccaaactaaacccctgcgctcaggcttaggttaaaaatccaaaagccacctgcatgtctctcaatcgcactcgcagtcgcagattctaaaacggcccgtcgccgactctgagactctcttctacttgttcaacctcaacctagtaatcttacaattagatttttacgatttttggagaagcagggaagccggtttctggtgagataactgaaagtcttgctcttagtgataaatttgtaagctttcaatcaaagagatggggaaagccaaaaaggctcctaaatttgccgccatgaagaagatcatcaccaaaagagctataaaaaattacaaagaggatgttttgaatcccaacaagaaagaccttactaaggaaaagatgccaagaaatgtgcctaatgtttcttcggcacttttcttcacacacaacactgccttgggaccgccttaccgggtcttggtggataccaactttattaatttctccatccagaataaattggatttggagaagggaatgatggactgcttatatgcgaaatgcactccttgtattacggattgtgtgatggcagagcttgagaagctaggtcagaagtaccgagtagctctgaggattgctaaggatcctcgttttgagagattaccctgtactcataaagggacctatgctgatgattgtcttgttgaaagagttactcagcataaatgcttcatagttgctacatgtgatcgagatctgaagcgaaggatacggaaggttcccggagtgcctatcatgtacataacccggcacaagtattcaattgagcggctgccagaggcaacagttggtggagctccaagaatttgataatgggaggaggatcattcaattgagaatcatctgtgctgctgtcctaactcaacgttgagccttaagatgttctaaatattagaacttttgcgtaggaatgatgatagctcgatgaaatgatgtgtgtatcagtattgtgattgaggcacttattttgtgccttgtgtaattctattaatgatatttttcctactaaatattcccagttttcattctgtcgtttatatcccgtcagccaatcgcgatgaaaaaagcaatatttgtatgtttgttgggacttcgttgtccgctccccgcagattcattgattaatttatgttttcaatgatgctaatgccttgcctaccatggagatgggaggacataatagaagttaaatgaggaattaatgtgacagctggttgaaccaccaatttttggtatttgaaacctaacaaacattcattgaaagattgattgtatagatgcttgttctgagttccctcctttacaaaccttcatgcccattttcattacaactgaagtgtaccaccagatccgaaatgaaaaaaactagtatacatttgccattcatcgacatggccagaaggatgcggttaagttacatacaaaacccacacatatcctttctggcaaaaattagaccagaggggagagaaatcaaaaattaaaagaatcatctaatcaaaactactttgaaagatgccagctgccaaagaatcaaatggactctagaatcattgatgtaatattgttgttgagttcgaattttccgtctcttctggtggaggtttcacatattttcctattactttttggcgtctctttctcttttgtctggtttgtttgtctttactttgctgcttccttttctcctttagcttattccgaagatgcctttctttctcaaatacaccttgccaaacgacctcacctgttgacggccataaccaccgtcttctagggtgatcagaatctgcctcctcggccatgtcctcatccatgctttttaaagtgctgtatgagaaccatctgacccacatttgacctctccgactcttaaacttgtgttgctcttgcattgcaccagtctcagggttcacatataccatccgtcttgcactgtgataagcccagacatttacaagtagctcaagcaggcgtgagtaacaa

SEQ ID NO: 1068 - DNA, 631 bp, Podocarpus macrophillus
agcttgtaggcttcaccattaaagatgggaaaatcgaagaagacacccaaatttgcaaagatgaagaaaattatcagctctaaagcaattcgcagttacaaagaagaggtgcttaatccaaacaagaaaaatacagagaaggagaagctgcctagaaatgtaccaaatgtctcttcagcactcttcttcaagcataacagtgcgttgggcccaccatatcaagttttggttgataccaatttcatcaacttctcaatacaaaacaagttggaccttgagaaagccatgatggactgcttgtatgcaaaatgtactccttgcattacagactgtgtgatggctgagcttgaaaaactgggacaaaaatatcgtgtagccctaagaatcgcaaaagatcctcggtttgatagactgccttgcacgcatcaaggaacttatgcagatgattgcttagtgcaacgtgttacacagcataaatgctacattgtcgctacttgcgatagggatttaaaacggcgtattcgaaagattcctggcgtaccaattatgtacatcactcaacacaagtattctattgaacgcttgccagaagcaactattggaggcgcaccacgattttagtgtttattcc

SEQ ID NO: 1069 - DNA, 1268 bp, Sciadopitys verticillata
ggaccgtgtagttggacaagtggccaggattgcaaagaaaatcgaaatacattctccaaacaaataccagtcgctcacgcaatgcagtctctcatgcattaacagttgcgaatgattggaacagtcgcccaaggcccagagaatagtctgtgacgacagccattagagcatggtgtgcaagttaggaggtagagattttagcttttggcaaggtgtcattggtgcttaaaaaattgaagcagcagctttcctggggtgttaggattctccataaagatgggaaaatcaaagaagacacccaaatttgccaagatgaagaaaattattagccataaagcaatccacagttacaaggaagaggtgcttaatccaaacaagaagaatacaaaggaggagaagctacctcgaaacataccaaatgtctcttcagcactcttcttcaaatacaacactgcactcgggccaccatatcaagttttggttgatactaatttcatcaacttctctatccagaacaagttggacttggagaaagcaatgatggactgcctgtatgcaaaatgtactccttgcatcacagattgtgtgatggctgaacttgaaaagctaggacagaagtatcgtgttgccttaagaattgcaaaggatcctcgatttgatagactgccttgcacacataatggcacttatgcagatgactgcattgtagaacgagttacccagcataagtgctatatcgtagctacttgtgatagggatttaaaacggcgaattcgaaagattcctggtgtacctattatgtatattacccaacacaaatattctattgaacgcttgccagaagcaaccatcggaggcgcaccacggttttaatgtcaatgcttgccaccaacatgatgaacaaagaataattctgtaaggagggtgttttgatcttttgtaatactgctagtcagcgaggttggttaagtgcatttcgattagcttggtgaattcttgttcagacatttttgttccgaaaactggaaccatattttggggctttggttccttcaatgtaatgcaaatcctgaagatattataagaggaacattaatgtccttcgggattgtctttttcctttgtttggaagcattgtatgcattacaataatccaagcacagaataatttagaatagagagttctgtgcatgttaaactgggagattgccaactagctttatgccatagtgaagttagttaacatattttgtaatgatgtaatgtat

SEQ ID NO: 1070 - DNA, 1292 bp, Taxus baccata
tgggtgtcagttatcaatacaccaattcaaaaaccctagtatcgtctgtttagggtttaggaacaaactctaaatcaaaccggctactcagagatttcggttggtaaggttttgcaggctttacggttttacagtggtgacaaggacaaatatatgtttagatcagaataggattatttctgcataaaccattcttcaagtggtagactttgcatcaaacaatgggaaaatcaaagaagacacccaaatttgctaggatgaaaaaaatcattagccataaaacaatacgcagttacaaagaagaggtgcttaatccaaacaagaagaatacggagaaagataaactgcctagaaatataccaaatgtctcctcagctctcttttttaagcacaatactgcattggggccaccatatcaagttttggttgataccaattttatcaacttctcaatccagaataagttggacttggagaaagcaatgatggactgcctgtatgcaaaatgtactccttgcatcacagactgtgtgatggctgaacttgaaaagctgggacagaagtatcgtgttgccttaagaattgcaaaggatcctcggtttgatagactaccttgcacacataaaggcacttatgcagatgactgccttgtagaacgtgttacccagcataagtgctatatagtagctacttgtgatagggatttaaagcgacgaattcgaaagattcctggtgtgcctattatgtacattacccaacacaaatattctattgaacgcttgccagaagcaaccatgggaggcgcaccacgattttaatgttacgctcacaagcaataaggtgaacaacgagcaattctgtaaagagggtcccttgttcttttacaacattgttacacagcaaggatggttagtcaaattttgattagataagtaagttcttgttcaaatattattattctaaaaaatcaaactatatcttggggcttttgtttctttttgtaatgcacatgcccaggatattagaaaaggacacttgatgtactgctttttttgtgggaaatttgtatgcattacaataatccaagcacaggataactgggaggtttccaaccggcttttaggtcacaatggagtttgtgagcttatgttgtaacataaagaaaatgaatgatcttggtaattgcaacaggtattcttttttattatttccttgtgttattggtaaaaagccaatttaaaatgctgatttactttaatttgctgtgtactttggtctctgcatcaaggtga

SEQ ID NO: 1071 - DNA, 1082 bp, Aquilegia formosa
gcacaatcagtttccttctttcgttctacgaagagggttttagagagacttctgtgttggaatctctgaactttgaattagggtttattcgaaatcgaaaaaaaaatgggaaaagcaaagaaatctcctaaattcgcagtaacgaagaagctcgttaccacaaaaatgatcaaaaaacataaagaagatgttctgaaccctaacaagaaggatctcgagaaagaaaaactacctagaaacgtgcctactgtttcttcagctcttttcttcaaacacaattctgcattgggtccgccttatcgagttttggttgatactaattttatcaatttctctattcagaataagttggacctggagaaagcaatgatggattgcttgtatgcaaaatgtactccttgcatcactgattgtgtaatggcggagctcgagaaactaggacagaagtaccgtgttgcattgaggattgccaaggatcctcggtttgagagactcccctgtacccacaaaggaacttatgctgatgactgccttgttgacagagttacacagcataaatgttatattgttgctacttgtgatcgagacttgaagcgaaggattcgcaagatccctggagtgccaatcatgtatattacgcaacataagtattcgattgaaaggcttcctgaagcaaccattggtggagctccaagatattgattgcagatggtttgatacttaagcaacaggatgagcatcagttctggttaccttttccaggttctatatatggtccacatagataattatgttcatgtcatattcatgctactatgcagacattttgctcctctggagttaggagtaattaatagtcggatttctctgttgtcgtcgaacgtggttaactgttttggttagagaccttccattgctgattttgattgttataccagaagaaattgaaaggcaagcaagaggagtgctagtgtttttgtctggtttagttgtaatgctgtaaaagcttaacttttttcttcctgtgtattaacaaagtaacattggtattacttcatagtttgcaattttattagcaataa

SEQ ID NO: 1072 - DNA, 1083 bp, Aquilegia formosa
gcacaatcagtttccttctttcgttcttcgaagagggttttagagagacttctgtgtcggaatctctgaactttgaattagggtttattcgaaatcgaaaaaaaaaatgggaaaagcaaagaaatctcctaaattcgcagtaatgaagaagctcgttaccacaaaaatgatcaaaaaacataaagaagatgttctgaaccctaacaagaaggatctcgagaaagaaaaactacctagaaacgtgcctactgtttcttcagctcttttcttcaaacacaattctgcattgggtccgccttatcgagttttggttgatactaattttatcaatttctctattcagaataagttggacctggagaaagcaatgatggattgcttgtatgcaaaatgtactccttgcatcactgattgtgtaatggcagagctcgagaaactaggacagaagtaccgtgttgcattgaggattgccaaggatcctcggtttgagagactcccctgtacccacaaaggaacttatgctgatgactgccttgttgacagagttacacagcataaatgttacattgttgctacttgtgatcgagacttgaagcgaaggattcgcaagatccctggagtgccaatcatgtatattacgcaacataagtattcgattgaaaggcttcctgaagcaaccattggtggagctccaagatattgattgcagatggtttgatacttaagcaacaggatgagcatcagttctggttaccttttccaggttctatatatggtccacatggataattatgttcatttcatattcatgctactatgcagacattttgctcctctggagttaggagtaattaatagtcggatttctctgttgtcgtcgaacgtggttaactgttttggttagagaccttccattgctgattttgattgttataccagaagaaattgaaaggcaagcaagaggagtgctagtgtttttgtctggtttagttgtaatgctgtaaaagcttaacttttttcttcctgtgtattaacaaagtaacattggtattacttcatagtttgcaattttattagcaataa

SEQ ID NO: 1073 - DNA, 792 bp, Musa acuminata
gcacgaggagagagagagagagagagagagagagagagagagagagagagagagagagagagagagagagagagagagagagagagagagagagagagagagagagagagagagagagagagagagagagaactcccctgttctgctcggtggggtgctgcggcgatggggagggcgaagaaaacccgcaaatttgcggtcatgaagaagctcgtcagctcgaaaaccctcaagaagtacaaggaagagattctgaaccctaagaagaaggatcccgagaaggagaatctgccccgcaatgtcccgagcgtatcttcggcgctgttctttaaatacaacaccgcacttggtccgccttacatggtcatcgtggataccaattttatcaacttctccatacaaaataagttggatttggagaagggcatgatggattgcctttatgcaaaatgcactccttgcattactgactgcgtgatggctgagcttgaaaagttgggacagaaatatcgtgtagctttacgtattgcaaaagatcctaggtttgaaaggctaccttgcacacataaagggacttatgctgatgactgcattgttgacagggttactcagcacaagtgttatattgttgcaacgtgcgatagagacttgaagcgaaggatacgcaagattcctggcgtgcctatcatgtacatcacacgacacaagtactcaatcgagcggctaccaaaagcaacaatcggtggagctccaagaatttgatgaagagtttcttccagagagaacaaactc

SEQ ID NO: 1074 - DNA, 990 bp, Citrus sinensis
caatcgtactcgcagtcgcagattctaaaacggcccgtcgccgactctgagactctcttctacttgttcaacctcaacctagtaatcttacaattagatttttacgatttttggagaagcagggaagccggtttctggtgagataactgaaagtcttgctcttagtgataaatttgtaagctttcaatcaaagagatggggaaagccaaaaaggctcctaaatttgccgccatgaagaagatcatcaccaaaagagctataaaaaattacaaagaggatgttttgaatcccaacaagaaagaccttactaaggaaaagatgccaagaaatgtgcctaatgtttcttcggcacttttcttcacacacaacactgccttgggaccgccttaccgggtcttggtggataccaactttattaatttctccatccagaataaattggatttggagaagggaatgatggactgcttatatgcgaaatgcactccttgtattacggattgtgtgatggcagagcttgagaagctaggtcagaagtaccgagtagctctgaggattgctaaggatcctcgttttgagagattaccctgtactcataaagggacctatgctgatgattgtcttgttgaaagagttactcagcataaatgcttcatagttgctacatgtgatcgagatctgaagcgaaggatacggaaggttcccggagtgcctatcatgtacataacccggcacaagtattcaattgagcggctgccagaggcaacagttggtggagctccaagaatttgataatgggaggaggatcattcaattgagaatcatctgtgctgctgtcctaactcaatgttgagccttaagatgttctaaatattagaacttttgcgtaggaatgatgatagctcgatgaaatgatgtgtgtatcagtattgtgattgaggcacttattttgtgccttgtgtaattctattaatgatatttttcctacta

SEQ ID NO: 1075 - DNA, 1340 bp, Cycas rumphii
ggtcctctctagtattctataacgtgtcgtctgttgcagcgggcgtgattttaagcgataaaacgtcaaccattggcggtaactgtatctgttgacttcttctggaaactcagtagcagtccagttttatataataaggtcaaggatttttctcgcaaagatgggaaagtcaaagaagatccccaaatttgccaagatgaaaagaattatcagctctaaaacgttgcgaaaatataaagaagaagtgctcaatccagacaaaaagaatgtagagaaacagaagttgcctagaaatgtaccaaatttttcttcagcactcttctttaagtacaacactgcattggggcctccataccaagttctggtggatactaacttcatcaatttctcaattcaaaacaagttggacttggagaaagcaatgatggactgtctgtatgcaaaatgcactccttgtatcacagactgcgtgatggctgaacttgaaaagttgggacagaaatatcgtgtagctttaaggattgcgaaagatcctcggtttgagagacttccgtgcacgcacaaaggaacctatgcagatgactgtattgtacaacgtgttattcagcataaatgctacattgtagctacatgcgatagagatttgaagcggcgcattcgcaagattcctggtgtccctatcatgtatatcacccaacacaaatattctattgagcgtttgccagaggcaaccattggcggggccccacgattttgatgttgatgctcatcttcaatcagatggacgaaagaatagtgccataaagaggtccttctgtttattaagaattctgttggatgacattgatgttgagccaactgtctataaacttagtatcttcttgattggatgttgtatattttctgaaaattcatggtatatctcacctgaagcatttttgtttcttcatttttctttccattccaagaatcttggaagttgtgaggttagagttccctaccgtttcgagagcttagcaaaatataacaaggtccatttccagatgttacttattgggctcaagttggtggagtttcatcaaactggtttaaaatggataaccagatactgcagcaactttgagttttgtggttatcaacattattgacccccaaaaatatttgatagacaacattctaaaatcctttgttagtgtctattctaattggctatgccgtttctttatgttaatttctcaggtgatttttccttttttgatacattataattttagtatgacatattgattacaattttatggcaatatgggacaactttgttccatttcattccctttagc

SEQ ID NO: 1076 - DNA, 951 bp, Heritiera littoralis
ggccttattcttccccagtctctgcctaaccgagctaaaccaaaacctcaagctcgcctcttttactgaaaatctctgagctgttccgaagggttgctgttaggcttcaaggtttccggcgcttttgatgttataagtctcgatctgaagccatgggtaaagcaaagaaggctccaaagtttgctggcatgaagaagatgatcactcaaaaagctattaaaaattacaaggaacaagttttgaatcccaacaagaaagacctgagcaaggaaaagctccccagaaatgtgccgaatgtttcttcagcgcttttcttcacatacaacacctccttgggaccgccttatcgggttttggttgatactaacttcatcaatttctccatccagaacaaattggatctggagaagggaatgatggactgcttatatgcaaaatgcactccttgtatcacagattgtgtgatggctgagcttgaaaagttaggccaaaaataccgtgttgctctgaggattgctaaggatcctcgttttgaaagactgccatgtagtcataagggaacctatgctgacgactgtattgttgagagagttacacagcacaaatgctttattgttgctacatgtgatcgagatttgaaacgaaggattcgtaaggttcctggcgtaccaatcatgtatatcactcagcataaatattcaattgaacgacttcctgaagcaaccattggtggagctccgagattctgatatgctgagtatgatgcttcagcagcattgatcttcggattctactcagataataagagtcaaagcccttaagaatactagcttgagagtatagttcagtgatatagctaggatttacttgtttcttctggtgatatttataacacttttccgatttaacacttatatgtctggatccccttaataggtgataatgtgaggc

SEQ ID NO: 1077 - DNA, 961 bp, Mimulus guttatus
gagccccaataattctcaattgaataattaggtcttgatttcaattgaaaatctgaatttttttctaggaatttggggggtctgcgaattgatttcaggatgggaaaagcgaagagaaccgccaaatttgccgtcatgaagaaactcgtctcccataaagccattaaacaatacaaagaggaagtcttaaaccctaataagaaagatttaaccaaggaaaacctccccagaaatgtaccacaagtttcatctgcgcttttcttcaagcacaacactgctttggggccgccatatcgagttttggtggatactaactttattaatttctccatccaaaataaattggatttggagaaagggatgatggactgcttatatgcaaaatgcaccccatgtatcacagactgtgttatggctgagcttgagaagttgggtcaaagataccgagttgctctcagaattgccaaggatcctcggttcgaaagacttccgtgtactcacaagggtacatatgctgatgactgtcttgtcgatagggttacacagcacaagtgctacattgttgcaacttgtgatcgagatttgaagaggaggattagaaagatacccggtgtaccaattatgtatatcgcccagcataggtactccatcgaacgacttcctgaagctacgattggtggagctccaagaatttaattacaagaagttagaagttggaaattcaaggttattttcttaagcgaaaatccggcccttatttctagtacaaggaaacgacgaggtggcacttgacgggcgtactattcttgtagcaaattttgtatgaaatcttagcgaaaaatgttaattaacttattctcgcctttcaaatgagttgaattttcgattaatgtctttactaaaattactttttccatttgatacaatgcgattaattttcgttcacgcctcgtttgggaat

SEQ ID NO: 1078 - DNA, 1206 bp, Glycine max
tcttttctcacgtctcactcatattttccccttgtgccgccattctaccacacgacgagcctgcgcatcgttctgtctctcacgcgccgcttggctctcagccccggcctgcagggttttgcataatctagctcttttttctccgtccaaaatgggtaaagctaaaaagggaccaaagtttgctgttatgaagaagattgttacttccaaagcaatcaaaagctacaaagaagaggttttgaacccagaaaagaagaatcttatgaaggaaaagttacccagaaatgttccaactcattcttcagcacttttctttcaatacaatactgcactgggacccccttatcgtgttttggtggacaccaacttcatcaatttctcaatccagaataaattggatctggagaaagggatgatggactgcttatatgctaaatgcaccccttgtattacggactgtgtgatggcagaactcgagaaattagggcaaaaatatcgtgtagctctaaggattgccaaggatcctcgatttgagagaatactatgtactcataaagggacctatgctgatgactgccttgttgagagagttactcagcacaagtgctacattgttgcaacatgtgatcgggacttgaagaggagaattcggaagattcccggtgttccaataatgtacatcaccaaacgcaagtactcaattgagcgattgcctgaagcaacaattggtggagcaccaagaatttgatgcagtaaaactaaaacaggtagagctggctataccaataatattgatactaatttcttggtcgaaaagtatgaaatcctgctacagtaacttgcatgtttggtttttggctggctgggctgaattctaacggaagcttgggactgaacaaaagcaagacttaaatggtttatacctgaaattttcttagtgtaagttggtagatttaggttctgtcaaattttgttttcctcatattgcctatctaatgtatcatggtaaaccccggagagtgtctaaaactatgacattttcatagttctggcaatgcaaatctcttgaaacaatactttttttgttgcaagagaaaaaccttattttccttgaatctaaattgtattaacttcaaccttcacatgtcagaagaccgagttggaaattagaaatttcaaaatcacggtttttcttttttaaaggcc

SEQ ID NO: 1079 - DNA, 1125 bp, Glycine max
acgtctcactcatattttccccttgtgccgccattctaccacacgacgagcctgcgcatcgttctgtctctcacgcgccgcttggctctcagccccggcctgcagggttttgcataatctagctcttttttctccgtccaaaatgggtaaagctaaaaagggaccaaagtttgctgttatgaagaagattgttacttccaaagcaatcaaaagctacaaagaagaggttttgaacccagaaaagaagaatcttatgaaggaaaagttacccagaaatgttccaactcattcttcagcacttttctttcaatacaatactgcactgggacccccttatcgtgttttggtggacaccaacttcatcaatttctcaatccagaataaattggatctggagaaagggatgatggactgcttatatgctaaatgcaccccttgtattacggactgtgtgatggcagaactcgagaaattagggcaaaaatatcgtgtagctctaaggattgccaaggatcctcgatttgagagaatactatgtactcataaagggacctatgctgatgactgccttgttgagagagttactcagcacaagtgctacattgttgcaacatgtgatcgggacttgaagaggagaattcggaagattcccggtgttccaataatgtacatcaccaaacgcaagtactcaattgagcgattgcctgaagcaacaattggtggagcaccaagaatttgatgcagtaaaactaaaacaggtagagctggctataccaataatattgatactaatttcttggtcgaaaagtatgaaatcctgctacagtaacttgcatgtttggtttttggctggctgggctgaattctaacggaagcttgggactgaacaaaagcaagacttaaatggtttatacctgaaattttcttagtgtaagttggtagatttaggttctgtcaaattttgttttcctcatattgcctatctaatgtatcatggtaaaccccggagagtgtctaaaactatgacattttcatagttctggcaatgcaaatctcttgaaacaatactttttttgttgcaagagaaaaaccttattttccttgaatctaaattgtattaacttc

SEQ ID NO: 1080 - DNA, 1670 bp, Glycine max
gctgtctttcatatttttccctagtaattttccccttgtgcggctattccaccccacgacgaacctgcgcatctctctctctctcgcgcgcgccgcttttctctcagccagccctgcagggttttgcataatttagctctttttctccgcccacaatgggtaaagctaaaaagggaccaaagtttgctgttatgaagaagattgtcacttccaaagcaatcaaaagctacaaagaagaggttttgaacccagaaaagaagaatcttatgaaggaaaagttacccagaaatgttccaactcattcttcagcgcttttctttcaatacaacactgcactgggacccccttatcgtgttttggtggacaccaacttcatcaatttctcgatccaaaataaattggatctggagaaagggatgatggactgcttatatgcaaaatgcaccccttgtattacggactgtgtgatggcagaactcgagaagttaggccaaaaatatcgtgtagctctaaggattgccaaggatcctcgatttgagagaatactatgtactcataaagggacctatgctgatgactgccttgttgagagagttactcagcacaagtgctacattgttgcaacatgtgatcgggacttgaagaggagaattcggaagattcccggtgttccaataatgtacatcaccaaacgcaagtactcgattgagcgattgcctgaagcaacaattggtggagctccaagaatttgatgcagtaaaactaaaacaggcagagctggctataacaataatattgatactaatttcttggtcgtgaagtatgaaatcctgctacagtacctagcatattcggtcttttgctggctgggctgaattctatcggaagcttgagacttgaacaaaagcagcacttcaatggtttatacctgaaattttcttagtgtaagttggtagatttaggttctgtcaaattttgttttcctcatattgcctatctaatgtatcatggtaaaccttggagagtgtctgaactatgatgacattttcatagttctgggcttgtggcaattaactctcttgaaacgatactttttttgttgcaagagaaaaaccttattttccttgaatctaaattttattagtttcaagcttgacatgccagaagactgagttggaaactggaaatttcaaaaccactgtttttcttctttaaaggccagtggagtaccaaaagaatttgtgtttcaattagtgtacgtattttattataaaaatatatttcatattattagatgtaaattatacccaacagctcatttgattaaacttgtttgctcaaacagttaatccggttgaacataaagactaaagaggatgtttaaccaatgttgtaccatctaattatcattgcccagaagaaaattcaagctattttgcgtattagtttaacgtttcacgctccagaaggtttaacaattattttgcctatatttccgtattatgtgatctgaatgctgcatcttggggtgtcttgaattgtagaaagatgacgtttctactatctagtgatgcgacttaagtggagtctcaactctcaactcaagcaagcaaattaccagtgtaaattttaaaaatctacgtgtgcgttggacttatataaatgtaagt

SEQ ID NO: 1081 - DNA, 1657 bp, Glycine max
tttttccctagtaattttccccttgtgcggctattccaccccacgacgaacctgcgcatctctctctctctcgcgcgcgccgcttttctctcagccagccctgcagggttttgcataatttagctctttttctccgcccacaatgggtaaagctaaaaagggaccaaagtttgctgttatgaagaagattgtcacttccaaagcaatcaaaagctacaaagaagaggttttgaacccagaaaagaagaatcttatgaaggaaaagttacccagaaatgttccaactcattcttcagcgcttttctttcaatacaacactgcactgggacccccttatcgtgttttggtggacaccaacttcatcaatttctcgatccaaaataaattggatctggagaaagggatgatggactgcttatatgcaaaatgcaccccttgtattacggactgtgtgatggcagaactcgagaagttaggccaaaaatatcgtgtagctctaaggattgccaaggatcctcgatttgagagaatactatgtactcataaagggacctatgctgatgactgccttgttgagagagttactcagcacaagtgctacattgttgcaacatgtgatcgggacttgaagaggagaattcggaagattcccggtgttccaataatgtacatcaccaaacgcaagtactcgattgagcgattgcctgaagcaacaattggtggagctccaagaatttgatgcagtaaaactaaaacaggcagagctggctataacaataatattgatactaatttcttggtcgtgaagtatgaaatcctgctacagtacctagcatattcggtcttttgctggctgggctgaattctatcggaagcttgagacttgaacaaaagcagcacttcaatggtttatacctgaaattttcttagtgtaagttggtagatttaggttctgtcaaattttgttttcctcatattgcctatctaatgtatcatggtaaaccttggagagtgtctgaactatgatgacattttcatagttctgggcttgtggcaattaactctcttgaaacgatactttttttgttgcaagagaaaaaccttattttccttgaatctaaattttattagtttcaagcttgacatgccagaagactgagttggaaactggaaatttcaaaaccactgtttttcttctttaaaggccagtggagtaccaaaagaatttgtgtttcaattagtgtacgtattttattataaaaatatatttcatattattagatgtaaattatacccaacagctcatttgattaaacttgtttgctcaaacagttaatccggttgaacataaagactaaagaggatgtttaaccaatgttgtaccatctaattatcattgcccagaagaaaattcaagctattttgcgtattagtttaacgtttcacgctccagaaggtttaacaattattttgcctatatttccgtattatgtgatctgaatgctgcatcttggggtgtcttgaattgtagaaagatgacgtttctactatctagtgatgcgacttaagtggagtctcaactctcaactcaagcaagcaaattaccagtgtaaattttaaaaatctacgtgtgcgttggacttatataaatgtaagt

SEQ ID NO: 1082 - DNA, 1052 bp, Tragopogon dubius
tcgggatccgtgacaatcctcaggggggttttagagatcgccgatttcctctgtacgcccatctctctagtctttttttctctgtgcgacgccatcgtcacgactgcctctgacatctaatggagaagggaaaccgtcgagcagccgctgccttttccaccattgatcaaaatctaacgaagaagatttgaaacaaagccgattgatcaccatcataatttttctgcaattacaagtttagaaagatggggagagcaaagaagggtcccaaattcgcagtaatgaagaaactggtctcccataaagcaattaaacaacataaagaagatgttttgaaccctaacaaaaaggatctaacaaagctccccagaaatgtgccgtatgtttcttctgctctgttctttacatacaataccgcgctcggaccaccttatcgagttttggtcgataccaacttcatcaatttttccatccaaaataaattggatctggagaagggaatgatggactgcttatatgcaaaatgtactccatgtattaccgattgtgtgatggctgaacttgagaagcttggtcagaaatatcgtgttgctttaagaattgcaaaagatcctagatttgaaagacttccatgcactcacaaaggaacctacgctgatgattgcattgttgaaagagttactcagcacaagtgctatttggtagcaacatgtgatagagatttgaagcgtaggattcgcaagatacctggtgtgccgattatgtatatcacccaacacaagtactcaatcgaaagattgcctgaagcaacaatgggtggagctccacgaatatgacaagtaagaatagaaatggccgactccttgtgttacggttcgtctaaagtggatgtgttgcggttttcttgttttatgcaacttttaaaagtagaaagatgggtttcagcaatgtcgggtttttgttgtcttttttataaagatagtcttttacggttgttttgatgttgaatcttaagttatttatatgatacaagtagtaaaagatatgttgca

SEQ ID NO: 1083 - DNA, 1195 bp, Tabernaemontana elegans
aaatcaatccgtgatagggagaagggtgggaaaaatgggcaaagctaaaaagctccgaaatttgctgttatgaagaaaatggtgacctcgaaggcaattaaacagcacaaacaagaggttttgaaccctaataagaaagatttgagtaaagaaaagctaccgagaaacgtgccaaatgtttcatctgcgcttttcttcaagcacaacacagcattggggccgccctatagagtattagtagatactaacttcatcaatttctctattcaaaataaattggatttggagaaagggatgatggactgcttgtacgcaaaatgtactccttgtattactgactgtgtaatggctgagcttgagaagttgggtcagaaataccgtgttgctttaagaattgcaaaggatcctcgatttgaaaggcttccctgtacacacaaaggaacctatgctgatgactgcctagtggacagagtcacacagcataaatgctatattgttgcaacatgtgatcgagatttgaaacgaaggatacgaaaggtccccggtgtgccgataatgtacattacccagcacaagtactccattgaacggttgcctgaagctacaattggtggagctccaagatattaataccattagtgagttgtaaaattcgtgctcaggaaacaaattatctctagctgtggcacatgataagagaaatgggcatattggagactcttccttggatagttaagtttgcaggatgatccaagttaatttttcgcatctgaggatgtcaagattgagtatgttcattttacctgtgctgggaattttgttgccgtgggattacatttagatggcaatactttattcaacagatgttctttctcatcgaagtttagctacatacagcaaaatagtattgggagacatggctggcaactaggcaagcaatatggaggaacttctcttttgtccaacattcaagaacttgagcatagattgaagaagtcagaatattcacatccttacgccatagagtcgataattgttcatgccgttgaaagtcctgcttttttcatttccttttcaattgggaatgtatgcattatctgatggattcaactgttctctcactgccgctgcttaacttggtagccatctctacgatctgattttaaaggattgtgcggtcattaatattatttct

SEQ ID NO: 1084 - DNA, 777 bp, Artemisia annua
gagcagcaaaaaagggtccaaaatttgcagctatgaagaaactagtctcccacaaagcaattaaacaacataaagaagaagtcttaaaccctaacaagaaagacttaactaagcagaatcttccaagaaatgtgccttatgtatcgtctgcgttgttctttacgtataatacggcgctcggtccgccttatcgggttttggttgatactaatttcatcaatttttccatccagaataaattggacttggagaagggaatgatggactgcttgtatgcaaaatgcactccatgtattaccgattgtgtgatggctgaacttgagaagcttggtcaaaaatatcgggttgctctgagaattgccaaggatcctagatttgaaaggcttccctgcactcacaaaggaacttatgctgatgactgtattgttgaaagagttactcagcacaagtgctatatggtagcaacatgtgatagagatttgaagcgtaggattcgcaagattcctggtgtgccaattatgtatatcacccaacacaagtactctattgaaagattgcctgaagcaaccatgggtggagctccaagaatatgagatttgatttgctgcaagctatatcgagtatgatctttacaagcgcctgctgttctttgagaatatgttgctcttttctaattttaatttaccgggtttgtcctataatagatgagatatgagattgttggatattgccattgcaccttagaagcaagtaatgttcaagtatgttttatttacc

SEQ ID NO: 1085 - DNA, 1192 bp, Manihot esculenta
aaaggcaaacccaacttccaaaggtttgcttccttccaatctacgccttgatattctttcctgcatcccgtccgccgctgctatacaactgatcgctgctttcattccatctctttgctggggctcatacgccgcttttcactgccgctgctgttgtatccagaagaaaatttccttcatctcgcaggtcagttctctttactgaagtaaaaagataggggacgagataatacattaatttgtccagcaaggcaaacacaactctacactatggggagggcaaaaaagggcccaaaatttgcagcaatgaagaagataatcacctctaaagcaattaaaaaatacaaagaagaggttctgaatccagctaaacaagatctctccaaggacaagctccctcgtaatgtgccccaagtttcttctgcactttacttcaaatacaacacagcattggggccaccatacagggttttggtagataccaactttatcaatttctccatccaaaataaattggatttagagaaggcaatgttagactgtttgtatgcaaaatgtacaccttgcatcactgattgtgttatggcagagcttgagaagttaggtcagaaataccgtgtagctctgaggatagctaaggatccacgttttgagagactgccctgtattcacaaagggacttatgctgatgactgtattgttgatagggttactcagcataaatgctacattgttgcgacgtgtgatcgtgatctgaagcgaaggatacgcaagatcccaggtgtgccaattatgtacattacacaacacaaatattcaattgagaggatgcctgaagcaacaataggtggagctccaagattttgaggcaacttccaagagtgggaagatttatggttttgtcacaattctcatctgctctttacttgttaccaaagggttttgttaaaaaaaaaaatcagtctaatgttagtggatggtttagtgcctgtcatgagctgagcagaatttgatatgttttacgtttttttttctaattagaaatttagtttatcttttttatttttaaaaatttgagaaaaagaatgttggttgagctgcattgatccgatttattactgcaacgttgttgttagagttggaaaattaattaaactacatgcttctattatagttctttatagctaaagtt

SEQ ID NO: 1086 - DNA, 1083 bp, Coffea canephora
ggaatgtggcagaggagcggtcttcatcttcaccgtcctaaaattgtcaaatattggaagggtttatacaagggttttagttaatttccaggttccgtaggtgaagaatttggattccatacatcctctgctacttaatagttcccttgtacaatcaatccccgatcgaaagcacaatgggtaaagccaaaaaagctcctaaattcgcagtaatgaagaaaatggtcacttccaaagccattaaacagcataaagaggaggttttgaatcctaacaaaaaagatttaactaaagagaagctccctagaaacgtgccaaatgtatcgtctgcacttttcttcaagcacaatactgctttgggtccgccatatatgatattggttgatactaactttatcaacttctctattcaaaataagttggatttgcagaaaggaatgatggattgcttgtatgcaaaatgtactccttgtgtcacagactgtgtaatggctgagcttgagaaattgggtcaaaaatatcgggtcgctttaagaattgctaaggatcctcgatttgaaaggctgccatgtacacataaaggaacctatgctgatgattgcatcgtagacagggtcacccagcacaagtgttacattgttgcaacatgtgatcgagatttaaagcgaaggatacgaaaggtccctggtgttccgatcatgtatattacacagcacaagtactccattgaacggctgcctgaagctacaattggtggagctccacgaatttgatgcaacagttgagttaataggaacttgctcccagaatgtggagtttctcgtccatggcattgggacaaggttctgttgaagtcattctgtaatctctctctgaggtggtcctgtttgtggctgatccgagttatttatgtcgcctgtcagaacttttgtaaatgtttctccttttatgttgcttaatttacttttgaaatgttgtttctggtttccatgtactcgcaaaacaaattttatatcagtgatgcaaggatatttgaggagcgaacttgaagaacagctacggtgatgttaacataacgtagct

SEQ ID NO: 1087 - DNA, 719 bp, Cyamopsis tetragonoloba
  misc_feature (633)..(633): n is a, c, g, or t
  misc_feature (643)..(643): n is a, c, g, or t
  misc_feature (682)..(682): n is a, c, g, or t
  misc_feature (719)..(719): n is a, c, g, or t
ttctgttgcatgcgacgccgccctctcctcctctttgattttgaatctggttaggattttgtgtaatctagctctacatccacgatgggtaaagctaagaaaggccccaaattcgcggttatgaagaagattgtcacttccaaagcaatcaaaaactacaaagaagaggttttgaacccagaaaagaagaatcttctcaaggaaaagttaccccgaaatgttccaagtcattcttctgcgcttttctttcaatacaatactgcattgggacctccttatcgtgttttggtggataccaacttcatcaatttctccatccagaataaattggatctggagaaaggaatgatggattgcttgtatgcaaaatgcactccttgtatcacagactgtgtgatggcagaacttgagaaattaggccataagtatcgggtagcactaaggattgcaaaggatcctcgatttgagcgaatactctgtactcataaagggacctatgctgatgattgccttgttgagagagttactcagcataagtgctacattgtcgcaacatgtgaccgggacttgaaaaggagaatccggaagattcctggtgtgccaataatgtacatcactaaacacaagtactcnatcgagcgantgcctgaagcaacaatcggtggagcaccaagaatttgangcagtaaaactggagaagctgtgtatatctataatcn

SEQ ID NO: 1088 - DNA, 861 bp, Lactuca sativa
gggggaatcagggtttagacacacacacacacagatggggagagcaaagaagggtccaaaattcgctgtaatgaagaaaatggtctctcataaagagattaaacaacataaagaagacgttttgaatcctaacaaaaaggatttaacaaagctccctagaaatgtaccctatgtttcttctgctctgttctttacatacaatactgctctgggacctccttatcgagttttggtcgataccaacttcatcaatttctccatccaaaataaactggacttggagaagggaatgatggattgcttatatgcaaaatgcactccatgtattactgattgtgtgatggctgaacttgaaaagcttggtcagaaatatcgcgttgctttaagaattgctaaggatcctagatttgaaaggcttccttgtactcacaaaggaacttatgctgatgactgcattgttgaaagagttactcagcataagtgctatttggtggcaacatgtgatagagatttgaagcgtaggattcgcaagatacctggtgtgcctattatgtatatcacacaacacaaatactcaattgaaagattgcctgaagcaacaatgggtggagctccaagaatgtaacatttgaggtgcttttgtatggtatccatgatgatgatctttacattagcctaaaaagatgatcttgtttcattttacacaatgtgtgtgtgtgtgtttttattatatcagttttgtctaatgatacatgtaagagatgagatcttaactgattttctactttaaagcaagtagaatactaaaacgatcaaccaattgtgacagaaaaagtgcttaacatatagtcttaaacataa

SEQ ID NO: 1089 - DNA, 1505 bp, Populus trichocarpa
agagcaatctaatacagcgaagctgggctggactcttcgggctccatattcctcgtttaggttaaacaaaatccctgcggcgggcgactcctttaaataaactcttttcctcaccgtcaccgacccaagcaaaagaacggtgaatctcaggccgtcgctctcttcctctgcgtgtattataaaccagactgaatatactttgcggggcagaccatctttagcaagaggaacaacataaaatattttgtcagtttctattcgcaaacacaacctcttatcttttcctgtttattagggtttgtactgtcttaggtttttaatcttcaaacgaagcgatggggagagccaaaaaaggccctaaatttgcaaaaatgaagaagatgattacctctaaagcaattaaacaacataaagaagaggttttgaatccgaagaaaaaagatttgtccctcgaaaagcttccaagaaatgtgccacaggtttcttctgctctctacttctcatacaacacagctttggggccgccatatagggtcttggtggatactaacttcattaatttctctattcagaataaattggatttagagaaggcaatgctggactgcttgtatgcgaaatgcacaccttgcatcacagactgtgtgatggcggaacttgagaagttaggtcagaaataccgcgtggctttaaggattgctaaggatccacgttttgagagactaccctgtattcataaggggacttatgctgatgactgtattgttgaaagggttaccaagcataaatgctatattgttgctacatgtgatcgagatttaaagcgaagaatccgcaagatccctggtgtgccaatcatgtacatcactcaacacaaatactcaattgagcggttgcctgaagcaacagtaggcggagctccacgatattgataactttcaagattgggagaacagaggattttgcttgatgctcttggatgttatttatcctaccatatggaaatatggttgaggtcctttaccatatggtgacttttttttagtgtagttgcttcctacctcgaaatgagggttgaaattttgttgtttctataatcagaggaaatcttcacaatatgcaactgtttttagctgtactccttgtttcattattctatatcacgcttgcagtctgaattatgcttcaaccccgctcaaacttggcaaccgaagctttgccgttttcctgaatttgatgggtggtcgaattgttttgtattctcacgccaatgcatttattccccatgaattggacctcggtggcgttacagccagcattgttgatgcagaagataaggactctgatgatttataattatatttaatagttaatgcaacaatacgaagaacactgaacaaagttctcagaccaagccgaatatgtagatgggggtagtttttgtttatttgcagaaaatcacacccggatgatttaatggttaatatcagtttgtgaatttttta

SEQ ID NO: 1090 - DNA, 805 bp, Prunus persica
ccagactaaccgacccaagtgcgaagttgagctctctctctatttgttggtttccgtagggtttattggggacaaagtaaaaggttttagggttctgcgcaatcccaaatttgcaagcttgttttgctctgtgatcaacaaagagatggggagggcacgcaaaggccctaagttcgcagtcatgaagaaggtggttacctccaaagcaattaaaagctacaaagaggaggttctgaacccaaacaagaaagatctcaccaaagaaaagctaccaagaaatgtgccaaatgtttcgtcggcgcttttcttcaaatacaacactgctttggggccgccttaccgggttttggtcgatactaacttcatcaatttctctattcagaataagttggatttggagaaggcaatgatggattgcctatacgcaaagtgcactccttgtatcacggattgtgtaatggcagagcttgagaagttaggtcagaaatatcgtgtggctctgaggattgccaaggatcctcgttttgagagactaccctgcactcataaaggaacctacgctgatgactgtctcgttgaaagggttactcagcacaaatgctacattgttgctacatgcgatcgagatttaaagcgaaggatccgaaagatccctggtgtgccaatcatgtacatcactcaacacaagtattcaattgagcggttgccagaagcaacaattggtggagctccaagattttgatgatggggatgtgacctttacaaagcaaagactagttccaccatgtgatgcgaatcacatgct

SEQ ID NO: 1091 - DNA, 967 bp, Nicotiana tabacum
  misc_feature (254)..(254): n is a, c, g, or t
  misc_feature (542)..(542): n is a, c, g, or t
  misc_feature (665)..(665): n is a, c, g, or t
agcccttgctcgatcacagttggagaaccaaaaatgggaaaagcgaagaaagcccccaaattcgcagtgatgaaaaaaatggttactcacaaagctatcaaacagtacaaagaggacgttttgaaccctaataagaaagatttgactaaagagaagctccccaagaacgtgccttacgtttcgtctgcgcttttcttcaagtacaacacagctttgggaccgccttatcgagttctagtcgatactaactttancaatttctccattcagaataaattggatttggagaaaggaatgatggattgtttgtatgccaaatgtacgccttgtataacagactgtgttatggctgagctggagaagctgggtcagaaataccgtgttgctctgagaattgcaaaagatccccggtttgaaaggcttccctgcactcacaaaggaacatatgctgatgattgtattgtcgagagagttactcagcacaagtgctatattgttgcaacatgtgatcgagatttgaagcgtagaatacgcaaggtccntggtgtaccaatcatgtacattactcaacacaaatattccattgagaggttgcctgaagcaacaataggtggagctccaagatattgagtatgtgtttcgagcagtcaacaatggaatttccnagaccttggatggtggttcgaattgccaacgcttggccatcaccgctaagactaccagatctcactgcattgttgcagaattgaaaatgctgaagtatcagtcagagtctcaattttgtacccgctggattgttatctgtgttcctcaatgataggaatctcgttcaattttggtcagtttaggatctatagaagccccagtgtgtaaatcttaattaaacatccaatagcgctattctaaggtattcccacagaactataatctgtgcttccttttaagtgtaaggagatgttatcaacct

SEQ ID NO: 1092 - DNA, 1010 bp, Cucurbita pepo
accactccctctctcattctccctccgtgtcgccgccgcctctctccggttgttgcagcgccgtcgtcttccctgctgccgcagcctctctaccagcggtttgcactcattctccctttcctgtcgccttcgccatcgtcttcccttctgccgcagtctctctccagcgggcttgtactgattttcaactatatcgttgttactgattaaccaattcaaatccaatggggagggccaagaaaggacccaaatttgcagtcgtgaagaagatgatctcttctaaagcgattaaaaactacaaggaagaggtcttgaataccaaaaaagaaagatctaacgaaagaaaatctcccgagaaacgttccaaatgttccttcagcacttttcttcaaatacaacactgcattggggcccccttatcgggttttggtggatacgaatttcatcaatttctccattcaaaacaaattggacttggagaagggaatgatggattgtctgtatgcaaaatgcaccccttgtataacagattgcgtgatggctgaacttgagcgattaggtcagaagtatcgcgttgctcttagaatagctaaggacccacgattcgagagactaccatgtactcataaaggaacctatgctgatgattgccttgtcgaaagggtgactcagcataagtgttatatcgttgccacttgtgacagagatttaaagcgtaggattcgtaagattcctggtgtaccaatcatgtacataacccgacatcagtattcaattgagcggttgcctgaagcaacaatgggaggagctccaaggatgtgattgtggcagtttgcaaggatgacagaaggaaaagaattttgtaagaggtttccccatgtaacttacttttggccttaggttaatgctgtatttatacggtgtttaagattatattttgactggcatgagcttagtctgatagaattaatcacatatttgtttgaatgaatatctcagtcatatcgtat

SEQ ID NO: 1093 - DNA, 1080 bp, Sequoia sempervirens
ctgtggtagggtttcgtaaaattttcgtgcgtactttgccgtttttactcatcggcatcgttgacagcacgacacaatttgtgcagaatcttgattaagtcacttgccatagtttcagtggtagagttcttcatcaaagatgggaaatcaaagaagacacccaaatttgctaggatgaaaaaataattagccataaacaatccgcagttacaaagaagaggtgcttaatccaaacaagaagaatacagtgaaggagaagctgccgagaaatgtaccaaatgtctcctcagcactctttttaagtacaatactgcactggggccgccatatcaagttttggtagataccaattttattaacttctcaatccagaacaagttggacttggagaaagcaatgatggactgcctgtatgcaaaatgtactccttgcatcacagactgtgtgatggctgagctggaaaagctaggacagaagtatcgtgttgccttacgaattgcaaaggatcctcgttttgatagattgccttgcactcataaaggcacttatgcagatgactgcattgtagaacgtgttacccagcataagtgctatattgtagccacgtgtgatagggatttaaaacgtcgaattcgaaagatccctggtgtgcctattatgtacattacccaacacaaatattcattgaacgcttgccagaagcaactataggaggcgcaccacgattttagcactgatgtttgccagcaatgcggtgaacaatgcacaattctgtaaggagagtctcttatacttgtataacctttattctcagcagtgttggtgagtcacatttttattaacctggtaacaatttcagaaattttgtttcaaagacacgagccatgttttggggcatttgttccttttgtaaagcacatccaaggaaactagaaaaaaagagtcaatttacctcagcaaaactttaggtgatagtggagtttttgagcaaatgtaccataaaagaaacgaataattttggtattgtaatgacgttgatttttattttatctttgtgtcgttggtgatagctatttcaaa

SEQ ID NO: 1094 - DNA, 738 bp, Persea americana
gcaatggggaaggcgaagaaagcccccaaattcgcagtttgtgaagaagctcgtgagctccaagactctccgaaaatacaaagaagaagttctaaaccccaaaaggaaagatcttgaaagggagaaactcccccgaaacgtcccaagtgttccgtcggcgctgttcttcaagcataacactgctctcgggccgccatatcgggttttggtcgataccaacttcatcaacttctctattcaaaacaagttggatttggagaaaggaatgatggactgcttatatgcaaaatgcaccccttgtatcaccgattgtgtcatggcagaactggaaaaattaggtcagaagtaccgtgtagctttgaggattgcaaaagatcctcggttcgagagactaccttgcactcacaaaggaacgtatgctgatgattgtcttgtggatcgggttactcagcacaaatgctacattgttgctacatgtgatagagacttgaagcgacgcattcgcaagatccctggtgtgcctatcatgtatatcacacaacataaatattcgattgagcgcctgcctgaagcgacaataggtggagctccaaggctctgatgcggacagccattttgcgagggacagctgttgcttgagcctacacgttgatggttattttattttatttttatgccctgtactgagtattcaacttacacatgttatctcatggataatttctcacaatgttgttg

SEQ ID NO: 1095 - DNA, 1114 bp, Theobroma cacao
cagaccccctctttattatacggaaaattccggaactgctccagggatttcctgttcgggtttgaggtttccggcgcttttgattttacaggcttcaatcggaagcgatgggaaaagcaaagaaggccccaaaatttgctagcatgaagaagatagtcactcaaaaagctattaaaaagcaagaacaagttttgaatcctaacaagaaagacctgagcaaggaaaaactccccagaaatgtaccgaatgtttcttcagcgcttttcttcacgtacaacacctccttgggacccccttatcgggttttggtggataccaacttcatcaatttctccatccagaacaaattggatttggagaagggaatgatggactgcttatatgcaaaatgcactccttgtatcacggattgtgtgatggctgaacttgaaaagctaggtcaaaaataccgtgtagctctgaggattgctaaggatcctcgttttgaaagactgccatgcactcataaaggaacctatgccgatgactgtattctatttcgtcgaaaacagcacaaatgctttattgttgctacatgtgatcgagatttaaagcgaaggattcgtaaggttcctggtgtgccaatcatgtacatcactcagcacaaatattcaattgaacggcttcctgaagcaaccattggtggagctccaagattctgatatgaagtgtaatgcttcagcagtagtgatctttagactctattctgataacccatatgctcagctctttgtcacggtgaagaggagtgaagcccataaggttgcagtggcttgcgagtataggtcagcaatttacttagggatcatctgcccaaccaatgtaacacctacttctggtgttgttttatttcttttccagcgaaaacacttaagtgaatgtatgacccttacggttgagatcatgaggtctatttgccccaagttttgactctcttgagttgtcggtacgattgttctcctacccggcatgagtgttaaaagtattatatacagtagttgctaagtaggcatgatcatccttgaatgtacctaacattttccttcttgtagaaattaaagttacagatttctga

SEQ ID NO: 1096 - DNA, 1291 bp, Eucalyptus grandis
ggtggtgcaactggcagtggttcggtttcctccgccgccttgcttcccgccgccactctctctctcgctgcgacaaggaggcgcgcacggagaccgagggaacgtaggtatagaagcgcatcatcttcttactccagaagcaaggaggagcaattcacgctgaatcgtcgtcgtcggtcgtcgtcgactaatcgtaacacgcaggccacgagaagggttttttgaggtgaagaagagatggggagagctaagaaaggccctaaattcgccgccatgaagaaaatcgtcacctccaaagccatcaaaaattacaagcaagaggttctaaaccctaacaagaaggacctttccaaggagaagctccccagaaacgtgccaaatgtttcgtccgcgctcttcttcaagcacaattctgccttgggaccgccttatcaagttctcgtggataccaacttcatcaatttctccattcagaataaactggatctggagaagggaatgatggactgcttatatgcaaaatgtaccccttgcatcacggagtgcgtgatggcagagcttgagaagctgggccagaaataccgtgttgctttgaggatagcaaaagatcctcgatttgaaagattgccttgtactcacaaagggacctatgctgatgattgccttgttgagagagtcactcagcacaaatgctacattgttgccacatgtgatcgagatttaaagcgaagaatccgtaagatccctggtgtaccaatcatgttcattacacagcacaagtattcaatagagagattgcctgaagcaacaattggtggagctccaagattttgagtgtggcatcatggcgttgtggggaagacttggttccgccaacttaagttcactgaaaatgcagtaccagatgttgttccggctcaatgttggactcggtgccagggcaactgggtcttcacaaggaaccgttctatgctgagctctagaccctgtgatgtaggattaacctctgaattttgcttgtcaagttctctcaaattttgtagcttcctcttcttgagcctaatctattcgtaaatggatctgttttagtttaagccatcttcttcttaaaatggttggcctatagccatacgttaaatcgtgattactgcttggtgttgcatctcgctacttggtcttgtcattttgggacttgttaacactcctcgatttggcaaaagccccaggtcaaggttaaacaagctgccggtacatatctcctgacgccatcaacattcgaaaatatttttga

SEQ ID NO: 1097 - DNA, 894 bp, Fagopyrum esculentum
tcctccgctcctctgttcattgacgccgcagggtttgctgccacccaccagaatttcaacctcgtttccctgtgtttgaattgaaagttgtacgagatttaggttttagttcggaaggcatgggaagagcaaagaaaggtcccaaatttgctgtcaagaagaagctcgtcacttccaaggctcttaaacaacataaacaggaggttttgaaccctaacaagaaggaccttgagaagcttcctagaaatgtgccgtatgtgtcatcagccttgttcttcaaacataatgtagccttgaagccgccttacagggttattgttgataccaacttcatcaatttctctattcaaaacaagttggatctggagaaagggatgttggattgcctatatgcaaaatgtactccttgcataaccgattgcgttatggctgagcttgaaaagttgggtcaaaagtatcgtgtagcactgaggattgcaaaggatcctcggtttgagaggctgccttgtacccataaaggcacttatgctgatgactgtatcgtagacagggttactcagcacaaatgctacattgttgccacatgtgatagagatctgaagcgaaggatcagaaaggtacctggtgtgccaatcatgtacatcacacaacataagtattcaatcgagcgactgcctgaagccacaatcggtggagctccaagatattaacgtactcggttcagtcatttggtggcgtggaacgaacttgtatggtccaaacggtctgtctactcgcaacagatcaatgatcctgtgaacttcagatcatcacatctcatctcaggcatcttgatgaaagtttttggttattttgacatgcataacattccttcagatccttgtaatggaatat

SEQ ID NO: 1098 - DNA, 786 bp, Taraxacum officinale
ggtttagcgagacagaagacatggggagagctaagaagggtccgaaattcgcagtaatgaagaagctagtctctcataaagcgattaaacaacataaagaagacgttttgaaccctaataaaaagaatttaacaaagctccccagaaatgttccctatgtttcttctgctctgttctttacatataatacggcacttggaccgccttatcgagttctggtcgataccaatttcatcaatttctccatccaaaacaaattggatttggagaagggaatgatggactgcctatatgcaaaatgcactccatgtattaccgattgtgtgatggctgaacttgagaaacttggtcagaaataccgtgttgctttaagaattgctaaggatcctagatttgaaaggcttccatgtacccacaaaggaacatatgctgatgactgcattgttgaaagagtcacccagcacaaatgctatttggtagcaacatgtgatagagatttaaagcgtaggattcgtaagatacgtggtgtgcctataatgtacatcacacagcacaaatactcaattgaaagattgcctgaagcaacaatgggaggagctccaagaatgtgagattttgaggtgctattgtatgcctaaaaacaagattttgagaatatgtttctgttttataatcgtttttacatgtaacagatgggatcataatagtttttgtagtttaaactttaaagtaagtaatgtacacatttgtttggagtgaaaacatctagcaattgtgattgaaaaa

SEQ ID NO: 1099 - DNA, 1128 bp, Rhizophora mangle
acggccaccgtattttgctccgtcatcgttacagcctccagctaagctacctagcccctcctttttcctccgtctttctctctctctttgatagacgcgattggaaaatcagcttcggattagggttttcaagcgttattgatccttagtcgttgggaatggggaaggcgaagaagggtcctaaattcgcggcagtgaagaagatggttacttcaaaagcacttaaacattataaagaagaggttttgaatccggggaaaaaagatgtttccaagcagaagctcccaagaaatgtgcctcaagtttcctcagcgctttacttagggtacaacacggctttggggccaccatacagagttttggtggataccaactttatcaatttctccatccagaataaattggatttggaaaggggaatgatggattgcttgtatgcaaaatgcacaccatgtatcacggactgtgtgatggcagagcttgagaagttaggtcagaaataccgtgtggctctgaggatagccaaggatccacgttttgagagaattccctgtattcataaagggacctatgctgatgactgtattgttgatagggtcactcagcataagtgctacattgttgcaacatgtgatcgagatttaaagcgcaggatacgcaagatccctggtgtgccaataatgtacatcactcaacataagtattctatcgaacggttgcctgaagcaacaattggtggagctccacggttttgatgaacctttcaaaggggaagactagagggtttataacttctaagaagaggagagttttgcaaattgcaccatccattttttccgttccttgcatcttaggtctcagtgctgctgggaggctggagttgttttgcatcaaagtaactgtgataaatgattgtaattgagctcgtgcggtgaatattaactccactgagctgcaattttagcttcactggagttgttaacgcattctgcttttagaagtgcttaatttgtgtctggatgcaagacttctccattttctgaactgtcgccagagagaaaatggcttgggtgagtatcctgaacccaaccccaattaaatatacatatttattaaaatatacatatt

SEQ ID NO: 1100 - DNA, 910 bp, Malus domestica
ctaaattccctttctcccttcccactcccgtaaccctctctcccgacccgccgtctgttcttcctagcccctctctcccgcggtatgttcttctggtagcctctctcagtatctcttttctcctccctcgtgcagtggacgcctggacggaataattcttgtcatctctgctctagtcgtcactacatctctgcattctccagattccactccaggtgtttttcagagaacactataaaaatagggtttaaggtttttgcactatctgtaaactttggttgtctctgtgattcgaaagatggggagagctaaaaaaggaccgaaatttgcagtcatgaagaaggtggtcacctccaaagcaattaaaagctacaaagaggcggttttgaatccgaacaagaagaatctcacgaaagaaaagctacccagaaatgtgccaaatgtttcttccgcgctgttctttaaacacaacactgctttgggaccgccttatcaggttttggttgataccaacttcatcaatttctctatccagaataagttggatttggagaaaggaatgatggattgcttgtacgcaaagtgcactccttgtatcacggattgtgtaatggcagagcttgagaaattaggtcagaaatatcgtgtggctctgaggattgctaaggatcctcgttttgagagactactctgcactcataaaggaacctatgctgatgactgtattgttgaaagagttacccagcacaaatgctacattgttgctacatgcgatcgagatttaaagagaaggatccgaaaggtccctggtgtgccaatcatgtacatcactcaacacaagtattcaattgagcggttgccagaagcaaccataggtggaggtaggcttggataccaaaaactcacataa

SEQ ID NO: 1101 - DNA, 1126 bp, Cajanus cajan
tctctcggctgggagtatcgttagggttttagaacaactcagacacacgggtttttgcattatctagctttttctctccatccacaatgggtaaagctaaaaaaggacccaaatttgcggtaatgaagaaggttgtcacttccaaagcaatcaaaagttataaagaagaggtattgaacccagaaaagaaaaaccttctaaaggaaaagttacccagaaacattccaagtcattcctcagcactattctttcaatacaataccgcattaggaccccccttatccgtgttttggtggataccaacttcatcaatttctccatccaaaataattggatctggagaaaggaatgatggactgcttatatgcaaaatgcaccccttgtatcacagactgtgtgatggcagaacttgagaaattaggccaaaaatatcgtgtagctctaaggattgccaaggatcctcgatttgagagaatactctgtactcataaaggaacatatgctgatgactgccttgttgagagagttactcagcataagtgctacattgttgcaacatgtgatcgggatttgaagaggaggatccggaagattcccggtgtgccaattatgtacatcaccaagcacaagtactcgattgagcgattgcctgaagcaacaattggtggagcaccaagaatatgatgcagtaaaactgataaagcagcaagtaggaaaaatattgatactaattgcttggtggaggagcatgaaatcctgtccaagttccatgcatgtttggtccttttgttggcagtggattgacctcttatggaagctttacatgaacgagaagcaactcttcaattttgatacatgaaatgtccttactgttactgtagctggagatttggattccgtcaaatcttgttttccgcgtgttgcgttactaatgtatcatggtgaaccttggagtgactaaattacgatgacatgttcatagttctagccacataaattactaaatgatatatctacatatttatatatatgttggaagagaaaaaaagtttatttccttgaattttattcgtattgacttcatccttcttgtatgttagaagactgattcggaaattggaaaatt

SEQ ID NO: 1102 - DNA, 1151 bp, Cucumis sativus
aacctccatcatcgtcctttactctcacgtgctccaccacacctccttcttcttcttcttcactccgtctcttcctctctttcagcagctcattgtcgccgccccctctctcccgttcagtgctactgccgccgtttccgtcgccgtctttcctctgctcgtgtcgtcccagcctctctccagcagatagtgagcaagttctcttttaagatttaaagcattgaaattgcatccgagtaagcgagagaatttagacagccatttggtggcacaacttcaattttttacccttcaatcaacgagatggggagggccaagaaaggacccaaatttgcagtcatgaagaagatggtcacctccaaagcgattaaaaactacaaggaagaggtcttgaatccaaagagaaaagatctaacaaaagaaaacctcccaagaaatgttccaaatgttccttcggcacttttcttcaagtacaacactgcattggggccaccttatcgggttttggtggatacaaatttcatcaatttctccattcaaaacaagttggacttggagaagggaatgatggactgtctatatgctaaatgcactccttgtataacagactgcgtgatggctgagcttgagcgattaggtcagaagtatcgcgttgctctgagaatagctaaggacccacgttttgagagactaccctgtactcataaaggaacctatgctgatgattgccttgttgaaagggtgactcagcataagtgttatatcgttgctacttgtgatagagatttgaagcgtagaattcgcaaggttcctggcgtacccatcatgtatataactcggcatcagtattcgattgagcggttgcctgaggcaacaattggaggagcgccaaggatgtgattgtgggacttacaatgatggacaaaagaaaaaaacaaaattcttgaagaggtttttcccctccaccaccaaccaactttccccaagagaagattaaattaaaagaaaatattaggaggccttggtatcatgtaaatttcttttggctttaggatctgtttctttttgttgcccctcctttctacaattatttgcttttctttttacgtcaagttaatgtatcccctaaagatgaaaaaagtgcttctccc

SEQ ID NO: 1103 - DNA, 1004 bp, Triphysaria pusilla
cattacggccggggcatttccaaaccttcgaagtttgaacgataacaaaagtttcgtttcgagccggaatttaatttaacgatgggaaaagcgaagaaatcccccaagtttgctgtgatgaagaaaatcgttacccataaagcacttaaacattacaaagaggagattttaaaccctaacaagaaagatttgaccaaggagaagctctccaaaaatgtaccgcaagtttcatcagctctgtatttcagtcacaatactgcgttgggcccaccatatagagtcttggtggatacaaatttcattaatttctctatccaaaataaattggatctggagaaagggatgatggactgcttatatgcaaaatgcactccttgcatcacagactgtgttatggctgagcttgagaagttaggtcaaaaataccgtgtcgctctaagaattgcgaaggatcctcgatttgaaaggcttccttgtattcataagggaacttatgctgatgattgtctagttgatagagttacaatgcacaagtgctatattgttgcgacctgtgatcgtgacttaaagcgaagaattcgcaaggtccctggggtacctataatgtatatcactcaacacagatattccattgaacgtttacctgaggctactcttggtggagctccaagaaattaatacgacaactccgtatctcgaatgaaacattgtaggagctaacaattgaccttgcacaaggttaaatgatgcaaacgagggggcttgtgattagtacaaggggttgtggttttggtgcgattatctgtgaaatttagtacgttttatatctgtcctgaatagttattaacaccgtactttatgcgtgttgtgatcttgtactgaacttatgcttggataatatttcaccttaaaggctgattgttcgtgttctgatatgattatcttttataaatcttaaaaagagatgtgttataatttcgagagataaaaaaaaaaaaaaaaaa

SEQ ID NO: 1104 - DNA, 945 bp, Nuphar advena
  misc_feature (536)..(536): n is a, c, g, or t
gtgcccggaaacattctccgattttcctacgaatttgggcaagtgggtatcccatccattcctccggaaggccggtgaagtgctcagaagatggggaaatcaaagaaaaccccaaaatttgcggtcaagaagaagctcgtgagctcaaagacgctaaaaaagtacaaggaagaggtgctcaaccccaacaagaaggacacccaaaaggagaagctccccagaaatgtgccaactgtgtcatcagcactttacttcacatacaacactgcacttgggccaccttacagggttttggttgataccaacttcataaatttctcaattcagaataagctagatttggtggatgcaatgatgcaatgtttatatgcaaaatgtacaccttgtattacggactgtgtcatggctgagcttgaaaaattagggcagaagtaccgtgtagctctgaggattgccaaggacccacggtttgacagacttccttgcattcataaaggaacttatgctgatgactgtattgttgacagggtaactcncacaaatgctatatagtagcaacttgtgatagagatttgaagcgaaggatacgcaagatccctggtgttcctattatgtacatcacacagcacaaatactcgattgaacgcctaccagaggcaacactgggaggagcaccacggatatgaagttggatgatctcctggctacttgaaagactgcaggttcctttacaccttttaagagcttttgttgaaaaaatcttagctcaaaatcatagtatcttctgattccaatggacccgtttcaatggttgctactgttgctgcaacttatagtcgtaactctgtgttagtcgtcagctattatttgccggatcatggcatcacaattttgttacaagttcagcttttaaacagttttggtatgtcattgcttattatctca

SEQ ID NO: 1105 - DNA, 1068 bp, Gossypium hirsutum
tcttcttggttctcattcgcctcttttggcggaacatcttattgtttcgaggggttgttgttcagtttcaaggtttcttgcttttttgtttttactagtttcaatctgcagccatgggaaaagcaaaaaaggcccccaaatttgctggcatgaagaaaatagtcactcaaaaagctattaaacattacaaggaccaagttttgaaccctaacaagaaggacctcagcaaggaaaaactccccagaaacgtgccgaacgtttcttcagctcttttctttacacacaacacctccttgggaccgccttatcgtgttttggttgataccaacttcatcaatttctccatccagaacaaattggatctggagaagggaatgatggactgcttatatgcaaaatgcactccttgtatcacagattgtgtgatggctgagcttgaaaaattgggccaaaagtaccgtgtagctttgaggattgctaaggatcctcgttttgaaagattgccatgtgtccatcaaggaacctatgctgatgactgtattgttgagagagttacacagcacaaatgcttcattgttgctacatgtgatcgggacttgaagagaaggattcgtaaggttcctggtgtgccaattatgtatgtcactcagcacaagtactcaattgaacgacttcctgaagcaaccattggtggagctccaagattttgacatgcaagtattgatatttcagtagcagtgatctctgggttcaattttgatacgatgagataaagtagttgaggttgtagatgggctatatattatatatagctaaacatttatttgcccaacctatgtaatcagcacctctcccagtgttttatttactcttttccagattaacatagtgcatgtcttcgataggtgatcttaatgggtgataatttgagaggcgtatactattttaacagtataatacactgtacttgtttatgacaattgtagtcatatttcttacttcgataatctgaatttgctactaattggatccaaaaagaaaaagtaccgactgcgactctgcgttgat

SEQ ID NO: 1106 - DNA, 702 bp, Vinca minor
aggaggagagagaagaagaaaagatgggaaaagctaaaaaagccccgaaatttgctgttatgaagaaaatggtgacctcaaaagcgattaaacaatataaagaagagattttgaaccctaataagaaagatttgaccaaaggaaagcttcccagaaacgtgccaaatgtttcatctgcacttttcttctcgcacaatacagctttggggcctccatacagagtactggtggatactaacttcatcaatttctctattcaaaataaattggatttggagaaagcgatgatggactgcttgtatgcgaaatgtactccttgtatcactgactgcgtaatggctgagcttgagaagttgggtacaaaataccgtgttgctttgagaattgcaaaggaccctcgatttgaaaggcttccctgcacacacaaaggaacctatgccgatgactgcttggtggatagagttactcagcataaatgctacattgttgcaacatgtgatcgagatttgaaacgaaggatacggaaggtacctggtgtgcctatcatgtatatcacccagcacaagtactccattgaacggttgcctgaagctacagttggtggagctccgagatattgataccacaaatgagtcgtacaattctcaggaagatgttttccctagctatcacgcatgagaagagaatttggcatactggagg

SEQ ID NO: 1107 - DNA, 1313 bp, Quercus alba
tagtatcagccccggaattccccggggattcagagtttctgttttcagttttcacgcctcccctctcaatcacattgcacaggtactctctctctctctctctggaaatttcttaaaaccgaaacttgattataaatcatttatgtatatgttaaatattatttatatatatatatatatgaggcggtcggttcggttgctcatcggaatgcaaaatccacaaccgctcgccgcaccggccgtcgtcggaatttgaaaatcgcctccgaccaccgcgccatgcacctccggtggagctctgtagggtgcggttcggatcggtgcaggccggttttgtcggctgcgggcagtatctgaacaggcctacagacaggtttctgggactcactctctctctgttgttcggactaggaataacttcatcttagtttgttctgctgttcatcctaagagatggggaaagcgaagaaaggtcccaaatttgctgccatgaaaaaaatggtcaccaaaaaatccattaaaaattacaaacaacaggttttggacccaaaaaagaatgataacaacgaaaagaagctcccaagaaatgtgccgaaggtttcatctgcacttttcttcaattacaacacctcgttgggaccaccatatcgggttttggtagataccaacttcatcaatttctctatccagaataaactggacttggagaagggaatgatggactgcctatatgcaaaatgcactccttgtatcacgcaatgtgtgatggcagagcttgagaagctaggtcagaaatatcgagttgctttgaggattgctaaggatcctcgttttgaaagactaatttgcactcataaagggacctatgctgatgactgtattgttgacagagttacagagcataaatgctacattgttgctacatgtgatcgagatttgaagcgaaggatccgaaaggttcctggtgtaccaattatgtatattactcggcacaagtactcaattgaacggttgcctgaagcaacagtcggtggagctccaaggtattgatgatggaagtaagatgttcaacaatgggaaggcttagattctgttatgattaatcaggttgagtactgatctttgtttgaacttccttctgtcctgagtgaaagaaaaggagaaagaagttttgtgtaggttatataattttggattctcacttgttaaattgaattagagtttttacttatcaaaaaaaaattgaattagagttttgtcttgttttatcttgacttctataatttaagaacctatatacgtatctcctactt

SEQ ID NO: 1108 - DNA, 1147 bp, Populus trichocarpa
attttttttcctcaccgtgaccgtcctcgtcccaaacaaaagctgctgtcagacgttccaatctcaggccatcactctctgcgtatattatcgaccaaactgaaagtactttagcgagccaaacagcataaacatcttttttggaaggggtagtcagttgcaatttgcaaaaacagtctcttcttacctcgccctatatattaggatttatactcttcaaacgaagcgatggggagagccaaaaagggcccaaaatttgcaaaaatgaagacgatgattacctctagagcaattaaacaacataaagaagaagtcttgaatccaaagaaaagagatttgtacctcgaaaagctcccgagaaatgtgccacaggtttcttcagctctcttcttctcgtacaacacagctttggggccgccatacagggttttggtggataccaacttcatcaatttctctattcagaataaattggatttagagaaggcgatgctggactgcttgtatgcgaaatgcacaccttgtatcacggactgtgtgatggcagaacttgagaagttaggtcagaagtaccgtgtggctttaaggattgctaaggatccacgttttgagagactaccctgtgttcacaagggaacttatgctgatgattgtattgttgaaagggttaccaagcataaatgctatgttgttgctacatgtgatcgagatttaaagcgaaggatccgcaagatccctggtgtgccaatcatgtacattacgcaacacaaatactcgattgagcggttgcctgaagcaacagtaggtggagctccaaggtattgataagtttccagaatgggagaatagaggattttgcctggggctcttgaatgttatttatcccaccttctagagatataattgatgtcgtttaccatgcggtgacactcttgagtgtagttgtttcctccctccaaatgagggttgcaattttgtttcttttctgtgatgagaggaaatactccccgctatgcaactgtttttagctttttcactctgtttcattgccctatatggctatatcatgcttacagtctgaatcctgtattggtatttaacccttctgaagctccgccgtgttcctgaatttggtgataccgcgtga

SEQ ID NO: 1109 - DNA, 718 bp, Malus domestica
ctccttctccctccctccctgactaaccgttgcttttcatagaaaaagagtctagggtttttgcgcagtcccaaatctgttaacttgggtttgctctgcgactgaaaagatggggagagctaaaaaaagccctaaattctcagtcatgaagaaggtggtcacctccaaagcaattaaaagctacaaagaggcggttttgaatccgaacaagaaggatctcaccaaagaaatgctacccagaaatgtgccaaatgtttcttccgcgctgttctttaaatacaacactgctttgggaccgccttaccgggttttggttgataccaacttcatcaatttctctatccagaataagttggatttggagaagggaatgatggattgcctatacgcaaaatgcactccttgtatcacagattgtgtaatggcagagctcgagaagttaggtcagaaatatcgtgtggctctgaggattgctaaggatcctcgttttgagagactactctgcactcataaagggacttacgctgatgactgtattgttgaaagagttatccagcacaaatgctacattgttgctacatgcgatcgagatttaaagcgaaggatcagaaaggtccctggtgtgccaatcatgtacatcactcaacacaagtattcaattgagaggttgccagaagcaaccataggtggaggtaggcttagataccaaaaaactcac

SEQ ID NO: 1110 - DNA, 820 bp, Chelidonium majus
ttcgctttatctccatcaccatccacggattctcgattactcagaaatcaaagattttaggagtctgtagagggaggaggcaaataagaatcttggtccagtgttctcacagtagcgagcagtggtttattaagggtttcaaaatcctactgttgtgtttgtttgaactccagcagagagacaccagagtcaagagatggggaaggcgaagaaaggccctaagtttgccgtcatgaagagaaccattagctcaaaaatgattaagcagaataaagaagaggtcctaaaccctaagaagaaagatctcgagaaggaaaaccgtaccagaaatgtgccgaatgtttcgtcggctctgttcttcaaacacaacactgcgttggggccaccttatagggttttgattgataccaactttatcaatttctccattcagaataagttggatttagagaaagcaattgatggattgcctttatgcaaaatgtatccctgtatcacagattgcgtcatggcagagcttgagaagttaggtcagaagtaccgtgtggcgttaaggattgcgaaggatcctcggtttgagagactcccatgcactcacaaaggaacatatgctgatgactgcttggttgatagagttacacagcacaagtgctacattgttgcaacatgtgatagagacttgaagcgaagaatccgcaaggtacctggtgttccaatcatgtacatcactcaacgtaagtactcgatcgaacggctacctgaagcaaccatcggtggagctccaagatattgattaaagaagtgaggatgatctttcagc

SEQ ID NO: 1111 - DNA, 745 bp, Unknown
  Sequence found in Organisms: Euphorbia peplus, Euphorbia esula
ttttgcgccaccgctaccgaccggccgtcaccgccttcagcaaaacccttccgtcatagcttttgttctgattaagcattcgcttccactatcctttgagacagagacgacgtcttcatcagttttttgaggttttcaatttacagtattgacgatggggaaagcgaaaaagggccggaaattcgcagttatgaagaagatggtcacttccaaagcaattaaacaatacaaggaagacgtgttgaatccgaacaaaaaagatctctccaaggaaaagcttcctcgcaatgtaccgcgggtttcgtctgctctctacttcaaacacaacacagctttagggccaccttacagggttctggtcgataccaactttatcaatttttcaatccagaataaattagatttggagaaggctatgttggactgtttgtatgcaaaatgtacaccttgtataactgattgtgttatggcagagctcgagaagttaggtcagaaataccgtgtagctctgagaattgctaaggatccacgttttgatagaatatcttgtatccacaaagggacttatgctgatgactgtatcgttgatagggttactcagcataaatgttacattgttgctacatgtgatagagatttgaaacggagaatacgcaagattcctggtgttccaattatgtatatcactcaacacaaatattcaattgaaaggttacctgaggctacaattggtggagctccgaga

SEQ ID NO: 1112 - DNA, 1018 bp, Lippia dulcis
cagaaaccacgacaacaaatttatctccagcgcctgcaaatcacaattgaagatgggaaaagcgaagaaatcttctaagtttgctgttatgaagaaaatcgtcacccataaagcaatcaagcagtacaaggaggatgtcttgaaccctaacaggaaagacttgaccaaggagaaactcccccgaaatgtgccgcaagtttcatcagcgctttacttcaagcacaatactgctttagggccaccgtaccgtgtattggtggatactaatttcattaatttctctatccaaaataaattagatttggagaaagcaatgatggactgtttgtatgcaaaatgcactccttgcattacggattgtgttatggccgagcttgagaagttaggtcagaaataccgagttgctttgagaattgcaaaggatcctcgatttgaaaggcttccctgtatacacaaaggaacttatgctgatgattgtcttgttgacagggttacacagcataagtgctacattgttgcaacatgtgatcgggacctgaagagaagaatccgtaagatccctggtgtgccaattatgtacattacaaagcaccaatattccattgaacgactacctgaggctacgattggtggagctccaagagtttgaaactagggtcttcagaagttgaaaatctctgggactcgtttgctcgacaaccaccctagaaaacttccatcttgagacgacactttgtttattagagcttagaacatttatccgtgcattgcaactgggttgatgctgagtatataccaatacgaagtgatgagcgtgtctgaacttatagcagatggagcctgttctgaaacattatttcaagttagctattgaaagtagctgatatttggtgcaatggttagactaaatatagtaaacagcatgatatcttggtacttgtattactcccaacttatgttatgcattgacatgatgaacattaaatgattttagaaaaaagaaaaagtaccgactgcg

SEQ ID NO: 1113 - DNA, 838 bp, Primula obconica
ttagggtttttggtgcgcagactgagattagagcaatgggaagagcgaagaaaagccctaaattcgccgtcatgaagaacctcatctcttctaaagccatcaaacatcataaagaagaggttttgaaccctaacaagaaggatttgacaaagctaaatctccccagaaacgtgccaaatgttccatctgctcttttcttcaagtacaatactgccctgggtccgccttatcgggttttagttgatactaatttcatcaatttctccattcaaaataaattggatttggaggaagggatgaaggtttgcttatatgccaaatgcactccttgcattacggattgtgttatggcggagctcgaaaaattaggtcagaaataccgcgttgctttaaggatcgctaaagatcctcggtatgaaaggcttccttgtattcataaaggaacatatgctgatgattgcttggttgatagggttacccagcacaagtgttacatagttgctacatgcgatagagatttgaagcgaaggattcggaagatcccaggtgttcccatcatgtatattactcagcacaggtattcaatagagcgtttgcccgaagctacaattggcggagctccaagaatttgagactaccatttagtgataaaaagcgtgtggctatggcatcggagtccagaaaactatatatgttcaacggatgaagttaaccgatgaggggttctaaccatattttgtgggagttttcaaacaatttgaaagcctgatgaaaatctttttgattgcatatgtaggcatatcgtgtaatagcatgtttaattgtttatttccttttc

SEQ ID NO: 1114 - DNA, 1104 bp, Trigonella foenum-graecum
gggaatcaaatcaaactgtgccctaattttgctttcttcttcactgtctcaccgcccttcacttcacttcgcgatttttctcaaatctgtttcgctacaatgggtaaagctaaaaaaggacccaaattcgctgttatgaagaagatggtcacttccaaagcaatcaaaagctataaagaagcggttttgaacccagaaaagaaggacactctcaaagaaaagttacccagaaacgttcctaaactttcttcggcgcttttctttcaatacaatactgctttgggacctccttatcgtgttttggtcgataccaacttcatcaatttctccatccagaataaattggatttggagaaaggaatgatggactgcttatatgcaaaatgtaccccctgtatcacagactgtgtgatggcagaactagaaaagttgggcacaaaatatcgtgtagctctaaggattgcaaaggatcctcgatttcagagattaatctgtactcataagggtacctatgctgatgactgccttgttgagagagttactgagcgtaagtgcttcattgttgcaacatgtgatcgagacttaaagaggaggatccggaagatttctggagtgccaataatgtacatcaccaaacacaaatactcaatcgagcggttgcctgaagcaacaatgggtggagcacctagaatttgatgctgtaaaacaggaaaagctatgcaatactaaattttttgacacctttctgggtttagaagctattgttccatgcatgttttggtccttttgctggatggattggaatctaatagaagcttgacattgatcaagaagcaactctacaatggttgatctgttaaatttcctaggtgtaaacttggtagattcttggtgctgtcaaacttctttctttttatcctggttttgccttactaatgtatcaatgcgaaccttggcgagtgcctaagctatcgaggctcgtggcattttcatagttatagatgtaaacctattgaaataatacttaatttatgattgaaaattaaaaacattccgtatatgtgcaaatgtgaccagtgatatggattggaatgctgaagagta

SEQ ID NO: 1115 - DNA, 1140 bp, Medicago truncatula
gaaccaaattaaaacatccttaaaaaaaaaaaaaaccaaataaaaacatcaagctgtaaccctaattttgctttcttcttcacttcgtttttgtctggagtatagcgaaacctcggcaacagttcacgtttacagtgaagctataactactagcttgtcaatttcgcagaacaatgggtaaagctaagaaaggacccaaattcgctgttatgaagaagatggtcacttccaaagcaatcaaaagctataaagaagcggttttgaacccagaaaagaagaacactcttaaagaaaagttacccagaaacgttcctactcattcttcggcacttttctttcactacaacactgctttgggacctccttatcgtgttttggtcgataccaatttcatcaatttctccattcagaataaattggatttggagaaaggaatgatggactgcttatatgcaaaatgtaccccgtgtatcacagactgtgtgatggcagaactagagaagttgggcacaaaatatcgtgtagctctaaggattgcaaaggatcctcgatttgagagattactctgtactcataggggtacctatgctgatgactgccttgttgacagagttaccgagagtaaatgcttcattgtcgcgacatgtgatcgagacttgaagaggaggatccggaagattcctggtgtgccaataatgtacatcaccaaacatagatactcaatcgagcggttgcctgaagcaacaattggtggagcacctagaatctgatacagtaaaacagggaaagctatgcataccaaaaattttgtcactccttttctatgtttagaagcaactgtgtaccatgcatgtttgatccttttgctggctggattggaatctaattgaagcttgacagtgatcaaaaagcaactctacaatggttgatccgttgaatttccttagcgttacttggtagttttttggtgttgtcaaacagatgtatcaatgtgaactttggagtttggagagtgcctgatatttattgtggcttatcgcatttttttatagttatagatgtaaacctattgaaattaatactttatgattgaaaaagaaagtgttttagttgaatctgaatcgttgggttcatccttca

SEQ ID NO: 1116 - DNA, 852 bp, Carthamus tinctorius
  misc_feature (180)..(180): n is a, c, g, or t
  misc_feature (314)..(314): n is a, c, g, or t
  misc_feature (339)..(339): n is a, c, g, or t
  misc_feature (397)..(397): n is a, c, g, or t
  misc_feature (442)..(442): n is a, c, g, or t
  misc_feature (462)..(462): n is a, c, g, or t
  misc_feature (470)..(470): n is a, c, g, or t
  misc_feature (483)..(483): n is a, c, g, or t
  misc_feature (555)..(555): n is a, c, g, or t
aaaaaaatcgaacgctaggcgggggattcatcgcatccaccttcttctctatgcatcgcagggttttagggtttgcaagtattcctctgaatcagaaagagagatggggagagcgaagaagggtccgaaattcgcagtgatgaagaaacttgcatctcacaaagccatcaaacaacatanagaagaggttttgaaccctaataaaaaggacttaacaaaggagaagctccctagaaatgtaccctatgtttcttctgctctcttcttcacctacaacaccgctcttggaccgccttatcgagttttggtcgatnccaacttcatcaatttctccatccnaaataaattggacttggagaagggcatgatggactgcttatatgcaaaatgcactccntgtattaccgattgtgtgatggctgaacttgagaagcttggtcanaaatatcgtgttgctctcanaattgccnaggatcctagatntgaaaggcttccttgcactcacaaaggaacttatgctgatgactgcattgttgaaagagttactcagcacanatgttatatggtagcaacatgtgatagagatttgaagcgtaggattcgcaagatacctggtgtgccgattatgtacatcactcagcataaatactctattgaaagattgcctgaagcaactatgggtggagctccaagaatatgacatttgggcgtttttgcatgttatcgatgatagagttttatgttacccgaagaatagatgtttagaaatcggctcactactactaagcgactactgatcttcgagaatgcgtagtcgattctttttatgttgtgaattttgtgttatatctt

SEQ ID NO: 1117 - DNA, 1235 bp, Triticum aestivum
tttcttgttttttctacacgattgctccaatattttcatctcagtagaggcatcggcgcatcttgtttaccaaagcattattcaacatgtaaactgaaaggagcctgaaaactaaaattcaactcgaaacagtggccaccagacgcgtgcagatgtcaagccagacagccatcttcgtctacggcaagccggcgcccttctccctggcctgcctcttccgctcctcctgcgcgatcctgtccctctccttggtggcggcctcgacgtcgtcccacgttgagtgctcctccgccgtgctctctgaaccgaccttctccttcaccccttgcgcggcctcctttgtggcttcccaggcgccctgcgccgcctgcttcgccttctcgccgagcacctgcgcggtctccgccaccttgctcgcgccctccttggtcatctccgcaaccttctccccggcgctcctggtgccctccgcggccctgtccttggcctcgccggccttgtccatggcgccctccgccacctccgcggtcttctccttggccgcgcccgccgtctccttggccttgtcgatcgcctgccccgtcgtctccttagccctctccttcatctcccccgccttgtccgcggcctggcttgccgtctccttggtctcgtgcttggccttctccgtcatgcgggaggccctctctgcggcttcctccgccgtctccttggccctctccttcatctcccccgccttgtccgcggcctggtttgccgtctccttagtctcgtggttcgccttctccgtcatgcgggaggccttctcggcggcgtccccggccttgtccttggtctcatcggccatgcgcgacgcctggtccttcgcgctctccttggcatggccggtggcatccttggcctgctccgccgcgcccctgtacttgtccttgatctccctccggtcgtccggcgagttgttatacgcctgcgacgatctcggggcggtctgcatgcagatggggctccagctcgcggcatgcgggcggggagcgaggaagcagggcctgggaatggccttcacggcagtgtttccggtgagcgccgtggcgctggcgacccgcgctcctccgagaagcatggcggccatcaacctggacatggatgtactctgtcaggacggctcgatccgtcaatgcggcgaaatcttgcaagctttaagtcttggatcagctgtcaactatggtggttgtgcg

SEQ ID NO: 1118 - DNA, 1300 bp, Triticum aestivum
caactagtaggagacatcctcaatcagagagaggagacattgcagagctcaaaagaaatcttgttttttctacaagatcgctccaatatttttatctcgggggaggcatcggcgcatctgtttaccaaagcattattcaacatgtaaaccgaagaggctgaaaactaaaattcaactcgaaacagaggccagtagacgcgtgcagatgtcaagccagacagccatcttcttctacggcaagccggcgcccttctccctggcctgcctcttccgctcctcctgcgcgatcctgtccctctccttggtcgccgcctcgacgtcgtcccacgtcgagtgctcctccgccgtgctctctgaaccgaccttctccttcaccccttgcgcggcttcctttgtggcttcccaggcgccctgcgccgcctgcttcgccttctcgccgagcgcctgcgctgtctcggccaccttgctcgcgccctccttggtcatctccgccaccttctccccggcgctcctggtgccctccgcggccctgtccttggcctcgccggccttgtccatggcgccctccgccacctccgcggtcttctccttggccgcgcccgccgtctccttggccttgtcgatcgcctgccccgtcgtctccttggccctctccttcatttcccccgccttgtccgcggcctggcttgccgtctccttggtctcgtgcttggccttctccgtcatgcgggaggccctctctgcggcttcctccgccgtctccttggccctatccttcatctcccccgccttgtccgcggcctggcttgccgtctccttggtctcgtgcttcgccttgtccgtcatgcgggaggccttctcggcggcgtccccggccctgcccttggtctcgtcggccatgcgcgacgcctggtccttcgcgctctccttggcatggccggtggcgtccttggcctgctccgccgcgcccctgtacttgtccttgatctccctccggtcgtccggcgagttgttatacgcctgcgacgatctcggggcggtctgcaagcagatggggctccagttcgcggcatgcggccggggagcgaggaagcaaggcttaggaatggccttcacggcagtgttgccggtgagcgccgtggcgctggcgacccgcgcgcctccaagaagcatggcggccatcaacctggacatggatgtactctatcagcactgctcgatcagtcaatgcggcgaaatcttgaaagcttggaatcttggatcagttggcaacgacggtgcggaagcgtgggtcgcagta

SEQ ID NO: 1119 - DNA, 1244 bp, Triticum aestivum
  misc_feature (797)..(797): n is a, c, g, or t
caccgtcgttgccaactgatccaagattccaagctttcaagattccgccgcattgacggatcgagtagtgctgatagggtacgcccatgtccaggttgatggccgccatgcttctcggaggcgcgcgggtcgccagcgccacggcgctcaccggcaacactgccgtgaaggccattcccaggccctgcttcctcgctccccggccgcatgccgcgagctggagccccatctgcatgcagaccgccccgagatcgtcgcaggcgtataacaacgcgccggacgaccggagggagattaaggacaagtacaggggcgcagcggagcaggccaaggatgccaccggccatgccaaggagagcgcgaaggaccacgcgtcgcgcatggccgacgagaccaaggacagggccggggacgccgccgagaaggcctcccgcatgacggagaaggcgaagcacgagaccaaagagacggcaagccaggccgcggacaaggcgggagagatgaaggagaaggccaaggagacggcggaggaagccgcggagaaggcctcccgcatgacggagaaggccaagcacgagacgaaggagacggcaagccaggccgcgcacaaggcgggggagatgaaggagagggccaaggagacgacggggcaggcgatggacaaggccaaggagacggcgggcgcggccaaggagaagacggcggaggtggcggagggcgccatggacaaggccggcgaggccaaggacagggccgcggagggcaccaggagcgccggggagaaggtggcggagatnaccaaggagggcgcgagcaaggtggccgagacggcgcaggcgctcagcgagaaggcgaagcaggcggcgcagggcgcctgggaagccacaaaggaggccgcgcaaggggtgaaggagaaggtcggtacagagagcacggcggaggagcactcgacgtgggacgacgtcgaggccgccaccaaggagagggacaggatcgcgcaggaggagcggaagaggcaggccagggagaagggcgccggcttgccgtagacgaagatggctgtccggctggacatctccacgcgtctagtggcctctgtttcgagttgaattttagttttcagcctcttcggtttacatgttgaataatgctttggcaaacagatgcgccgatgcctcccctgagatgaaaatattggagcaatcgtgtagaaaaaacaagaaatttcttttgagctctgcaat

SEQ ID NO: 1120 - DNA, 1267 bp, Triticum aestivum
agctcacacgcacaaccaccatagttgacagctgatccaagacttaaagcttgcaagatttcgccgcattgacggatcgagccgtcctgacagagtacatccatgtccaggttgatggccgccatgcttctcggaggagcgcgggtcgccagcgccacggcgctcaccggaaacactgccgtgaaggccattcccaggccctgcttcctcgctccccgcccgcatgccgcgagctggagccccatctgcatgcagaccgccccgagatcgtcgcaggcgtataacaactcgccggacgaccggagggagatcaaggacaagtacaggggcgcggcggagcaggccaaggatgccaccggccatgccaaggagagcgcgaaggaccaggcgtcgcgcatggccgatgagaccaaggacaaggccggggacgccgccgagaaggcctcccgcatgacggagaaggcgaaccacgagactaaggagacggcaaaccaggccgcggacaaggcgggggagatgaaggagagggccaaggagacggcggaggaagccgcagagagggcctcccgcatgacggagaaggccaagcacgagaccaaggagacggcaagccaggccgcggacaaggcgggggagatgaaggagagggctaaggagacgacggggcaggcgatcgacaaggccaaggagacggcgggcgcggccaaggagaagaccgcggaggtggcggagggcgccatggacaaggccggcgaggccaaggacagggccgcggagggcaccaggagcgccggggagaaggttgcggagatgaccaaggagggcgcgagcaaggtggcggagaccgcgcaggtgctcggcgagaaggcgaagcaggcggcgcagggcgcctgggaagccacaaaggaggccgcgcaaggggtgaaggagaaggtcggttcagagagcacggcggaggagcactcaacgtgggacgacgtcgaggccgccaccaaggagagggacaggatcgcgcaggaggagcggaagaggcaggccagggagaagggcgccggcttgccgtagacgaagatggctgtctggcttgacatctgcacgcgtctggtggccactgtttcgagttgaattttagttttcaggctcctttcagtttacatgttgaataatgctttggtaaacaagatgcgccgatgcctctactgagatgaaaatattggagcaatcgtgtagaaaaaacaagaaaattttcttttgagctctgcaatgt

SEQ ID NO: 1121 - DNA, 1283 bp, Triticum aestivum
accaccgtcgttgccaactgatccaagattccaagctttcaagatttcgccgcattgactgatcgagcagtgctgatagagtacatccatgtccaggttgatggccgccatgcttcttggaggcgcgcgggtcgccagcgccacggcgctcaccggcaacactgccgtgaaggccattcctaagccttgcttcctcgctccccggccgcatgccgcgaactggagccccatctgcttgcagaccgccccgagatcgtcgcaggcgtataacaactcgccggacgaccggagggagatcaaggacaagtacaggggcgcggcggagcaggccaaggacgccaccggccatgccaaggagagcgcgaaggaccaggcgtcgcgcatggccgacgagaccaagggcagggccggggacgccgccgagaaggcctcccgcatgacggacaaggcgaagcacgagaccaaggagacggcaagccaggccgcggacaaggcgggggagatgaaggatagggccaaggagacggcggaggaagccgcagagagggcctcccgcatgacggagaaggccaagcacgagaccaaggagacggcaagccaggccgcggacaaggcgggggaaatgaaggagagggccaaggagacgacggggcaggcgatcgacaaggccaaggagacggcgggcgcggccaaggagaagaccgcggaggtggcggagggcgccatggacaaggccggcgaggccaaggacagggccgcggagggcaccaggagcgccggggagaaggtggcggagatgaccaaggagggcgcgagcaaggtggccgagacagcgcaggcgctcggcgagaaggcgaagcaggcggcgcagggcgcctgggaagccacaaaggaagccgcgcaaggggtgaaggagaaggtcggttcagagagcacggcggaggagcactcgacgtgggacgacgtcgaggcggcgaccaaggagagggacaggatcgcgcaggaggagcggaagaggcaggccagggagaagggcgccggcttgccgtagaagaagatggctgtctggcttgacatctgcacgcgtctactggcctctgtttcgagttgaattttagttttcagcctcttcggtttacatgttgaataatgctttggtaaacagatgcgccgatgcctcccccgagataaaaatattggagcgatcttgtagaaaaaacaagatttcttttgagctctgcaatgtctcctctctctgattgaggatgtctcctactagttga

SEQ ID NO: 1122 - DNA, 1415 bp, Pseudoroegneria spicata
  misc_feature (870)..(870): n is a, c, g, or t
  misc_feature (1054)..(1054): n is a, c, g, or t
cacacactagctaccatcgttgccaactgatccaagacttcaaagatttctccgcgttgatagagtacatccatgtccaggttgatggccgccatgcttctcggaggcgcgcgggtcgccagcgcgacggcgctcaccggaaacactgccgtgaaggccattcccaggccctgcttcctcgctccccggccgcatgccgcgagctggagccccatctgcttgcagaccgccccgagatcgtcgcaggcgtataacaactcgccggacgaccggagggagatcaaggacaagtacaggggcgcggcggagcaggccaaggacgccaccggcggtgccaaggaaagcgcgaagggccaggcgtcgcgcatggccgacgagaccaaggacaaggctggggacgccgccgagaaggcctcccgcatgacggagaaggcgaagcacgagaccaaggagacggcaagccaggccgcggacaagacggcggagatgaaggacagggccaaggagacggcggaggaagccgcggagaaggccaagcacgagacgaaggagacggcaagccaggccgcggacaaggcgggggagatgaaggagagggccaaggagacgacggggcaggcgatcgacaaggccaaggagacggcgggcgcggccaaggagaagacggcggaggtggcggagggcgccaaggacagggtcggcgaggccaaagacacggccgcggagggcaccaggagcgccggggagaaggtggcggagatgaccaaggagggcgcgagcaaggtggccgagacagcgcaggcgctcggagagaaggcgaagcaggcggcgcagggcgcctgggacgccaccaagggagccgcgcagggngtgaaggagaaggtcacctcggagagcacgacggaggagcactcgacgtgggacgatgttgaagccgccaccaaggggagggacaggatcgcgcaggaggagagcaagaggcaggccagggagaagggagccggcttgccgtagacgaagatggctgcctggctggctgcacactttgcattcncacgcgtttagtgccttctgttcagagttgaatttttagttttcagcctctttcagtttacatgttgaataatgcttgggtaaacagatgcgtcgatgcctcctgagatcggaacattggagcaatcgtgtagaaaaacgagataaaaattgggctttgcaatgtatgcagtttctcgctggaggacgtctcttcgggcattccaaagagaccctcaaagctcgggtatacttccgggtggaagtggtctgcaccgttttgtgtcaacttttgccatctaataaggaccctcattggttcgcgaaccacgtgcaaggtctcctttgctttctcaaccggagaaataaagattaatttgaga

SEQ ID NO: 1123 - DNA, 2921 bp, Triticum aestivum
acaaaagcaaacgcgctgctccactccgagccgcggccatggagctcgccaccgcggccgtcgtctccacagcctccatccaccccggccgcagccatttctcaaccccacgcgtagcctcctggtctagttcctcgtcgccgtcctcctctcggtccctgtccacctccgcctccacctcgcggtcccagaggcgtcgactccccgtcgcctcggccgccgtagagctccgcgaggccgccgcaggtggtggagactccgtccgcgtcatcgagacgccgcagcccaactccagtgttaagttcagcgtggaggtgcctccctcgatatgccaggagtgctaccaaacaactcttctcgagtactcaaagcgtttcaaggttcctggatttcggcctggaaagatagttccagaaaatgtacttttaaactacgttggaccacaacatgtacgggctgctacagttgaagctatcttaagacatacacttcctcaagcattgtcctcggtagaagagagggcattagaagattctgtgcgcattctcactaagtttgatgatatgaacgaggctttctcccttgaccatgtctttagatatgatgttgctgtggatgttgttcctgaagtccgttggttatctgaagacaaatataagaacctcaaagtggttattgaaatagatgaaattgttgatgcagaaaaggcagccgagttagagcttaagcgccgtcgtaaatctctagggctgcttcgaatagtacctgacagaggcctacaggtaggtgatctagttgtactggatatattggctgaaactatcacgaccgatggctctagaggtagaaaaaattccgtcagctgagggtacagggttccacttggacactgaggaaaatactaatcttgttcctggatttctgggttcgctaattgggattcgtcctggtgagactagaacttttcctattcagttccctgagtcgtttgagcaggaaactctacaaggtgtccgtgcccagtttactgttgtctgtaaagaacttttcttcagagagttgccagaattggatgattcgcttgccgcaaagctccttccaggatgcaataccatcgatgaggttaaagaacgaattttggaaagatgcaaagaagtggagaagacggctatagaacaagcaacagataatgcaatcctcgaccaactgggaaagttggtagacgttgatgttccacgttccttgtttcaagaacaaggccaacagttgtatggagcgaaacttctccaacttcaggccgaaaggaagctagacaaagaccagctagcatccctttcaagcgagaagtcggtccaggagtacctaaaaggtgagagggagaacattactaggatcattaagcaaatgttggttgttggtgaaatattcaaggccgaaaatttgcagtactcgacagaccaactcgtcaaggaagttgagaactctatagaagagttcaaacgctataatcaagactacgacgaggggaacatcaagcagcaggttcaggatgttctggaggctgccaaggtgctcgagtggctcaaggagaactgcacgatcgagtacatcaaaaaatgagcgcgacgctagatgctctgtcagttttcaaggatggcaggcgtgcaaactctctctggcctaccttggttttgcagacagaagagtttgctttgttcatagcacaagagagaagtctcgtttacatgtagatgtcaagtttgctctatacataccgaaagtgttactctagtcccgagctcaaatatcataaacagcatactatattgtgtgaggagtggacatccaaatactgttttttttctttacagcattaaatatccatttttgccaagacatagccaagttcgtcctgacaagcatgcaatggcgatagtccgcacaaatcctttggatctgattattcatgtgcaatcctgaaccggtcgattgagttggtgccatggccatgctctctccgggagttcatgaactcagtgacggtgaaagcccggtaacgctgctgctttcccgccgtcaagagctccgggaggggcccaaacaagtcggattcctggcgcttcgcaggattaaagaagagtgcaatggacaccctggcatcttgaccagacctgatcaccaccctgtgctccacgctcgcgtactcatcatttgaaaccaccttgagcacgtccccgatgttgaccagaagcgcgccgggcaccggcggcacgtcggcccaccgtccgtcgtggaggcgcacctgaagccctccgacgccgtcttgtgccaggacggtgaagaggctggggtctgtgtgctccgggcacggcgggtaatagtggcacgccatcagcacgccttccacctgcatcgccctctccagccgccccgcgccgacgccgagcgcctccgacagcagcccggccatcttcttcctgagctccgtcatgagcagctggtacttgagcagcgcgtcccggcaagccggcggcagatgggcgaggtcgggcgccggaggggggccgaagcggacctggagcgtgtcgcgccaggggaggagaggaccggcggaatttttgccgggctggatggggatggtggagtaggtgacgctcccgacggacgcgggcgtgtagaacgccgaacggacggtgaggggcagctcgtggaaggcccggacggcggacaccgcggagtcgacggcggcggcgtcgacgccgtggttggtgacatggaagaagccgcacgagcgcgcggcggcgcggatgagcggcaggctggatgagggcgggactgcgaggtcaacgcttgggatggtgaagaggatctccttctcgaatggcggtggggaggggctgccttgccgggtgcgaggaaga

SEQ ID NO: 1124 - DNA, 1868 bp, Leymus cinereus x Leymus triticoides
  misc_feature (9)..(10): n is a, c, g, or t
  misc_feature (20)..(20): n is a, c, g, or t
  misc_feature (28)..(28): n is a, c, g, or t
  misc_feature (227)..(227): n is a, c, g, or t
  misc_feature (581)..(581): n is a, c, g, or t
  misc_feature (617)..(617): n is a, c, g, or t
  misc_feature (1836)..(1837): n is a, c, g, or t
aaaacacanncgctgctccnctccgagncgcggccatggagctcgccaccgcggccgtcgtctccacagcttccatccacactggccgcagccatttctcaaccccacgcgcagcctcctggtctagttcctcgtcaccgtcctcctctcggtccctgtccacctccgcctccacctcgcggtcccagaggcgacgactccccgtcgcctcggccgccgtagagctncgcgaggccgccgcaggtggtggagactccgtccgcgtcatcgagacgccgcagcccaactccagtgttaagttcagcgtggaggtgcctccctcgatatgccaggagtgctaccaaacaactcttctcgagtactcaaagcgtttcaaggttcctggatttcggcctggaaagatagttccagaaaatgtacttttaaactacgttggaccgcaacatgtacgggctgctacagttgaagctatcttaagacatacacttcctcaagcattgtcctcggtagaagagagggcattagaagattctgtgcgcattctcactaagtttgatgatatgaacgaggctttctccctngaccatgtctttagatatgatgttgctgtggatgtngttcctgaagtccgttggttatctgaagacaaatataagaacctcaaagtggttattgaaatagatgaaattgttgatgcagaaaaggcagccgagttagagcttaagcgtcgtcgtaaatctctaggtctgcttcgaatagtacctgacagaggcctacaggtaggtgatctagtggtactggatatattggctgaaactatcacgaccgacggctctaaaggagaaaaaattccatcagctgagagtacagggttccacttggacactgaggaaaatactaatcttgttcctggatttctgggttcgctaattgggattcgtcctggtgagactagatcttttcctattcagttccctgagtcgtttgagcaggaaactctacaaggtgtccgtgcccagtttactgttgtctgtaaagaactcttcttcagagagttgccagaactggacgattcacttgccccaaagctccttccaggatgcactaccattgatcaggttaaagaacgaattttggaaagatgcaaagaagtggagaagacggctatagaacaagcaacagataatgcaatcctcgaccaactgggaaagttggtagacgttgatgttccacattccttgtttcaagaacaaggccagcagttgtatggagccaaacttctgcaacttcaggcagaaaggaagctagacaaagaccagctagcatccctttcgagcgaaaagtcggtccaggagtacctaaaaagtgagagggagaacattactaggatcattaaacaaatgttggttgttggtgaaatattcaaggccgaaaatttgcagtactcgacagaccagctcgtcaaggaagttgagaactctatagaagagttcaaacgctataatcaagactacgacgaggggaacatcaagcagcaggttcaggatgttctcgaggctgcaaaggtgcttgagtggctcaaggagaactgcacgatcgagtacatcagaaaatgagcgcgacgcaggatgctctgtcagttttcaaggatggcaggcgtgcaaactctctctggcctaccttggttttgcagacagaagggtctgctttgtttatagcacaagagagaagtctcgtttacatgtagatgtcaagtttgctctatacatacacggaggaagtcgactccgcaacagataattgtcactgttgttttgtttatacgaaatgaacggnnaagtttgctcaagagctatttaccttccaca

SEQ ID NO: 1125 - DNA, 1879 bp, Triticum aestivum
ctcgtcttctcccccacaaaagcaaacgcgctgctccactccgagccgcggccatggagctcgccaccgcggccgtcgtctccacagcctccatccaccccggccgcagccatttctcaaccgcacgcgtagcctcctggtctagttcctcgtcgccgtcctcctctcggtccctgtccacctccgcctccacctcgcggtcccagaggcgtcgactccccgtcgcctcggccgccgtagagctccgcgaggccgccgcaggtggtggagactccgtccgcgtcatcgagacgccgcagcccaactccagtgttaagttcagcgtggaggtgcctccctcgatatgccaggagtgctaccaaacaactcttctcgagtactcaaagcgtttcaaggttcctggatttcggcctggaaagatagttccagaaaatgtacttttaaactacgttggaccacaacatgtacgggctgctacagttgaagctatcttaagacatacacttcctcaagcattgtcctcggtagaagagagggcattagaagattctgtgcgcattctcactaagtttgatgatatgaacgaggctttctcccttgaccatgtctttagatatgatgttgctgtggatgttattcctgaagtccgttggttatctgaagacaaatataagaacctcaaagtggttattgaaatagatgaaattgttgatgcagaaaaggcagccgagttggagcttaagcgtcgtcgtaaatctctagggctgcttcgaatagtacctgacagaggcctacaggtaggcgatctagtggtactggatatattggctgaaactatcacaaccgacggctctaaaggtgaaaaaattccatcagctgagagtacagggttccacttggacactgaggaaaataataatcttgttcctggatttctgggttcgctaattgggattcgtcctggtgagactagaacttttcctattcagttccctgagtcatttgagcaggaaactctacaaggtgtccgtgcccagtttactgttgtctgtaaagaacttttcttcagagagctgccagaattggatgattcgcttgccgcaaagctccttccaggatgcaataccatcgatgaggttaaggaacgaattttggaaagatgcaaagaagtggagaagacggctatagaacaagcaacagataatgcaatcctcgaccaactgggaaagttggtagacgttgatgttccacgttccttgtttcaagaacaaggtcaacagttgtatggagcgaaacttctccaacttcaggcagaaaggaagctagacaaagaccagctagcatccctttcaagcgaaaagtctgtccaggagtacctgaaaagtgagagggagaacattgctaggatcattaagcaaatgttggttgttggtgaaatattcaaggctgaaaatttgcagtactcgacagaccaactcgtcaaggaagttgagaactctatagaagagttcaaacgctataatcaagactacgacgaggggaacatcaagcagcaggttcaggatgttctcgaggctgccaaggtgctcgagtggctcaaggagaactgcacgatcgagtacatcaaaaaatgagcgcgacgctagatgctctgtcagttttcaaggatggcaggcgtgcaaactctctctgctcccaccttggttttgcagacagaagggtttgctttgtttatagcacaagagagatgtatcgtttacatgtagatgtcaagtttgctctatacataccgaaagtgtcactctagtcccgagctcaaatatcataaacaacatactatattatgtgatgtgaggagtggatatccaaatattgtttt

SEQ ID NO: 1126 - DNA, 1985 bp, Brachypodium distachyon
ttcgcttatctccttcctaaatcctaatcccctcgtctctcttctcccccacaaaaacgaacgcgctgcttcgccccgaacctcggccatggagctcgccactgcggctgctgtcgtctccacagcctccacccatcccggccgcaaccgcttctactcctcacgctcggcctcgtggtctaactgctcaccactctcatcctctcgctctttgtccacgtcgacctcgcggttccagatacgaccactccccgttgcctgggcagccgtagagctccgagaggccgcttcagggggtggagactccgtccgtgtcaccgagacgctgcagcctggctccagtgtcaagttcagcgtggaagtgcctccctcgatatgtcaggaatgctacgaaactactcttatggagtactcgaagcgtttcaaggttcctggatttcggcctgggaaaatagttccagagaatgtacttataaactacgttgggccgcaacatgtacgggctgctacagttgaagctatcttaagacatacgcttcctcaagcgttgtcctcggtagaggagagggcattagaagattctgtacgcattcttactaagtttgatgatatgaataattcgttctccctggaggatgtatttagatatgatgttgctgtggatattattcctgaagtccggtggttatctgaagacaaatataagaacctcaaagttgttattgaaatagatgaaattgttgatgcagaaaaggcagccgaggtagagcttaaacgtcgccgtaaagctctagggctgcttcgaatagtgactgatagaggcctacaggtaggtgatttagcggtatttgatatatctgctgaaactataaccaccgatggctctaaaggtgaaaaaattccatcggctgagagcacagggttccacttggacactgaggaaaataataaccttgttcctggatttctgggttcgctaattgggattcgtcctggcgagactagatcatttcctattcagttccctgagtcatttgatcaagaaagtctacgaggtgtccgtgcccagtttactgttgtgtgtaaagaactcttcttcagacagttgccagaattggacgattcacttgccgaaaaactccttccaggatgcactaccatggatcaggttcgagaacgaattctggaaagatgcaaagaagtggagaagacagctatagaacaagcaacagataatgcaatcctcgatcagctgggacagttggttgaagttgatgttccacgctccttatttcaagaacaaggccaaatgttgtatggagccaaacttctgcaacttcaggcagaaacaaagctagatagagaccagctagcatccctttcaagtgaaaagtcagtccaggaatacctgaaaaatgagagggagaacattactaggatcattaaacaaatgttggctgttggtgaaatattcaaggctgaaaacttgcagtactcaaccgaacagctcatcaaggaagttgagaactctatagaagagttcaaacgctataatcaagactacgacgaggggaacatcaaacagcaggttcaggatgttctagaggctgcaaaggtgcttgaatggctcaaagagaactgcacgatcgagtacatcagacgatgagtgtgatgctagatgagctgccagttttcaaagatggcaggcatgcaaactctttgcgatatctttgttttgcagacctatgcaatgaagtgtttgttttgtgtatagcaagcagagaagcgtttatacgcagatgggaattgtagatgaagggcaagtctgttagtacatattcgtgctttgcacagaagtaatcgactctgcagcagataattgtcatgattctatttgtttacaaggaacgaacggataaattgtcttcgttgttacaggctcacagctatattgtttacgggaaatcaatgaataaatttccttc

SEQ ID NO: 1127 - DNA, 2023 bp, Oryza sativa
gcagagtctcttctttcactcgcttatctccccttccaaatcctaatccgctcgcctctcgtcttctcccccacaaaacccacacactcgcgcttggctcatcggctgcctccgcgagccgcggccatggagctcgccaccgccaccgccgccgccgccgcctcctccaccacccgtgctcaccgaccccgcagctccaggctcgcagtcccgacgagggacagctgctccctcctcccctcctcttcctcccgccagttcgccgcgctctccacgtcggcggcctccaccgcctcgcggtcacgggcgcagaggcggcggctccccgtcgcctcggccgccgtcgagctccgggaggcctcgtcgcagggcggagactccgtccgcgtcaccgagacgctgcagcccggctccagtgtcaagttcagtgtggaggtgcctccttccatatgccagcaatgctatgaaactactctacaagagtacgcaaagcgcttcaagattcctggatttcgtcccgggaaagtagttccagagaacgtacttataaactatgtaggaccaaaacacgtacaggatgctacagttgaagctatcttgaggcatacacttcctcaagcattgtcctcggtagaggacagggcattagaagattctgtacgcattctaacaaagtttgaagatatggcaaattcattctctcttgataatgtgtttagatatgatgtttctgtggatgttgcccctgaagtgagatggttatctgaagataaatataagaacctcaaagtggtcgttgaaatagatgaaattgttgatgctgaaaaggcagctgagatagaacttaaacgtcgtcataaagctctaggattactccgaatagttgctgacagaggactgcaggtaggtgatctggtggtactagatatatttgcagaaagtattaccagtgatggctctaaaggtgaaaaaattccatcagctgagagtaaaggtttccacttggacactgaggaaaacaataaccttgttcctggttttcttggttcgttaattggtattcgtcctggtgagactagatcatttcctcttcaattccctgagtcctttgaacaagaaagtctgcaaggtgtccgtgctcaatttactgttgtgtgcaaagagctcttctacagagagttgccagaattggatgactcacttgctggaaagctccttccaggctgcactaccatggatcaggttcgagaacgcattttgcaaagatgtaaagaagtggagaaaacagcaatagaacaagcaacagataatgcaatccttgatcagcttggaaagttagttgaagttgatgttccacgagccttatttcaagaacaaggccagcagttgtatggagccaaacttctacaactccaggcagaaaggaagctagataaagaccagctggcatccctttcaagccaaaagtcagttcaggaatacctagaaagtgagagagaaaatattaatagaatcattaaacaaatgttggctgttggtgaaatattcaaggctgaaaatctgcagttttcgaccgagcaactggtaaaggaagttgagaactctatagaagagttcaaacactataatcaagactatgatgaggggagcatcaagcagcaggttcaggatgttctagaggcagcgaaggtgctcgaatggctcaaggagaactgcattattgagtacattagaccatgaatctagtgtcaaagacagctggtgtgaaaattttgctgagttactttggttctactcgtacagataaaatgaagccttgtgccaactcattgcctaccgatggaatgtaaagtttgctttttatttatagcacaataaagagatatggttcacaaatagattgcaaatttctttcaaattctttgtattatatgtctataattgaacatggtacagataattgtcccaaaaagttgataataaggaatgaatgatgcgttgtgctactttttttttagggaaa

SEQ ID NO: 1128 - DNA, 1983 bp, Sorghum bicolor
aaaccgcgctgatcccgggcgcccgctttagttcactcccctgtcccctcctctccgcgcagcggcgaccaaaccatggagctgtccaccgtcgccgccgcagttgcctcggccgccgcgcgtccacacgggcatttctcctctccccgcgcggcctccgtctccgtctccgtctcgtggaacaacagtccctcgctcgcctccacctcacgacggcaaaggctgctgcggcggctccccgtcacctcggccgtcgtggagctccgccaagccgctgccgggggcggagactcgcttcgtgtcaccgagacgcggcagcctggatccagtgttaagttcagcgtggaggtgcctacttccatcattcacgactgttaccaaaccacgctacaggagtacgcgaaacgttttaaggttcctggatttcggcctgggaagatcattccagaaaacattcttataaactatgtaggaccgcaacatgtacaggatgccacaattgaagctgtcttgaaacatacacttcctcaagcattgtcctcggtagaggagagggcattagaagattctgttcgcattcttactcagtttgatgatatgagaaattctttctcactcgacaatgtgtttaggtatgatgttgctgtggatgttgtccctgaagtccgatggttatccgaagacaaatataagaacctcaaagttgtcgttgaaatagatgaagctgttgatgcagaaaaggcagcagaaaaagagcttcagcgacgtcataaagctctgggcttacttagagttgtggctgacagaggcctccagattggtgatctggtggtactagatatttttgcagacagcattaacagtgatggctctaaaggtgaaaaaatttcatctgccgagagtacaggtttccacttggacactgaggaaactaataaccttgttcctggatttcttggttcattaattgggattcgtcctggtgaagctagatcatttcctattcagttccctgagtcatttgagcaagaaagtctaagaggtgtccatgcacagtttactgttgtgtgtaaagagctcttctacagagagttgccagaaatgggtgactcacttgctgtaaagcttcttccaggatgcactacaatagacgaggttcgaggacgtattttggaaagatgtaaagaagtagagaaaatggccatagaacaagcaaccgataatgcaatccttgatcagctcgggaagttggttgaggttgatgttcctcgtgccttgtttcaagaacaaggccaacaactttacggagccaaacttctgcagcttcaggcagaaaggaagctagataaagaccagctagcatccttatcgacccagaggtcagttcaggcgtacctagaagatgagaaggagaatattacaagaatcattaaacagatgctggctgttggtgatgttttcaaatccgagaatttacagtactctactgaacagctcatcaaggaagttgaaaactccatagcagagttcaaacagtacaatcaagactatgatgaggacaacatcaggcaacaggtccaggatgttctagaggcagcgaaggtgcttgaatggctcaaggagaactgtacagtcgagtatatcaggcgatgagtctatgatgctgctgggtcaaggctctctgaacgtgagaaagatggctggtgtggcggtgggcaattttgtgagtgaccttggtccttgccaaccaacccatgcaatgaagaatcttgcgcatagcagaccagtgcagtgattaagattttgtttctatatagcataagaaagaagtatactatattttgtaagtacaatgcgagttcacaaaagttgtacccagtctttaagaggttgtaatccacatttcaacagatcagccttgcctcggttttttccttccccaaaccccactcatgtgggagcctctagcactgggtctgctct

SEQ ID NO: 1129 - DNA, 2495 bp, Triticum aestivum
tgatacgtctcagtggtatcaacgcagagtacccggacgcccgccgcctccaccgaggcgaaacctacgtcccgccgccgccgcctcacgccgagtaagtagccaagcttacatcggcaagatggtgcagtataatttcaagaaaatcactgttgtccctcctgggaaggacttcatcgacataatcttgtcccgcactcagaggcaaacaccaactgttgtccacaagggctatgctatcaaccgcattcgccagttctatatgcgcaaggttcgctatacccagcagaacttctatgaaaagctgtccaccatcatcgatgagttccccagactggatgacatccaccctttctatggcgatctccttcatgtgctctacaacaaggatcactacaaacttgccttgggtcagatcaatacagctagaaatatcattgcaaagatctccaaggactatctgaggctgctcaagtatggagacaccctgtaccggtgcaagtgcctgaaggtagctgctctcggtcgcatgtgtactgttctaaagcgtatcagtcctagtttggcatacctggagcagatcaggcagcacatggccaggcttccatcaattgacccaaacacccgtactatcttgatttgtgggtatccaaatgttgggaagagctctttcatgaacaaggttacaagggctgatgtggacgtacagccttatgctttcacaacaaaatccctttttgttggccatgcagattacaagtatctgcggtaccaagtgattgacactcctgggatccttgatcggccttttgaggacaggaacatcatagaaatgtgcagcatcaccgctctcgcccacttgagggctgctgtgctgttcttcttggacatctctggttcttgtgggtacactattgctcagcaagctgcactcttccacagtataaaatccttgttcatgaataagcctctggtcattgtgtgcaacaagactgatttgcagccgtttgatgggctttctgaagatgacatgaagctagtaatggagatgaagtcagaggctatgaagactatacctcaaggtggagatcctagtgaagagggtgttttgttgactatgagtgctttaacagatgagggtgtgatggctgttaaaaatgctgcatgtgagaggcttcttgagcagagggtggagatcaagatgaagtcaaagaagatcaatgactgcttaaacaggtttcatgttgctatgcccaagcctcgtgacaacagagataggcctacttgtattcctcaggctgttcttgaagctcaagcgattgctgctgcaaaggaaaagaagaaacttgagagggaccttgagaatgagaatggaggtgctggagtctattccgccagtctcaagaagcattacttgttggctgatgatgaatggaaggaagatattctccctgagatattggatggccataatgttgctgatttcctggatccggatatcttggaaaggtgtgaggagctggaaagggaggagggtcttcgtcttgaagaagaggctgctcaggatgctttcatgattgatggccatgatgaattaactgaagaacagcgagagatattgggtaagattaggaagaagaaggcaatgctcatccaagagcataggatgaagaagagtactgcagagagccgtcctattgttccaaggaagcatgacaaggataggaagttcacaaccaagagactgggcaggcaactcacatccatgggcgttgatcctactgcggctgtgaaccgacttcgcagccagtcaagaggccgtaagcgtgagaggtcactgagcagagctgatggtgacgacgctatggacgttgatggccagcactccgacaagaagctgcgtacgaggtcgaggtctaggtccaaatcacgaccaattgaagaggtcgtaccaggtgacgggatccgggacgttgctcaaaagaagaaggccatcaagaaatcgagggactctgtcaagaacaggaacaaggaggctcgccgtggagaggcggatcgcgtcatccccaccttgaaaccgaagcatctcttctctggaaaacgaggagttggaaagacccagaggcgataaaccagtcaatgtggacgttgctgcttgcaatcactcgatcaggaactattggatcactgccatttttcgtgctgggcatcgggggaggcttcagtgtcaatctggcagctggagatactactatctattgcaattttatttttatctggcatttgctctgtgttccgctttgtttgttagactacattgttgttgaactatatggttgtaccttcggtttactctgcacttgtgcggagcggagtcgaattttgtttgatggtgttattaatgtatttgaacgggccgcttgttttcctttttgtgaaatgttttgatactgtgatattgcaccttggtctggaacctgtgagtttcagtaatt

SEQ ID NO: 1130 - DNA, 2473 bp, Brachypodium distachyon
gtctttctcctccccaactctgcccgccgccacgcagagggggacgccgcctccgccccctaccagaggcgaaggaccgcctcctgctcctgttctctccgacgagtaattagcgaagctttgtattgacaagatggtgcagtataatttcaagaaaatcactgtggtccctcctgggaaggacttcattgacataatcttgtcccgcactcagaggcaaacaccgactgttgtccacaagggatatgctatcaaccgcattcgccagttctatatgcgtaaggttcggtatactcagcagaatttctatgagaagctgtccaccatcattgatgagtttcccagactggatgacatccatcctttctatggcgatctcctgcatgtgctctataacaaggatcactacaaacttgccttgggccagatcaatactgctagaaatatcgttgccaagatctccaaggactatttgaggctacttaagtatggagataccctgtaccggtgcaagtgcctgaaggtggctgcactaggtcgcatgtgtactgttataaagcggatcagtcctagtttggcatacttggagcagatcaggcagcacatggccaggcttccatcaatagacccaaacaccaggacaatattgatttgtggttacccaaatgttgggaagagctctttcatgaacaaggttacaagggcagatgtggacgtgcagccttatgcttttacaacaaaatctctgtttgttggccatgcagattacaagtatctgcggtaccaagtaattgatactccagggatccttgaccgaccttttgaggacaggaacatcatagaaatgtgcagtattactgctcttgcccacttgagggctgctgtgctgttcttcttagacatctctggatcttgtggttacacaattgctcagcaagccgcactcttccacagtataaaatccttgttcatgaataagcctctagtcattgtgtgcaacaagactgacttgcagccgcttgatgggctttctgaggaagatatgaagctagtgatggagatgaagtcggaggctatgaagactatacctcaaggtggagatcctagtgaagagggtgttttgttgactatgagcgctttaacagatgagggtgtcatggctgttaaaaatgctgcatgtgagaggcttcttgagcagagggtggagatcaagatgaaatcaaagaagatcaatgactgcttaaataggtttcatgttgctatgcccaaacctcgtgacaacagggagaggccaacttgcatcccagaggctgttctggaagctcaagcagttgctgctgcaaaggaaaagaagaaacttgagagggacctggagaatgagaatggtggtgctggtgtctattctgtcagtcttaagaagcattacatattggccaatgatgaatggaaggaagacattctgcctgagatattggatggtcataatgttgctgattttctggatccggatatcttggaaaggtgtgaagaattggaaagagaggagggtcttcgtcttgaagaagcagctgctcaagatgctttcatgattgatggacatgatgaattaactaaagaacagcgtgaaatcttgggtcagatcaggaagaagaaggcaatgctcatccaagagcatagaatgaagaagagaactgcggagagccgtcccattgttcctaggaagtttgacaaagataggaaattcacaaccaagagaatgggcaggcaactttcttccatgggcgttgatcctagtgcagctgtgagccgagttcgcagccagtcaagaggccgtaagcgtgagaggtcactgagcagagctgagggtgatgatatggagatcgatggccagcattccaacaagaaattgcggacaaggtctaggtccaagtcacgaccaattgaggaagtcgcaccaggtgaagggttcaaggactctgctcagaagaagaaggccatcaagaagtctagggactctgtgaagaacaggaacaaggaggctcgccgtggagaggccgatcgtgtcatccccaccctgaaaccaaagcatctcttctctgggaaacgaggtaatggaaagacaagcaggcgataagccaatcaacgcggacacagctacttatgatcactggaaaaggaactctagaatcgcagcaattttcggccttgggatatctggaggcttcaatatccagccggcagtaccgagttggaaactattacgttgtttcatggcttttactatcatttgggcatcgtcctcttgtgttagattatgttattgcagaactattgctaccttggtttttaaatgtgatagtattgagacgtgtcaaattttgtttaatgtttaccctttgttttaaggtatcagaaccttgtttcccttttatattgaaatacattgctactgtgatattgctgttttgtttct

SEQ ID NO: 1131 - DNA, 2000 bp, Avena sativa
gccacgcagagggggacgccgcctccaccgaggcgaagctccgtctcttgctcctcccgtcgccgccgccgccgccaccgcctaacgacgaatacgctatcaacttttctatcgccaagatggtgcagtataatttcaagaagatcactgttgtccctcctgggaaggacttcattgacataatcttgtcccgtactcagaggcaaacaccgactgttgtccacaagggctatgctatcaaccgcattcgccagttctatatgcgcaaagttcggtatacccagcagaacttctatgaaaagctgtccaccatcatagatgagttccccagactggatgacatccatcctttctacggtgatctccttcatgtgctatataacaaggatcactacaagcttgccttgggtcagatcaatacagcaagaaatattattgcaaagatctccaaggactatttgaggctgctcaagtatggagacaccctgtaccggtgcaagtgcttgaaggttgctgcactaggtcgcatgtgtactgtcttaaagcggatcacgcctagtttggcatacctggagcagatcaggcagcacatggccaggccttccgtcaatagaccccaacaccaggactatattgatttgtggatatccaaatgttgggaagagctctttcatgaacaaggttacaagggcagatgtggatgtgcagccctatgcttttacaacaaagtccctgtttgttggccatgcagattacaagtatctgcggtaccaagtgattgacactccagggatccttgatcggccttttgaggacagaaacatcatagaaatgtgcagtatcactgctctggcccacttgagggctgctgtgctcttcttcttggacatctctgggtcttgtgggtacactattgctcagcaagctgcactcttccacagcataaaatccttgttcatgaacaagcctctcgtgattgtgtgcaacaagactgacttgcagccccttgaagggctctctgaggaggacatgaagctggtaatggagatgaaatcagaagctatgaagactttacctcaaggtggagatcctaatgaggagggtgttttgttgactatgagcgctttgactgatgagggtgtgatggctgttaaaaatgctgcatgtgagcggcttcttgagcagagggttgagatcaagatgaaatcaaagaagatcaacgactgcttaaataggtttcatgttgctatgcccaagccccgtgacaacagagataggcccacctgcatccctcaggctgttcttgaagctcaagctgttgctgctgcaaaggaaaagaagaagcttgagagggaccttgagaatgagaatggaggtgctggtgtctattctgccagtctcaagaagcattacatactggccaatgatgaatggaaggaagacattctccctgagatattggatgggcataatgttgctgatttcctggaccctgacatcttggaaaggtgtgaggaactggaaagggaggagggtcttcgtcttgaggaggaagctgctcaagatgctttcatgatcgatggccatgatgaattaactgaagagcagcgtgaaatattgggtaagattaggaggaagaaggcaatcctcatccaggagcataggatgaagaagagcactgcggagagccgtcctattgttccaaggaagcatgacaaagataggaaattcacaaccaagagattgggcaggcaactgtcatccatgggtgttgatcccactgcagccgtgaacagacttcgcagccagtcaagaggccgaaagcgtgagaggtcactgagcaaagctgctgatggtgacgatatggaggtagatgggcagcactctgacaagaaactgcgaacaagatccaggtccaggtcccaatcacgaccaatgactgaggtcgtaccaggtgacgggctcagggactctgcccagaagaagaaggccatcaagaa

SEQ ID NO: 1132 - DNA, 2570 bp, Oryza sativa
acgcagaggggggacgccgccgccgccgccgccgaccacctccaggaggcaaggcatcgtatcccggtgctgattcacctgctcccgctcgcctccgccgccgtctcacgagtagtcatctgagctagtgaagatggtgcagtacaatttcaaacgaatcactgttgtccctcctgggaaggacttcattgacatcatcttgtcccgcacccagaggcaaacaccaactgttgtccataagggatattctatctcccgcattcgccagttttatatgcgaaaggttaagtatacacagtcaaacttctacgagaagctgtccactgttatcgatgacttcccaaggctggatgacatccatcctttctatggtgatctcctacatgttctgtacaacaaagatcactacaaacttgccttgggccaaatcaacactgccagaaatatcattgcaaagatagctaaggactatttgaggctgctcaagtatggagactcactgtaccggtgcaagtgcctgaaggtggctgccctaggtcgcatgtgtactgtcattaagcggatcagtcctagtttggcatacctggagcagatcaggcagcacatggcgaggcttccatctatagacccaaacaccaggactttattgatttgtggctatccaaatgttgggaagagctctttcatgaacaagatcacaagagcagatgtggatgtccagccttatgctttcacaactaagtctctgtttgttggtcatgctgattacaagtatttgcgctaccaagtgattgacactccagggatccttgatcggccttttgaggacaggaacatcatagaaatgtgcagcatcactgctcttgcccacttgagggctgctgtgctattcttcctggacatctctggttcttgtgggtacagtattgctcagcaagctgcacttttccacagtattaagtccttgttcatgaacaagcctctagtcattgtgtgcaacaagacggacttgcagcctcttgaaaatctgtctgaggaggacatgaagctggtaatggagatgaaagcggaggctatgaagactctaggtcatggtggagaagctaatgaagagggtgttttgttgactatgagtactttgactgaagagggtgtgatggctgtgaaaaatgctgcatgtgagaggcttcttgatcaaagggtggagatcaagatgaaatcaaagaagatcaatgactgcctaaataggtttcatgttgctatgccaaagcctcgtgataacaaggagaggcctgcttgcatccctcaggctgttctggatgctcgagcaagtgctgctgctgcaaaggaaaagaagaagctggaaaggaaactggagaaggacctcgagaatgagaatggaggtgctggggtctattctgctagtctcaagaagcattacttattggctgatgatgaatggaaggaagatattctgcctgagatattggatgggcataatgttgccgattttctggatccagatatactgcagaggtgtgaagagttggagagagaggagggtcttcgcctcgaagaggaagctgcacaggaagctttccagattgatggccatgaactaactgaagagcagcgtgaaatcttgggtcagattagaaagaagaaggcattgctcatccaagagcatagaatgaagaagaggactgcagaaagccgtcctattgttcctagaaagtttgacaaagacaggacattcacaactaatagaatgggtcgtcaactttcatccatgggttttgatcctagggcagctctggaccgagcccgcagccgttctagaggtcgcaagcgtgagaggtcacttagcagagctgctagtgatggtgatgatatggatatagatggccagcaatccagcaagaaattgcgcgcgttgtcgaggtccaggtctaggtcaaaatcaagaccacctgaggaggttgttccaggagaaggattcaaggactctgctcagaagaagaaggcgattaagaaagctaaggattctgtgaggaacaggaacaaggaggctcgtcgcggtgaggcggatcgtgtcattccaactttgaaaccaaagcatctattctctggaaaacgttctattggcaagacgagcaggcgataagtaattcagcactgctgcttagcatcactggtttcaggaagagcagtataattgcagttcggtgttgggattagggtgaaggaaggcctgtttatccaatctttaggacttgttctacgccgttattcatactgtctggtggattggtgttgtatcgcgtctcatccttcgactgagacataattttgttagcttatgtttcagctttatgctacattatatatggtttggctagtattaatagagtggtttaatttcgtcgaatggtactcactaccatcaatatcttataattgtgactttgttatacttatattccagtcctgttctactgtaccgatgctctactgtttgagatgcaatgttaaacttgttgagctggaacatcttgattagcactctccaa

(The sequence listing continues in the following parts.)

What is claimed is:

1. A nucleic acid construct comprising polynucleotide comprising a nucleic acid sequence encoding a polypeptide which comprises the amino acid sequence as set forth in SEQ ID NO: 492, and a promoter for directing transcription of said nucleic acid sequence in a plant cell, wherein said promoter is heterologous to said polynucleotide and/or to said plant cell.

2. A plant cell comprising the nucleic acid construct of claim 1.

3. The plant cell of claim 2, wherein said plant cell forms part of a plant.

4. A plant comprising the nucleic acid construct of claim 1.

5. A method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence encoding the polypeptide set forth by SEQ ID NO: 492, thereby increasing the abiotic stress tolerance, yield, biomass, growth rate, vigor, oil content, fiber yield, fiber quality, and/or nitrogen use efficiency of the plant.

6. The method of claim 5, wherein said exogenous polynucleotide comprises the nucleic acid sequence set forth by SEQ ID NO:293 or SEQ ID NO:19, or an optimized nucleic acid sequence of said SEQ ID NO:293 or of said SEQ ID NO:19.

7. The method of claim 5, wherein said exogenous polynucleotide comprises the nucleic acid sequence set forth by SEQ ID NO:293.

* * * * *